United States Patent 9,061,059 (MODIFIED POLYNUCLEOTIDES FOR TREATING PROTEIN DEFICIENCY) - sequence listing, part 45

SEQ ID NO: 83534 - DNA, 1821 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgacctacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83535 - DNA, 1920 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83536 - DNA, 1971 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgagaagaggcgaggccaccatcagaccccccccctgcgacgacaccaaggtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83537 - DNA, 1701 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83538 - DNA, 123 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaactag

SEQ ID NO: 83539 - DNA, 330 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgtag

SEQ ID NO: 83540 - DNA, 270 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgagaagaggcgaggccaccatcagaccccccccctgcgacgacaccaagggcggccaggactag

SEQ ID NO: 83541 - DNA, 330 bp, Artificial Sequence; identical to SEQ ID NO: 83539
  Description of Artificial Sequence: Synthetic coding sequence

SEQ ID NO: 83542 - DNA, 327 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgtag

SEQ ID NO: 83543 - DNA, 57 bp, Artificial Sequence
  Description of Artificial Sequence: Synthetic coding sequence
atgaagagctgcggcaagagattccacgacgaggtgggcaagttcagattcctgtag

SEQ ID NO: 83544 - DNA, 183 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgcctag

SEQ ID NO: 83545 - DNA, 87 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtag

SEQ ID NO: 83546 - DNA, 741 bp, Artificial Sequence
  Description of Artificial Sequence: Synthetic coding sequence
atgacccccggcaccgccaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagtag

SEQ ID NO: 83547 - DNA, 213 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggctag

SEQ ID NO: 83548 - DNA, 2172 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgaccgtgctggaggcctgcatgaagaactgcggcagaagattccacaacgaggtgggcaagttcagattcctgaacgagctgatcaaggtggtgagccccaagtacctgggcgacagagtgagcgagaaggtgaagaccaaggtgatcgagctgctgtacagctggaccatggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83549 - DNA, 2073 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgacctacctgggcgacagagtgagcgagaaggtgaagaccaaggtgatcgagctgctgtacagctggaccatggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83550 - DNA, 1956 bp, Artificial Sequence; identical to SEQ ID NO: 83528
  Description of Artificial Sequence: Synthetic coding sequence

SEQ ID NO: 83551 - DNA, 462 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgaccgtgctggaggcctgcatgaagaactgcggcagaagattccacaacgaggtgggcaagttcagattcctgaacgagctgatcaaggtggtgagccccaagtacctgggcgacagagtgagcgagaaggtgaagaccaaggtgatcgagctgctgtacagctggaccatggccctgcccgaggaggccaagatcaaggacgcctaccacatgctgaagagacaggccttcagccaggccgccgagaagcagaagcccagatag

SEQ ID NO: 83552 - DNA, 1806 bp, Artificial Sequence
  Description of Artificial Sequence: Synthetic coding sequence
atggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83553 - DNA, 918 bp, Artificial Sequence
  Description of Artificial Sequence: Synthetic coding sequence
atggccgccggcctggccagactgctgctgctgctgggcctgagcgccggcggccccgcccccgccggcgccgccaagatgaaggtggtggaggagcccaacgccttcggcgtgaacaaccccttcctgccccaggccagcagactgcaggccaagagagaccccagccccgtgagcggccccgtgcacctgttcagactgagcggcaagtgcttcagcctggtggagagcacctacaagtacgagttctgccccttccacaacgtgacccagcacgagcagaccttcagatggaacgcctacagcggcatcctgggcatctggcacgagtgggagatcgccaacaacaccttcaccggcatgtggatgagagacggcgacgcctgcagaagcagaagcagacagagcaaggtggagctggcctgcggcaagagcaacagactggcccacgtgagcgagcccagcacctgcgtgtacgccctgaccttcgagacccccctggtgtgccacccccacgccctgctggtgtaccccaccctgcccgaggccctgcagagacagtgggaccaggtggagcaggacctggccgacgagctgatcaccccccagggccacgagaagctgctgagaaccctgttcgaggacgccggctacctgaagacccccgaggagaacgagcccacccagctggagggcggccccgacagcctgggcttcgagaccctggagaactgcagaaaggcccacaaggagctgagcaaggagatcaagagactgaagggcctgctgacccagcacggcatcccctacaccagacccaccgagaccagcaacctggagcacctgggccacgagacccccagagccaagagccccgagcagctgagaggcgaccccggcctgagaggcagcctgtag

SEQ ID NO: 83554 - DNA, 4497 bp, Artificial Sequence; identical to SEQ ID NO: 75891
  Description of Artificial Sequence: Synthetic coding sequence

SEQ ID NO: 83555 - DNA, 4173 bp, Artificial Sequence
  Description of Artificial Sequence: Synthetic coding sequence
atggacggcgccagcgccgagcaggacggcctgcaggaggacagaagccacagcggccccagcagcctgcccgaggcccccctgaagccccccggccccctggtgccccccgaccagcaggacaaggtgcagtgcgccgaggtgaacagagccagcaccgagggcgagagccccgacggccccggccagggcggcctgtgccagaacggccccaccccccccttccccgacccccccagcagcctggaccccaccaccagccccgtgggccccgacgccagccccggcgtggccggcttccacgacaacctgagaaagagccagggcaccagcgccgagggcagcgtgagaaaggaggccctgcagagcctgagactgagcctgcccatgcaggagacccagctgtgcagcaccgacagccccctgcccctggagaaggaggagcaggtgagactgcaggccagaaagtggctggaggagcagctgaagcagtacagagtgaagagacagcaggagagaagcagccagcccgccaccaagaccagactgttcagcaccctggaccccgagctgatgctgaaccccgagaacctgcccagagccagcaccctggccatgaccaaggagtacagcttcctgagaaccagcgtgcccagaggccccaaggtgggcagcctgggcctgcccgcccaccccagagagaagaagaccagcaagagcagcaagatcagaagcctggccgactacagaaccgaggacagcaacgccggcaacagcggcggcaacgtgcccgcccccgacagcaccaagggcagcctgaagcagaacagaagcagcgccgccagcgtggtgagcgagatcagcctgagccccgacaccgacgacagactggagaacaccagcctggccggcgacagcgtgagcgaggtggacggcaacgacagcgacagcagcagctacagcagcgccagcaccagaggcacctacggcatcctgagcaagaccgtgggcacccaggacaccccctacatggtgaacggccaggagatccccgccgacaccctgggccagttccccagcatcaaggacgtgctgcaggccgccgccgccgagcaccaggaccagggccaggaggtgaacggcgaggtgagaagcagaagagacagcatctgcagcagcgtgagcctggagagcagcgccgccgagacccaggaggagatgctgcaggtgctgaaggagaagatgagactggagggccagctggaggccctgagcctggaggccagccaggccctgaaggagaaggccgagctgcaggcccagctggccgccctgagcaccaagctgcaggcccaggtggagtgcagccacagcagccagcagagacaggacagcctgagcagcgaggtggacaccctgaagcagagctgctgggacctggagagagccatgaccgacctgcagaacatgctggaggccaagaacgccagcctggccagcagcaacaacgacctgcaggtggccgaggagcagtaccagagactgatggccaaggtggaggacatgcagagaagcatgctgagcaaggacaacaccgtgcacgacctgagacagcagatgaccgccctgcagagccagctgcagcaggtgcagctggagagaaccaccctgaccagcaagctgaaggccagccaggccgagatcagcagcctgcagagcgtgagacagtggtaccagcagcagctggccctggcccaggaggccagagtgagactgcagggcgagatggcccacatccaggtgggccagatgacccaggccggcctgctggagcacctgaagctggagaacgtgagcctgagccagcagctgaccgagacccagcacagaagcatgaaggagaagggcagaatcgccgcccagctgcagggcatcgaggccgacatgctggaccaggaggccgccttcatgcagatccaggaggccaagaccatggtggaggaggacctgcagagaagactggaggagttcgagggcgagagagagagactgcagagaatggccgacagcgccgccagcctggagcagcagctggagcaggtgaagctgaccctgctgcagagagaccagcagctggaggccctgcagcaggagcacctggacctgatgaagcagctgaccctgacccaggaggccctgcagagcagagagcagagcctggacgccctgcagacccactacgacgagctgcaggccagactgggcgagctgcagggcgaggccgccagcagagaggacaccatctgcctgctgcagaacgagaagatcatcctggaggccgccctgcaggccgccaagagcggcaaggaggagctggacagaggcgccagaagactggaggagggcaccgaggagaccagcgagaccctggagaagctgagagaggagctggccatcaagagcggccaggtggagcacctgcagcaggagaccgccgccctgaagaagcagatgcagaagatcaaggagcagttcctgcagcagaaggtgatggtggaggcctacagaagagacgccaccagcaaggaccagctgatcagcgagctgaaggccaccagaaagagactggacagcgagctgaaggagctgagacaggagctgatgcaggtgcacggcgagaagagaaccgccgaggccgagctgagcagactgcacagagaggtggcccaggtgagacagcacatggccgacctggagggccacctgcagagcgcccagaaggagagagacgagatggagacccacctgcagagcctgcagttcgacaaggagcagatggtggccgtgaccgaggccaacgaggccctgaagaagcagatcgaggagctgcagcaggaggccagaaaggccatcaccgagcagaagcagaagatgagaagactgggcagcgacctgaccagcgcccagaaggagatgaagaccaagcacaaggcctacgagaacgccgtgggcatcctgagcagaagactgcaggaggccctggccgccaaggaggccgccgacgccgagctgggccagctgagagcccagggcggcagcagcgacagcagcctggccctgcacgagagaatccaggccctggaggccgagctgcaggccgtgagccacagcaagaccctgctggagaaggagctgcaggaggtgatcgccctgaccagccaggagctggaggagagcagagagaaggtgctggagctggaggacgagctgcaggagagcagaggcttcagaaagaagatcaagagactggaggagagcaacaagaagctggccctggagctggagcacgagaagggcaagctgaccggcctgggccagagcaacgccgccctgagagagcacaacagcatcctggagaccgccctggccaagagagaggccgacctggtgcagctgaacctgcaggtgcaggccgtgctgcagagaaaggaggaggaggacagacagatgaagcacctggtgcaggccctgcaggccagcctggagaaggagaaggagaaggtgaacagcctgaaggagcaggtggccgccgccaaggtggaggccggccacaacagaagacacttcaaggccgccagcctggagctgagcgaggtgaagaaggagctgcaggccaaggagcacctggtgcagaagctgcaggccgaggccgacgacctgcagatcagagagggcaagcacagccaggagatcgcccagttccaggccgagctggccgaggccagagcccagctgcagctgctgcagaagcagctggacgagcagctgagcaagcagcccgtgggcaaccaggagatggagaacctgaagtgggaggtggaccagaaggagagagagatccagagcctgaagcagcagctggacctgaccgagcagcagggcagaaaggagctggagggcctgcagcagctgctgcagaacgtgaagagcgagctggagatggcccaggaggacctgagcatgacccagaaggacaagttcatgctgcaggccaaggtgagcgagctgaagaacaacatgaagaccctgctgcagcagaaccagcagctgaagctggacctgagaagaggcgccgccaagaccgtgctgagacccgccagcctgcccggctag

SEQ ID NO: 83556 - DNA, 3405 bp, Artificial Sequence
  Description of Artificial Sequence: Synthetic coding sequence
atggacggcgccagcgccgagcaggacggcctgcaggaggacagaagccacagcggccccagcagcctgcccgaggcccccctgaagccccccggccccctggtgccccccgaccagcaggacaaggtgcagtgcgccgaggtgaacagagccagcaccgagggcgagagccccgacggccccggccagggcggcctgtgccagaacggccccaccccccccttccccgacccccccagcagcctggaccccaccaccagccccgtgggccccgacgccagccccggcgtggccggcttccacgacaacctgagaaagagccagggcaccagcgccgagggcagcgtgagaaaggaggccctgcagagcctgagactgagcctgcccatgcaggagacccagctgtgcagcaccgacagccccctgcccctggagaaggaggagcaggtgagactgcaggccagaaagtggctggaggagcagctgaagcagtacagagtgaagagacagcaggagagaagcagccagcccgccaccaagaccagactgttcagcaccctggaccccgagctgatgctgaaccccgagaacctgcccagagccagcaccctggccatgaccaaggagtacagcttcctgagaaccagcgtgcccagaggccccaaggtgggcagcctgggcctgcccgcccaccccagagagaagaagaccagcaagagcagcaagatcagaagcctggccgactacagaaccgaggacagcaacgccggcaacagcggcggcaacgtgcccgcccccgacagcaccaagggcagcctgaagcagaacagaagcagcgccgccagcgtggtgagcgagatcagcctgagccccgacaccgacgacagactggagaacaccagcctggccggcgacagcgtgagcgaggtggacggcaacgacagcgacagcagcagctacagcagcgccagcaccagaggcacctacggcatcctgagcaagaccgtgggcacccaggacaccccctacatggtgaacggccaggagatccccgccgacaccctgggccagttccccagcatcaaggacgtgctgcaggccgccgccgccgagcaccaggaccagggccaggaggtgaacggcgaggtgagaagcagaagagacagcatctgcagcagcgtgagcctggagagcagcgccgccgagacccaggaggagatgctgcaggtgctgaaggagaagatgagactggagggccagctggaggccctgagcctggaggccagccaggccctgaaggagaaggccgagctgcaggcccagctggccgccctgagcaccaagctgcaggcccaggtggagtgcagccacagcagccagcagagacaggacagcctgagcagcgaggtggacaccctgaagcagagctgctgggacctggagagagccatgaccgacctgcagaacatgctggaggccaagaacgccagcctggccagcagcaacaacgacctgcaggtggccgaggagcagtaccagagactgatggccaaggtggaggacatgcagagaagcatgctgagcaaggacaacaccgtgcacgacctgagacagcagatgaccgccctgcagagccagctgcagcaggtgcagctggagagaaccaccctgaccagcaagctgaaggccagccaggccgagatcagcagcctgcagagcgtgagacagtggtaccagcagcagctggccctggcccaggaggccagagtgagactgcagggcgagatggcccacatccaggtgggccagatgacccaggccggcctgctggagcacctgaagctggagaacgtgagcctgagccagcagctgaccgagacccagcacagaagcatgaaggagaagggcagaatcgccgcccagctgcagggcatcgaggccgacatgctggaccaggaggccgccttcatgcagatccaggaggccaagaccatggtggaggaggacctgcagagaagactggaggagttcgagggcgagagagagagactgcagagaatggccgacagcgccgccagcctggagcagcagctggagcaggtgaagctgaccctgctgcagagagaccagcagctggaggccctgcagcaggagcacctggacctgatgaagcagctgaccctgacccaggaggccctgcagagcagagagcagagcctggacgccctgcagacccactacgacgagctgcaggccagactgggcgagctgcagggcgaggccgccagcagagaggacaccatctgcctgctgcagaacgagaagatcatcctggaggccgccctgcaggccgccaagagcggcaaggaggagctggacagaggcgccagaagactggaggagggcaccgaggagaccagcgagaccctggagaagctgagagaggagctggccatcaagagcggccaggtggagcacctgcagcaggagaccgccgccctgaagaagcagatgcagaagatcaaggagcagttcctgcagcagaaggtgatggtggaggcctacagaagagacgccaccagcaaggaccagctgatcagcgagctgaaggccaccagaaagagactggacagcgagctgaaggagctgagacaggagctgatgcaggtgcacggcgagaagagaaccgccgaggccgagctgagcagactgcacagagaggtggcccaggtgagacagcacatggccgacctggagggccacctgcagagcgcccagaaggagagagacgagatggagacccacctgcagagcctgcagttcgacaaggagcagatggtggccgtgaccgaggccaacgaggccctgaagaagcagatcgaggagctgcagcaggaggccagaaaggccatcaccgagcagaagcagaagatgagaagactgggcagcgacctgaccagcgcccagaaggagatgaagaccaagcacaaggcctacgagaacgccgtgggcatcctgagcagaagactgcaggaggccctggccgccaaggaggccgccgacgccgagctgggccagctgagagcccagggcggcagcagcgacagcagcctggccctgcacgagagaatccaggccctggaggccgagctgcaggccgtgagccacagcaagaccctgctggagaaggagctgcaggaggtgatcgccctgaccagccaggagctggaggagagcagagagaaggtgctggagctggaggacgaggtgagacccggccacctgctgtggagacagagaggcgccggccacgtgagccccggccacgccgccaccagagagaccagaagaaccaagctgcacagagtgcccagcgtggccaccttcggcgtggccaccttctag

SEQ ID NO: 83557 - DNA, 6693 bp, Artificial Sequence
  Description of Artificial Sequence: Synthetic coding sequence
atgttcaagaagctgaagcagaagatcagcgaggagcagcagcagctgcagcaggccctggcccccgcccaggccagcagcaacagcagcacccccaccagaatgagaagcagaaccagcagcttcaccgagcagctggacgagggcacccccaacagagagagcggcgacacccagagcttcgcccagaagctgcagctgagagtgcccagcgtggagagcctgttcagaagccccatcaaggagagcctgttcagaagcagcagcaaggagagcctggtgagaaccagcagcagagagagcctgaacagactggacctggacagcagcaccgccagcttcgacccccccagcgacatggacagcgaggccgaggacctggtgggcaacagcgacagcctgaacaaggagcagctgatccagagactgagaagaatggagagaagcctgagcagctacagaggcaagtacagcgagctggtgaccgcctaccagatgctgcagagagagaagaagaagctgcagggcatcctgagccagagccaggacaagagcctgagaagaatcgccgagctgagagaggagctgcagatggaccagcaggccaagaagcacctgcaggaggagttcgacgccagcctggaggagaaggaccagtacatcagcgtgctgcagacccaggtgagcctgctgaagcagagactgagaaacggccccatgaacgtggacgtgctgaagcccctgccccagctggagccccaggccgaggtgttcaccaaggaggagaaccccgagagcgacggcgagcccgtggtggaggacggcaccagcgtgaagaccctggagaccctgcagcagagagtgaagagacaggagaacctgctgaagagatgcaaggagaccatccagagccacaaggagcagtgcaccctgctgaccagcgagaaggaggccctgcaggagcagctggacgagagactgcaggagctggagaagatcaaggacctgcacatggccgagaagaccaagctgatcacccagctgagagacgccaagaacctgatcgagcagctggagcaggacaagggcatggtgatcgccgagaccaagagacagatgcacgagaccctggagatgaaggaggaggagatcgcccagctgagaagcagaatcaagcagatgaccacccagggcgaggagctgagagagcagaaggagaagagcgagagagccgccttcgaggagctggagaaggccctgagcaccgcccagaagaccgaggaggccagaagaaagctgaaggccgagatggacgagcagatcaagaccatcgagaagaccagcgaggaggagagaatcagcctgcagcaggagctgagcagagtgaagcaggaggtggtggacgtgatgaagaagagcagcgaggagcagatcgccaagctgcagaagctgcacgagaaggagctggccagaaaggagcaggagctgaccaagaagctgcagaccagagagagagagttccaggagcagatgaaggtggccctggagaagagccagagcgagtacctgaagatcagccaggagaaggagcagcaggagagcctggccctggaggagctggagctgcagaagaaggccatcctgaccgagagcgagaacaagctgagagacctgcagcaggaggccgagacctacagaaccagaatcctggagctggagagcagcctggagaagagcctgcaggagaacaagaaccagagcaaggacctggccgtgcacctggaggccgagaagaacaagcacaacaaggagatcaccgtgatggtggagaagcacaagaccgagctggagagcctgaagcaccagcaggacgccctgtggaccgagaagctgcaggtgctgaagcagcagtaccagaccgagatggagaagctgagagagaagtgcgagcaggagaaggagaccctgctgaaggacaaggagatcatcttccaggcccacatcgaggagatgaacgagaagaccctggagaagctggacgtgaagcagaccgagctggagagcctgagcagcgagctgagcgaggtgctgaaggccagacacaagctggaggaggagctgagcgtgctgaaggaccagaccgacaagatgaagcaggagctggaggccaagatggacgagcagaagaaccaccaccagcagcaggtggacagcatcatcaaggagcacgaggtgagcatccagagaaccgagaaggccctgaaggaccagatcaaccagctggagctgctgctgaaggagagagacaagcacctgaaggagcaccaggcccacgtggagaacctggaggccgacatcaagagaagcgagggcgagctgcagcaggccagcgccaagctggacgtgttccagagctaccagagcgccacccacgagcagaccaaggcctacgaggagcagctggcccagctgcagcagaagctgctggacctggagaccgagagaatcctgctgaccaagcaggtggccgaggtggaggcccagaagaaggacgtgtgcaccgagctggacgcccacaagatccaggtgcaggacctgatgcagcagctggagaagcagaacagcgagatggagcagaaggtgaagagcctgacccaggtgtacgagagcaagctggaggacggcaacaaggagcaggagcagaccaagcagatcctggtggagaaggagaacatgatcctgcagatgagagagggccagaagaaggagatcgagatcctgacccagaagctgagcgccaaggaggacagcatccacatcctgaacgaggagtacgagaccaagttcaagaaccaggagaagaagatggagaaggtgaagcagaaggccaaggagatgcaggagaccctgaagaagaagctgctggaccaggaggccaagctgaagaaggagctggagaacaccgccctggagctgagccagaaggagaagcagttcaacgccaagatgctggagatggcccaggccaacagcgccggcatcagcgacgccgtgagcagactggagaccaaccagaaggagcagatcgagagcctgaccgaggtgcacagaagagagctgaacgacgtgatcagcatctgggagaagaagctgaaccagcaggccgaggagctgcaggagatccacgagatccagctgcaggagaaggagcaggaggtggccgagctgaagcagaagatcctgctgttcggctgcgagaaggaggagatgaacaaggagatcacctggctgaaggaggagggcgtgaagcaggacaccaccctgaacgagctgcaggagcagctgaagcagaagagcgcccacgtgaacagcctggcccaggacgagaccaagctgaaggcccacctggagaagctggaggtggacctgaacaagagcctgaaggagaacaccttcctgcaggagcagctggtggagctgaagatgctggccgaggaggacaagagaaaggtgagcgagctgaccagcaagctgaagaccaccgacgaggagttccagagcctgaagagcagccacgagaagagcaacaagagcctggaggacaagagcctggagttcaagaagctgagcgaggagctggccatccagctggacatctgctgcaagaagaccgaggccctgctggaggccaagaccaacgagctgatcaacatcagcagcagcaagaccaacgccatcctgagcagaatcagccactgccagcacagaaccaccaaggtgaaggaggccctgctgatcaagacctgcaccgtgagcgagctggaggcccagctgagacagctgaccgaggagcagaacaccctgaacatcagcttccagcaggccacccaccagctggaggagaaggagaaccagatcaagagcatgaaggccgacatcgagagcctggtgaccgagaaggaggccctgcagaaggagggcggcaaccagcagcaggccgccagcgagaaggagagctgcatcacccagctgaagaaggagctgagcgagaacatcaacgccgtgaccctgatgaaggaggagctgaaggagaagaaggtggagatcagcagcctgagcaagcagctgaccgacctgaacgtgcagctgcagaacagcatcagcctgagcgagaaggaggccgccatcagcagcctgagaaagcagtacgacgaggagaagtgcgagctgctggaccaggtgcaggacctgagcttcaaggtggacaccctgagcaaggagaagatcagcgccctggagcaggtggacgactggagcaacaagttcagcgagtggaagaagaaggcccagagcagattcacccagcaccagaacaccgtgaaggagctgcagatccagctggagctgaagagcaaggaggcctacgagaaggacgagcagatcaacctgctgaaggaggagctggaccagcagaacaagagattcgactgcctgaagggcgagatggaggacgacaagagcaagatggagaagaaggagagcaacctggagaccgagctgaagagccagaccgccagaatcatggagctggaggaccacatcacccagaagaccatcgagatcgagagcctgaacgaggtgctgaagaactacaaccagcagaaggacatcgagcacaaggagctggtgcagaagctgcagcacttccaggagctgggcgaggagaaggacaacagagtgaaggaggccgaggagaagatcctgaccctggagaaccaggtgtacagcatgaaggccgagctggagaccaagaagaaggagctggagcacgtgaacctgagcgtgaagagcaaggaggaggagctgaaggccctggaggacagactggagagcgagagcgccgccaagctggccgagctgaagagaaaggccgagcagaagatcgccgccatcaagaagcagctgctgagccagatggaggagaaggaggagcagtacaagaagggcaccgagagccacctgagcgagctgaacaccaagctgcaggagagagagagagaggtgcacatcctggaggagaagctgaagagcgtggagagcagccagagcgagaccctgatcgtgcccagaagcgccaagaacgtggccgcctacaccgagcaggaggaggccgacagccagggctgcgtgcagaagacctacgaggagaagatcagcgtgctgcagagaaacctgaccgagaaggagaagctgctgcagagagtgggccaggagaaggaggagaccgtgagcagccacttcgagatgagatgccagtaccaggagagactgatcaagctggagcacgccgaggccaagcagcacgaggaccagagcatgatcggccacctgcaggaggagctggaggagaagaacaagaagtacagcctgatcgtggcccagcacgtggagaaggagggcggcaagaacaacatccaggccaagcagaacctggagaacgtgttcgacgacgtgcagaagaccctgcaggagaaggagctgacctgccagatcctggagcagaagatcaaggagctggacagctgcctggtgagacagaaggaggtgcacagagtggagatggaggagctgaccagcaagtacgagaagctgcaggccctgcagcagatggacggcagaaacaagcccaccgagctgctggaggagaacaccgaggagaagagcaagagccacctggtgcagcccaagctgctgagcaacatggaggcccagcacaacgacctggagttcaagctggccggcgccgagagagagaagcagaagctgggcaaggagatcgtgagactgcagaaggacctgagaatgctgagaaaggagcaccagcaggagctggagatcctgaagaaggagtacgaccaggagagagaggagaagatcaagcaggagcaggaggacctggagctgaagcacaacagcaccctgaagcagctgatgagagagttcaacacccagctggcccagaaggagcaggagctggagatgaccatcaaggagaccatcaacaaggcccaggaggtggaggccgagctgctggagagccaccaggaggagaccaaccagctgctgaagaagatcgccgagaaggacgacgacctgaagagaaccgccaagagatacgaggagatcctggacgccagagaggaggagatgaccgccaaggtgagagacctgcagacccagctggaggagctgcagaagaagtaccagcagaagctggagcaggaggagaaccccggcaacgacaacgtgaccatcatggagctgcagacccagctggcccagaagaccaccctgatcagcgacagcaagctgaaggagcaggagttcagagagcagatccacaacctggaggacagactgaagaagtacgagaagaacgtgtacgccaccaccgtgggcaccccctacaagggcggcaacctgtaccacaccgacgtgagcctgttcggcgagcccaccgagttcgagtacctgagaaaggtgctgttcgagtacatgatgggcagagagaccaagaccatggccaaggtgatcaccaccgtgctgaagttccccgacgaccagacccagaagatcctggagagagaggacgccagactgatgttcaccagccccagaagcggcatcttctag

SEQ ID NO: 83558 - DNA, 6732 bp, Artificial Sequence
  Description of Artificial Sequence: Synthetic coding sequence
atgttcaagaagctgaagcagaagatcagcgaggagcagcagcagctgcagcaggccctggcccccgcccaggccagcagcaacagcagcacccccaccagaatgagaagcagaaccagcagcttcaccgagcagctggacgagggcacccccaacagagagaacgccagcacccacgccagcaagagccccgacagcgtgaacggcagcgagcccagcatcccccagagcggcgacacccagagcttcgcccagaagctgcagctgagagtgcccagcgtggagagcctgttcagaagccccatcaaggagagcctgttcagaagcagcagcaaggagagcctggtgagaaccagcagcagagagagcctgaacagactggacctggacagcagcaccgccagcttcgacccccccagcgacatggacagcgaggccgaggacctggtgggcaacagcgacagcctgaacaaggagcagctgatccagagactgagaagaatggagagaagcctgagcagctacagaggcaagtacagcgagctggtgaccgcctaccagatgctgcagagagagaagaagaagctgcagggcatcctgagccagagccaggacaagagcctgagaagaatcgccgagctgagagaggagctgcagatggaccagcaggccaagaagcacctgcaggaggagttcgacgccagcctggaggagaaggaccagtacatcagcgtgctgcagacccaggtgagcctgctgaagcagagactgagaaacggccccatgaacgtggacgtgctgaagcccctgccccagctggagccccaggccgaggtgttcaccaaggaggagaaccccgagagcgacggcgagcccgtggtggaggacggcaccagcgtgaagaccctggagaccctgcagcagagagtgaagagacaggagaacctgctgaagagatgcaaggagaccatccagagccacaaggagcagtgcaccctgctgaccagcgagaaggaggccctgcaggagcagctggacgagagactgcaggagctggagaagatcaaggacctgcacatggccgagaagaccaagctgatcacccagctgagagacgccaagaacctgatcgagcagctggagcaggacaagggcatggtgatcgccgagaccaagagacagatgcacgagaccctggagatgaaggaggaggagatcgcccagctgagaagcagaatcaagcagatgaccacccagggcgaggagctgagagagcagaaggagaagagcgagagagccgccttcgaggagctggagaaggccctgagcaccgcccagaagaccgaggaggccagaagaaagctgaaggccgagatggacgagcagatcaagaccatcgagaagaccagcgaggaggagagaatcagcctgcagcaggagctgagcagagtgaagcaggaggtggtggacgtgatgaagaagagcagcgaggagcagatcgccaagctgcagaagctgcacgagaaggagctggccagaaaggagcaggagctgaccaagaagctgcagaccagagagagagagttccaggagcagatgaaggtggccctggagaagagccagagcgagtacctgaagatcagccaggagaaggagcagcaggagagcctggccctggaggagctggagctgcagaagaaggccatcctgaccgagagcgagaacaagctgagagacctgcagcaggaggccgagacctacagaaccagaatcctggagctggagagcagcctggagaagagcctgcaggagaacaagaaccagagcaaggacctggccgtgcacctggaggccgagaagaacaagcacaacaaggagatcaccgtgatggtggagaagcacaagaccgagctggagagcctgaagcaccagcaggacgccctgtggaccgagaagctgcaggtgctgaagcagcagtaccagaccgagatggagaagctgagagagaagtgcgagcaggagaaggagaccctgctgaaggacaaggagatcatcttccaggcccacatcgaggagatgaacgagaagaccctggagaagctggacgtgaagcagaccgagctggagagcctgagcagcgagctgagcgaggtgctgaaggccagacacaagctggaggaggagctgagcgtgctgaaggaccagaccgacaagatgaagcaggagctggaggccaagatggacgagcagaagaaccaccaccagcagcaggtggacagcatcatcaaggagcacgaggtgagcatccagagaaccgagaaggccctgaaggaccagatcaaccagctggagctgctgctgaaggagagagacaagcacctgaaggagcaccaggcccacgtggagaacctggaggccgacatcaagagaagcgagggcgagctgcagcaggccagcgccaagctggacgtgttccagagctaccagagcgccacccacgagcagaccaaggcctacgaggagcagctggcccagctgcagcagaagctgctggacctggagaccgagagaatcctgctgaccaagcaggtggccgaggtggaggcccagaagaaggacgtgtgcaccgagctggacgcccacaagatccaggtgcaggacctgatgcagcagctggagaagcagaacagcgagatggagcagaaggtgaagagcctgacccaggtgtacgagagcaagctggaggacggcaacaaggagcaggagcagaccaagcagatcctggtggagaaggagaacatgatcctgcagatgagagagggccagaagaaggagatcgagatcctgacccagaagctgagcgccaaggaggacagcatccacatcctgaacgaggagtacgagaccaagttcaagaaccaggagaagaagatggagaaggtgaagcagaaggccaaggagatgcaggagaccctgaagaagaagctgctggaccaggaggccaagctgaagaaggagctggagaacaccgccctggagctgagccagaaggagaagcagttcaacgccaagatgctggagatggcccaggccaacagcgccggcatcagcgacgccgtgagcagactggagaccaaccagaaggagcagatcgagagcctgaccgaggtgcacagaagagagctgaacgacgtgatcagcatctgggagaagaagctgaaccagcaggccgaggagctgcaggagatccacgagatccagctgcaggagaaggagcaggaggtggccgagctgaagcagaagatcctgctgttcggctgcgagaaggaggagatgaacaaggagatcacctggctgaaggaggagggcgtgaagcaggacaccaccctgaacgagctgcaggagcagctgaagcagaagagcgcccacgtgaacagcctggcccaggacgagaccaagctgaaggcccacctggagaagctggaggtggacctgaacaagagcctgaaggagaacaccttcctgcaggagcagctggtggagctgaagatgctggccgaggaggacaagagaaaggtgagcgagctgaccagcaagctgaagaccaccgacgaggagttccagagcctgaagagcagccacgagaagagcaacaagagcctggaggacaagagcctggagttcaagaagctgagcgaggagctggccatccagctggacatctgctgcaagaagaccgaggccctgctggaggccaagaccaacgagctgatcaacatcagcagcagcaagaccaacgccatcctgagcagaatcagccactgccagcacagaaccaccaaggtgaaggaggccctgctgatcaagacctgcaccgtgagcgagctggaggcccagctgagacagctgaccgaggagcagaacaccctgaacatcagcttccagcaggccacccaccagctggaggagaaggagaaccagatcaagagcatgaaggccgacatcgagagcctggtgaccgagaaggaggccctgcagaaggagggcggcaaccagcagcaggccgccagcgagaaggagagctgcatcacccagctgaagaaggagctgagcgagaacatcaacgccgtgaccctgatgaaggaggagctgaaggagaagaaggtggagatcagcagcctgagcaagcagctgaccgacctgaacgtgcagctgcagaacagcatcagcctgagcgagaaggaggccgccatcagcagcctgagaaagcagtacgacgaggagaagtgcgagctgctggaccaggtgcaggacctgagcttcaaggtggacaccctgagcaaggagaagatcagcgccctggagcaggtggacgactggagcaacaagttcagcgagtggaagaagaaggcccagagcagattcacccagcaccagaacaccgtgaaggagctgcagatccagctggagctgaagagcaaggaggcctacgagaaggacgagcagatcaacctgctgaaggaggagctggaccagcagaacaagagattcgactgcctgaagggcgagatggaggacgacaagagcaagatggagaagaaggagagcaacctggagaccgagctgaagagccagaccgccagaatcatggagctggaggaccacatcacccagaagaccatcgagatcgagagcctgaacgaggtgctgaagaactacaaccagcagaaggacatcgagcacaaggagctggtgcagaagctgcagcacttccaggagctgggcgaggagaaggacaacagagtgaaggaggccgaggagaagatcctgaccctggagaaccaggtgtacagcatgaaggccgagctggagaccaagaagaaggagctggagcacgtgaacctgagcgtgaagagcaaggaggaggagctgaaggccctggaggacagactggagagcgagagcgccgccaagctggccgagctgaagagaaaggccgagcagaagatcgccgccatcaagaagcagctgctgagccagatggaggagaaggaggagcagtacaagaagggcaccgagagccacctgagcgagctgaacaccaagctgcaggagagagagagagaggtgcacatcctggaggagaagctgaagagcgtggagagcagccagagcgagaccctgatcgtgcccagaagcgccaagaacgtggccgcctacaccgagcaggaggaggccgacagccagggctgcgtgcagaagacctacgaggagaagatcagcgtgctgcagagaaacctgaccgagaaggagaagctgctgcagagagtgggccaggagaaggaggagaccgtgagcagccacttcgagatgagatgccagtaccaggagagactgatcaagctggagcacgccgaggccaagcagcacgaggaccagagcatgatcggccacctgcaggaggagctggaggagaagaacaagaagtacagcctgatcgtggcccagcacgtggagaaggagggcggcaagaacaacatccaggccaagcagaacctggagaacgtgttcgacgacgtgcagaagaccctgcaggagaaggagctgacctgccagatcctggagcagaagatcaaggagctggacagctgcctggtgagacagaaggaggtgcacagagtggagatggaggagctgaccagcaagtacgagaagctgcaggccctgcagcagatggacggcagaaacaagcccaccgagctgctggaggagaacaccgaggagaagagcaagagccacctggtgcagcccaagctgctgagcaacatggaggcccagcacaacgacctggagttcaagctggccggcgccgagagagagaagcagaagctgggcaaggagatcgtgagactgcagaaggacctgagaatgctgagaaaggagcaccagcaggagctggagatcctgaagaaggagtacgaccaggagagagaggagaagatcaagcaggagcaggaggacctggagctgaagcacaacagcaccctgaagcagctgatgagagagttcaacacccagctggcccagaaggagcaggagctggagatgaccatcaaggagaccatcaacaaggcccaggaggtggaggccgagctgctggagagccaccaggaggagaccaaccagctgctgaagaagatcgccgagaaggacgacgacctgaagagaaccgccaagagatacgaggagatcctggacgccagagaggaggagatgaccgccaaggtgagagacctgcagacccagctggaggagctgcagaagaagtaccagcagaagctggagcaggaggagaaccccggcaacgacaacacccagctggcccagaagaccaccctgatcagcgacagcaagctgaaggagcaggagttcagagagcagatccacaacctggaggacagactgaagaagtacgagaagaacgtgtacgccaccaccgtgggcaccccctacaagggcggcaacctgtaccacaccgacgtgagcctgttcggcgagcccaccgagttcgagtacctgagaaaggtgctgttcgagtacatgatgggcagagagaccaagaccatggccaaggtgatcaccaccgtgctgaagttccccgacgaccagacccagaagatcctggagagagaggacgccagactgatgagctggctgagaagcagcagctag

SEQ ID NO: 83559 - DNA, 2196 bp, Artificial Sequence
  Description of Artificial Sequence: Synthetic coding sequence
atgagctggttcgtggacctggccggcaaggccgaggacctgctgaacagagtggaccagggcgccgccaccgccctgagcagaaaggacaacgccagcaacatctacagcaagaacaccgactacaccgagctgcaccagcagaacaccgacctgatctaccagaccggccccaagagcacctacatcagcagcgccgccgacaacatcagaaaccagaaggccaccatcctggccggcaccgccaacgtgaaggtgggcagcagaacccccgtggaggccagccaccccgtggagaacgccagcgtgcccagacccagcagccacttcgtgagaagaaagaagagcgagcccgacgacgagctgctgttcgacttcctgaacagcagccagaaggagcccaccggcagagtggagatcagaaaggagaagggcaagacccccgtgttccagagcagccagaccagcagcgtgagcagcgtgaaccccagcgtgaccaccatcaagaccatcgaggagaacagcttcggcagccagacccacgaggccgccagcaacagcgacagcagccacgagggccaggaggagagcagcaaggagaacgtgagcagcaacgccgcctgccccgaccacacccccacccccaacgacgacggcaagagccacgagctgagcaacctgagactggagaaccagctgctgagaaacgaggtgcagagcctgaaccaggagatggccagcctgctgcagagaagcaaggagacccaggaggagctgaacaaggccagagccagagtggagaagtggaacgccgaccacagcaagagcgacagaatgaccagaggcctgagagcccaggtggacgacctgaccgaggccgtggccgccaaggacagccagctggccgtgctgaaggtgagactgcaggaggccgaccagctgctgagcaccagaaccgaggccctggaggccctgcagagcgagaagagcagaatcatgcaggaccagagcgagggcaacagcctgcagaaccaggccctgcagaccttccaggagagactgcacgaggccgacgccaccctgaagagagagcaggagagctacaagcagatgcagagcgagttcgccgccagactgaacaaggtggagatggagagacagaacctggccgaggccatcaccctggccgagagaaagtacagcgacgagaagaagagagtggacgagctgcagcagcaggtgaagctgtacaagctgaacctggagagcagcaagcaggagctgatcgactacaagcagaaggccaccagaatcctgcagagcaaggagaagctgatcaacagcctgaaggagggcagcggcttcgagggcctggacagcagcaccgccagcagcatggagctggaggagctgagacacgagaaggagatgcagagagaggagatccagaagctgatgggccagatccaccagctgagaagcgagctgcaggacatggaggcccagcaggtgaacgaggccgagagcgccagagagcagctgcaggacctgcacgaccagatcgccggccagaaggccagcaagcaggagctggagaccgagctggagagactgaagcaggagttccactacatcgaggaggacctgtacagaaccaagaacaccctgcagagcagaatcaaggacagagacgaggagatccagaagctgagaaaccagctgaccaacaagaccctgagcaacagcagccagagcgagctggagaacagactgcaccagctgaccgagaccctgatccagaagcagaccatgctggagagcctgagcaccgagaagaacagcctggtgttccagctggagagactggagcagcagatgaacagcgccagcggcagcagcagcaacggcagcagcatcaacatgagcggcatcgacaacggcgagggcaccagactgagaaacgtgcccgtgctgttcaacgacaccgagaccaacctggccggcatgtacggcaaggtgagaaaggccgccagcagcatcgaccagttcagcatcagactgggcatcttcctgagaagataccccatcgccagagtgttcgtgatcatctacatggccctgctgcacctgtgggtgatgatcgtgctgctgacctacacccccgagatgcaccacgaccagccctacggcaagtag

SEQ ID NO: 83560 - DNA, 2076 bp, Artificial Sequence
  Description of Artificial Sequence: Synthetic coding sequence
atgagctggttcgtggacctggccggcaaggccgaggacctgctgaacagagtggaccagggcgccgccaccgccctgagcagaaaggacaacgccagcaacatctacagcaagaacaccgactacaccgagctgcaccagcagaacaccgacctgatctaccagaccggccccaagagcacctacatcagcagcgccgccgacaacatcagaaaccagaaggccaccatcctggccggcaccgccaacgtgaaggtgggcagcagaacccccgtggaggccagccaccccgtggagaacgccagcgtgcccagacccagcagccacttcgtgagaagaaagaagagcgagcccgacgacgagctgctgttcgacttcctgaacagcagccagaaggagcccaccggcagagtggagatcagaaaggagaagggcaagacccccgtgttccagagcagccagaccagcagcgtgagcagcgtgaaccccagcgtgaccaccatcaagaccatcgaggagaacagcttcggcagccagacccacgaggccgccagcaacagcgacagcagccacgagggccaggaggagagcagcaaggagaacgtgagcagcaacgccgcctgccccgaccacacccccacccccaacgacgacggcaagagccacgagctgagcaacctgagactggagaaccagctgctgagaaacgaggtgcagagcctgaaccaggagatggccagcctgctgcagagaagcaaggagacccaggaggagctgaacaaggccagagccagagtggagaagtggaacgccgaccacagcaagagcgacagaatgaccagaggcctgagagcccaggtggacgacctgaccgaggccgtggccgccaaggacagccagctggccgtgctgaaggtgagactgcaggaggccgaccagctgctgagcaccagaaccgaggccctggaggccctgcagagcgagaagagcagaatcatgcaggaccagagcgagggcaacagcctgcagaaccaggccctgcagaccttccaggagagactgcacgaggccgacgccaccctgaagagagagcaggagagctacaagcagatgcagagcgagttcgccgccagactgaacaaggtggagatggagagacagaacctggccgaggccatcaccctggccgagagaaagtacagcgacgagaagaagagagtggacgagctgcagcagcaggtgaagctgtacaagctgaacctggagagcagcaagcaggagctgatcgactacaagcagaaggccaccagaatcctgcagagcaaggagaagctgatcaacagcctgaaggagggcagcggcttcgagggcctggacagcagcaccgccagcagcatggagctggaggagctgagacacgagaaggagatgcagagagaggagatccagaagctgatgggccagatccaccagctgagaagcgagctgcaggacatggaggcccagcaggtgaacgaggccgagagcgccagagagcagctgcaggacctgcacgaccagatcgccggccagaaggccagcaagcaggagctggagaccgagctggagagactgaagcaggagttccactacatcgaggaggacctgtacagaaccaagaacaccctgcagagcagaatcaaggacagagacgaggagatccagaagctgagaaaccagctgaccaacaagaccctgagcaacagcagccagagcgagctggagaacagactgcaccagctgaccgagaccctgatccagaagcagaccatgctggagagcctgagcaccgagaagaacagcctggtgttccagctggagagactggagcagcagatgaacagcgccagcggcagcagcagcaacggcagcagcatcaacatgagcggcatcgacaacggcgagggcaccagactgagaaacgtgcccgtgctgttcaacgacaccgagaccaacctggccggcatgtacggcaaggtgagaaaggccgccagcagcatcgaccagttcagactgtgcttcaccagcggcagctag

SEQ ID NO: 83561 - DNA, 1923 bp, Artificial Sequence
  Description of Artificial Sequence: Synthetic coding sequence
atgagctggttcgtggacctggccggcaaggccgaggacctgctgaacagagtggaccagggcgccgccaccgccctgagcagaaaggacaacgccagcaacatctacagcaagaacaccgactacaccgagctgcaccagcagaacaccgacctgatctaccagaccggccccaagagcacctacatcagcagcgccgccgacaacatcagaaaccagaaggccaccatcaagaccatcgaggagaacagcttcggcagccagacccacgaggccgccagcaacagcgacagcagccacgagggccaggaggagagcagcaaggagaacgtgagcagcaacgccgcctgccccgaccacacccccacccccaacgacgacggcaagagccacgagctgagcaacctgagactggagaaccagctgctgagaaacgaggtgcagagcctgaaccaggagatggccagcctgctgcagagaagcaaggagacccaggaggagctgaacaaggccagagccagagtggagaagtggaacgccgaccacagcaagagcgacagaatgaccagaggcctgagagcccaggtggacgacctgaccgaggccgtggccgccaaggacagccagctggccgtgctgaaggtgagactgcaggaggccgaccagctgctgagcaccagaaccgaggccctggaggccctgcagagcgagaagagcagaatcatgcaggaccagagcgagggcaacagcctgcagaaccaggccctgcagaccttccaggagagactgcacgaggccgacgccaccctgaagagagagcaggagagctacaagcagatgcagagcgagttcgccgccagactgaacaaggtggagatggagagacagaacctggccgaggccatcaccctggccgagagaaagtacagcgacgagaagaagagagtggacgagctgcagcagcaggtgaagctgtacaagctgaacctggagagcagcaagcaggagctgatcgactacaagcagaaggccaccagaatcctgcagagcaaggagaagctgatcaacagcctgaaggagggcagcggcttcgagggcctggacagcagcaccgccagcagcatggagctggaggagctgagacacgagaaggagatgcagagagaggagatccagaagctgatgggccagatccaccagctgagaagcgagctgcaggacatggaggcccagcaggtgaacgaggccgagagcgccagagagcagctgcaggacctgcacgaccagatcgccggccagaaggccagcaagcaggagctggagaccgagctggagagactgaagcaggagttccactacatcgaggaggacctgtacagaaccaagaacaccctgcagagcagaatcaaggacagagacgaggagatccagaagctgagaaaccagctgaccaacaagaccctgagcaacagcagccagagcgagctggagaacagactgcaccagctgaccgagaccctgatccagaagcagaccatgctggagagcctgagcaccgagaagaacagcctggtgttccagctggagagactggagcagcagatgaacagcgccagcggcagcagcagcaacggcagcagcatcaacatgagcggcatcgacaacggcgagggcaccagactgagaaacgtgcccgtgctgttcaacgacaccgagaccaacctggccggcatgtacggcaaggtgagaaaggccgccagcagcatcgaccagttcagcatcagactgggcatcttcctgagaagataccccatcgccagagtgttcgtgatcatctacatggccctgctgcacctgtgggtgatgatcgtgctgctgacctacacccccgagatgcaccacgaccagccctacggcaagtag

SEQ ID NO: 83562 - DNA, 504 bp, Artificial Sequence
  Description of Artificial Sequence: Synthetic coding sequence
atggccaccgaggtgcacaacctgcaggagctgagaagaagcgccagcctggccaccaaggtgttcatccagagagactacagcgacggcaccatctgccagttccagaccaagttcccccccgagctggacagcagaatcgagagacagctgttcgaggagaccgtgaagaccctgaacggcttctacgccgaggccgagaagatcggcggcagcagctacctggagggctgcctggcctgcgccaccgcctacttcatcttcctgtgcatggagacccactacgagaaggtgctgaagaagatcagcagatacatccaggagcagaacgagaagatcttcgcccccagaggcctgctgctgaccgaccccgtggagagaggcatgagagtgatcgagatcagcatctacgaggacagatgcagcagcggcagcagcagcagcggcagcagcagcggcagcggcagcagcagcggcggcggcggcggcgccggcgccagatag

SEQ ID NO: 83563 - DNA, 1812 bp, Artificial Sequence
  Description of Artificial Sequence: Synthetic coding sequence
atggccgaggagaccggccagagcaagctggccgccgccaagaagaagttcaaggagtactggcagagaaacagacccggcgtgcccgccgccgccaagagaaacaccaaggccaacggcagcagccccgagaccgccgccagcggcggctgccacagcagcgaggccagcagcagcgccagcagcagcctgcacgccagacagagcccctgccaggagcaggccgccgtgctgaacagcagaagcatcaagatcagcagactgaacgacaccatcaagagcctgaagcagcagaagaagcaggtggagcaccagctggaggaggagaagaaggccaacaacgagaagcagaaggccgagagagagctggagggccagatccagagactgaacaccgagaagaagaagctgaacaccgacctgtaccacatgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgaagcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtgctgcagctgctgggcgagatgcaggaccaccaggagcaccccggcctgggcagcaactgctgcgtgccctgcttctgctgggcctggctgcccagaagaagaagatag

SEQ ID NO: 83564 - DNA, 1485 bp, Artificial Sequence
  Description of Artificial Sequence: Synthetic coding sequence
gagaagaaggccaacaacgagaagcagaaggccgagagagagctggagggccagatccagagactgaacaccgagaagaagaagctgaacaccgacctgtaccacatgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtgctgcagctgctgggcgagatgcaggaccaccaggagcaccccggcctgggcagcaactgctgcgtgccctgcttctgctgggcctggctgcccagaagaagaagatag

SEQ ID NO: 83565 - DNA, 1812 bp, Artificial Sequence; identical to SEQ ID NO: 83563
  Description of Artificial Sequence: Synthetic coding sequence

SEQ ID NO: 83566 - DNA, 1902 bp, Artificial Sequence
  Description of Artificial Sequence: Synthetic coding sequence
atgctgcccgtggacggcgaggagagaaagagcgagggcagcgacaccgagggcgacagaaccagcccctgcgccggccccaccagcagcgccaccctgaaggacctggaggtgggcggcagcggctggagatgcagcgaccccgccggccagcccagcaacctgctgccccagagaggcctgggcgcccccctgcccgccgagaccgcccacacccagcccagccccaacgacagaagcctgtacctgagccccaagagcagcagcgccagcagcagcctgcacgccagacagagcccctgccaggagcaggccgccgtgctgaacagcagaagcatcaagatcagcagactgaacgacaccatcaagagcctgaagcagcagaagaagcaggtggagcaccagctggaggaggagaagaaggccaacaacgagaagcagaaggccgagagagagctggagggccagatccagagactgaacaccgagaagaagaagctgaacaccgacctgtaccacatgaagcacagcctgagatacttcgaggaggagagcaaggacctggccggcagactgcagagaagcagccagagaatcggcgagctggagtggagcctgtgcgccgtggccgccacccagaagaagaagcccgacggcttcagcagcagaagcaaggccctgctgaagagacagctggagcagagcatcagagagcagatcctgctgaagggccacgtgacccagctgaaggagagcctgaaggaggtgcagctggagagagaccagtacgccgagcagatcaagggcgagagagcccagtggcagcagagaatgagaaagatgagccaggaggtgtgcaccctgaaggaggagaagaagcacgacacccacagagtggaggagctggagagaagcctgagcagactgaagaaccagatggccgagcccctgccccccgacgcccccgccgtgagcagcgaggtggagctgcaggacctgagaaaggagctggagagagtggccggcgagctgcaggcccaggtggagaacaaccagtgcatcagcctgctgaacagaggccagaaggagagactgagagagcaggaggagagactgcaggagcagcaggagagactgagagagagagagaagagactgcagcagctggccgagccccagagcgacctggaggagctgaagcacgagaacaagagcgccctgcagctggagcagcaggtgaaggagctgcaggagaagctgggccaggtgatggagaccctgaccagcgccgagaaggagcccgaggccgccgtgcccgccagcggcaccggcggcgagagcagcggcctgatggacctgctggaggagaaggccgacctgagagagcacgtggagaagctggagctgggcttcatccagtacagaagagagagatgccaccagaaggtgcacagactgctgaccgagcccggcgacagcgccaaggacgccagccccggcggcggccaccaccaggccggccccggccagggcggcgaggagggcgaggccgccggcgccgccggcgacggcgtggccgcctgcggcagctacagcgagggccacggcaagttcctggccgccgccagaaaccccgccgccgagcccagccccggcgcccccgccccccaggagctgggcgccgccgacaagcacggcgacctgtgcgaggccagcctgaccaacagcgtggagcccgcccagggcgaggccagagagggcagcagccaggacaaccccaccgcccagcccgtgctgcagctgctgggcgagatgcaggaccaccaggagcaccccggcctgggcagcaactgctgcgtgccctgcttctgctgggcctggctgcccagaagaagaagatag

SEQ ID NO: 83567 - DNA, 9780 bp, Artificial Sequence
  Description of Artificial Sequence: Synthetic coding sequence
atgctgagcagactgagcggcctggccaacgtggtgctgcacgagctgagcggcgacgacgacaccgaccagaacatgagagcccccctggaccccgagctgcaccaggagagcgacatggagttcaacaacaccacccaggaggacgtgcaggagagactggcctacgccgagcagctggtggtggagctgaaggacatcatcagacagaaggacgtgcagctgcagcagaaggacgaggccctgcaggaggagagaaaggccgccgacaacaagatcaagaagctgaagctgcacgccaaggccaagctgaccagcctgaacaagtacatcgaggagatgaaggcccagggcggcaccgtgctgcccaccgagccccagagcgaggagcagctgagcaagcacgacaagagcagcaccgaggaggagatggagatcgagaagatcaagcacaagctgcaggagaaggaggagctgatcagcaccctgcaggcccagctgacccaggcccaggccgagcagcccgcccagagcagcaccgagatggaggagttcgtgatgatgaagcagcagctgcaggagaaggaggagttcatcagcaccctgcaggcccagctgagccagacccaggccgagcaggccgcccagcaggtggtgagagagaaggacgccagattcgagacccaggtgagactgcacgaggacgagctgctgcagctggtgacccaggccgacgtggagaccgagatgcagcagaagctgagagtgctgcagagaaagctggaggagcacgaggagagcctggtgggcagagcccaggtggtggacctgctgcagcaggagctgaccgccgccgagcagagaaaccagatcctgagccagcagctgcagcagatggaggccgagcacaacaccctgagaaacaccgtggagaccgagagagaggagagcaagatcctgctggagaagatggagctggaggtggccgagagaaagctgagcttccacaacctgcaggaggagatgcaccacctgctggagcagttcgagcaggccggccaggcccaggccgagctggagagcagatacagcgccctggagcagaagcacaaggccgagatggaggagaagaccagccacatcctgagcctgcagaagaccggccaggagctgcagagcgcctgcgacgccctgaaggaccagaacagcaagctgctgcaggacaagaacgagcaggccgtgcagagcgcccagaccatccagcagctggaggaccagctgcagcagaagagcaaggagatcagccagttcctgaacagactgcccctgcagcagcacgagaccgccagccagaccagcttccccgacgtgtacaacgagggcacccaggccgtgaccgaggagaacatcgccagcctgcagaagagagtggtggagctggagaacgagaagggcgccctgctgctgagcagcatcgagctggaggagctgaaggccgagaacgagaagctgagcagccagatcaccctgctggaggcccagaacagaaccggcgaggccgacagagaggtgagcgagatcagcatcgtggacatcgccaacaagagaagcagcagcgccgaggagagcggccaggacgtgctggagaacaccttcagccagaagcacaaggagctgagcgtgctgctgctggagatgaaggaggcccaggaggagatcgccttcctgaagctgcagctgcagggcaagagagccgaggaggccgaccacgaggtgctggaccagaaggagatgaagcagatggagggcgagggcatcgcccccatcaagatgaaggtgttcctggaggacaccggccaggacttccccctgatgcccaacgaggagagcagcctgcccgccgtggagaaggagcaggccagcaccgagcaccagagcagaaccagcgaggagatcagcctgaacgacgccggcgtggagctgaagagcaccaagcaggacggcgacaagagcctgagcgccgtgcccgacatcggccagtgccaccaggacgagctggagagactgaagagccagatcctggagctggagctgaacttccacaaggcccaggagatctacgagaagaacctggacgagaaggccaaggagatcagcaacctgaaccagctgatcgaggagttcaagaagaacgccgacaacaacagcagcgccttcaccgccctgagcgaggagagagaccagctgctgagccaggtgaaggagctgagcatggtgaccgagctgagagcccaggtgaagcagctggagatgaacctggccgaggccgagagacagagaagactggactacgagagccagaccgcccacgacaacctgctgaccgagcagatccacagcctgagcatcgaggccaagagcaaggacgtgaagatcgaggtgctgcagaacgagctggacgacgtgcagctgcagttcagcgagcagagcaccctgatcagaagcctgcagagccagctgcagaacaaggagagcgaggtgctggagggcgccgagagagtgagacacatcagcagcaaggtggaggagctgagccaggccctgagccagaaggagctggagatcaccaagatggaccagctgctgctggagaagaagagagacgtggagaccctgcagcagaccatcgaggagaaggaccagcaggtgaccgagatcagcttcagcatgaccgagaagatggtgcagctgaacgaggagaagttcagcctgggcgtggagatcaagaccctgaaggagcagctgaacctgctgagcagagccgaggaggccaagaaggagcaggtggaggaggacaacgaggtgagcagcggcctgaagcagaactacgacgagatgagccccgccggccagatcagcaaggaggagctgcagcacgagttcgacctgctgaagaaggagaacgagcagagaaagagaaagctgcaggccgccctgatcaacagaaaggagctgctgcagagagtgagcagactggaggaggagctggccaacctgaaggacgagagcaagaaggagatccccctgagcgagaccgagagaggcgaggtggaggaggacaaggagaacaaggagtacagcgagaagtgcgtgaccagcaagtgccaggagatcgagatctacctgaagcagaccatcagcgagaaggaggtggagctgcagcacatcagaaaggacctggaggagaagctggccgccgaggagcagttccaggccctggtgaagcagatgaaccagaccctgcaggacaagaccaaccagatcgacctgctgcaggccgagatcagcgagaaccaggccatcatccagaagctgatcaccagcaacaccgacgccagcgacggcgacagcgtggccctggtgaaggagaccgtggtgatcagccccccctgcaccggcagcagcgagcactggaagcccgagctggaggagaagatcctggccctggagaaggagaaggagcagctgcagaagaagctgcaggaggccctgaccagcagaaaggccatcctgaagaaggcccaggagaaggagagacacctgagagaggagctgaagcagcagaaggacgactacaacagactgcaggagcagttcgacgagcagagcaaggagaacgagaacatcggcgaccagctgagacagctgcagatccaggtgagagagagcatcgacggcaagctgcccagcaccgaccagcaggagagctgcagcagcacccccggcctggaggagcccctgttcaaggccaccgagcagcaccacacccagcccgtgctggagagcaacctgtgccccgactggcccagccacagcgaggacgccagcgccctgcagggcggcaccagcgtggcccagatcaaggcccagctgaaggagatcgaggccgagaaggtggagctggagctgaaggtgagcagcaccaccagcgagctgaccaagaagagcgaggaggtgttccagctgcaggagcagatcaacaagcagggcctggagatcgagagcctgaagaccgtgagccacgaggccgaggtgcacgccgagagcctgcagcagaagctggagagcagccagctgcagatcgccggcctggagcacctgagagagctgcagcccaagctggacgagctgcagaagctgatcagcaagaaggaggaggacgtgagctacctgagcggccagctgagcgagaaggaggccgccctgaccaagatccagaccgagatcatcgagcaggaggacctgatcaaggccctgcacacccagctggagatgcaggccaaggagcacgacgagagaatcaagcagctgcaggtggagctgtgcgagatgaagcagaagcccgaggagatcggcgaggagagcagagccaagcagcagatccagagaaagctgcaggccgccctgatcagcagaaaggaggccctgaaggagaacaagagcctgcaggaggagctgagcctggccagaggcaccatcgagagactgaccaagagcctggccgacgtggagagccaggtgagcgcccagaacaaggagaaggacaccgtgctgggcagactggccctgctgcaggaggagagagacaagctgatcaccgagatggacagaagcctgctggagaaccagagcctgagcagcagctgcgagagcctgaagctggccctggagggcctgaccgaggacaaggagaagctggtgaaggagatcgagagcctgaagagcagcaagatcgccgagagcaccgagtggcaggagaagcacaaggagctgcagaaggagtacgagatcctgctgcagagctacgagaacgtgagcaacgaggccgagagaatccagcacgtggtggaggccgtgagacaggagaagcaggagctgtacggcaagctgagaagcaccgaggccaacaagaaggagaccgagaagcagctgcaggaggccgagcaggagatggaggagatgaaggagaagatgagaaagttcgccaagagcaagcagcagaagatcctggagctggaggaggagaacgacagactgagagccgaggtgcaccccgccggcgacaccgccaaggagtgcatggagaccctgctgagcagcaacgccagcatgaaggaggagctggagagagtgaagatggagtacgagaccctgagcaagaagttccagagcctgatgagcgagaaggacagcctgagcgaggaggtgcaggacctgaagcaccagatcgagggcaacgtgagcaagcaggccaacctggaggccaccgagaagcacgacaaccagaccaacgtgaccgaggagggcacccagagcatccccggcgagaccgaggagcaggacagcctgagcatgagcaccagacccacctgcagcgagagcgtgcccagcgccaagagcgccaaccccgccgtgagcaaggacttcagcagccacgacgagatcaacaactacctgcagcagatcgaccagctgaaggagagaatcgccggcctggaggaggagaagcagaagaacaaggagttcagccagaccctggagaacgagaagaacaccctgctgagccagatcagcaccaaggacggcgagctgaagatgctgcaggaggaggtgaccaagatgaacctgctgaaccagcagatccaggaggagctgagcagagtgaccaagctgaaggagaccgccgaggaggagaaggacgacctggaggagagactgatgaaccagctggccgagctgaacggcagcatcggcaactactgccaggacgtgaccgacgcccagatcaagaacgagctgctggagagcgagatgaagaacctgaagaagtgcgtgagcgagctggaggaggagaagcagcagctggtgaaggagaagaccaaggtggagagcgagatcagaaaggagtacctggagaagatccagggcgcccagaaggagcccggcaacaagagccacgccaaggagctgcaggagctgctgaaggagaagcagcaggaggtgaagcagctgcagaaggactgcatcagataccaggagaagatcagcgccctggagagaaccgtgaaggccctggagttcgtgcagaccgagagccagaaggacctggagatcaccaaggagaacctggcccaggccgtggagcacagaaagaaggcccaggccgagctggccagcttcaaggtgctgctggacgacacccagagcgaggccgccagagtgctggccgacaacctgaagctgaagaaggagctgcagagcaacaaggagagcgtgaagagccagatgaagcagaaggacgaggacctggagagaagactggagcaggccgaggagaagcacctgaaggagaagaagaacatgcaggagaagctggacgccctgagaagagagaaggtgcacctggaggagaccatcggcgagatccaggtgaccctgaacaagaaggacaaggaggtgcagcagctgcaggagaacctggacagcaccgtgacccagctggccgccttcaccaagagcatgagcagcctgcaggacgacagagacagagtgatcgacgaggccaagaagtgggagagaaagttcagcgacgccatccagagcaaggaggaggagatcagactgaaggaggacaactgcagcgtgctgaaggaccagctgagacagatgagcatccacatggaggagctgaagatcaacatcagcagactggagcacgacaagcagatctgggagagcaaggcccagaccgaggtgcagctgcagcagaaggtgtgcgacaccctgcagggcgagaacaaggagctgctgagccagctggaggagaccagacacctgtaccacagcagccagaacgagctggccaagctggagagcgagctgaagagcctgaaggaccagctgaccgacctgagcaacagcctggagaagtgcaaggagcagaagggcaacctggagggcatcatcagacagcaggaggccgacatccagaacagcaagttcagctacgagcagctggagaccgacctgcaggccagcagagagctgaccagcagactgcacgaggagatcaacatgaaggagcagaagatcatcagcctgctgagcggcaaggaggaggccatccaggtggccatcgccgagctgagacagcagcacgacaaggagatcaaggagctggagaacctgctgagccaggaggaggaggagaacatcgtgctggaggaggagaacaagaaggccgtggacaagaccaaccagctgatggagaccctgaagaccatcaagaaggagaacatccagcagaaggcccagctggacagcttcgtgaagagcatgagcagcctgcagaacgacagagacagaatcgtgggcgactaccagcagctggaggagagacacctgagcatcatcctggagaaggaccagctgatccaggaggccgccgccgagaacaacaagctgaaggaggagatcagaggcctgagaagccacatggacgacctgaacagcgagaacgccaagctggacgccgagctgatccagtacagagaggacctgaaccaggtgatcaccatcaaggacagccagcagaagcagctgctggaggtgcagctgcagcagaacaaggagctggagaacaagtacgccaagctggaggagaagctgaaggagagcgaggaggccaacgaggacctgagaagaagcttcaacgccctgcaggaggagaagcaggacctgagcaaggagatcgagagcctgaaggtgagcatcagccagctgaccagacaggtgaccgccctgcaggaggagggcaccctgggcctgtaccacgcccagctgaaggtgaaggaggaggaggtgcacagactgagcgccctgttcagcagcagccagaagagaatcgccgagctggaggaggagctggtgtgcgtgcagaaggaggccgccaagaaggtgggcgagatcgaggacaagctgaagaaggagctgaagcacctgcaccacgacgccggcatcatgagaaacgagaccgagaccgccgaggagagagtggccgagctggccagagacctggtggagatggagcagaagctgctgatggtgaccaaggagaacaagggcctgaccgcccagatccagagcttcggcagaagcatgagcagcctgcagaacagcagagaccacgccaacgaggagctggacgagctgaagagaaagtacgacgccagcctgaaggagctggcccagctgaaggagcagggcctgctgaacagagagagagacgccctgctgagcgagaccgccttcagcatgaacagcaccgaggagaacagcctgagccacctggagaagctgaaccagcagctgctgagcaaggacgagcagctgctgcacctgagcagccagctggaggacagctacaaccaggtgcagagcttcagcaaggccatggccagcctgcagaacgagagagaccacctgtggaacgagctggagaagttcagaaagagcgaggagggcaagcagagaagcgccgcccagcccagcaccagccccgccgaggtgcagagcctgaagaaggccatgagcagcctgcagaacgacagagacagactgctgaaggagctgaagaacctgcagcagcagtacctgcagatcaaccaggagatcaccgagctgcaccccctgaaggcccagctgcaggagtaccaggacaagaccaaggccttccagatcatgcaggaggagctgagacaggagaacctgagctggcagcacgagctgcaccagctgagaatggagaagagcagctgggagatccacgagagaagaatgaaggagcagtacctgatggccatcagcgacaaggaccagcagctgagccacctgcagaacctgatcagagagctgagaagcagcagcagccagacccagcccctgaaggtgcagtaccagagacaggccagccccgagaccagcgccagccccgacggcagccagaacctggtgtacgagaccgagctgctgagaacccagctgaacgacagcctgaaggagatccaccagaaggagctgagaatccagcagctgaacagcaacttcagccagctgctggaggagaagaacaccctgagcatccagctgtgcgacaccagccagagcctgagagagaaccagcagcactacggcgacctgctgaaccactgcgccgtgctggagaagcaggtgcaggagctgcaggccggccccctgaacatcgacgtggcccccggcgccccccaggagaagaacggcgtgcacagaaagagcgaccccgaggagctgagagagccccagcagagcttcagcgaggcccagcagcagctgtgcaacaccagacaggaggtgaacgagctgagaaagctgctggaggaggagagagaccagagagtggccgccgagaacgccctgagcgtggccgaggagcagatcagaagactggagcacagcgagtgggacagcagcagaacccccatcatcggcagctgcggcacccaggagcaggccctgctgatcgacctgaccagcaacagctgcagaagaaccagaagcggcgtgggctggaagagagtgctgagaagcctgtgccacagcagaaccagagtgcccctgctggccgccatctacttcctgatgatccacgtgctgctgatcctgtgcttcaccggccacctgtag

SEQ ID NO: 83568 - DNA, 2919 bp, Artificial Sequence
  Description of Artificial Sequence: Synthetic coding sequence
atgaaggcccagggcggcaccgtgctgcccaccgagccccagagcgaggagcagctgagcaagcacgacaagagcagcaccgaggaggagatggagatcgagaagatcaagcacaagctgcaggagaaggaggagctgatcagcaccctgcaggcccagctgacccaggcccaggccgagcagcccgcccagaagctgagagtgctgcagagaaagctggaggagcacgaggagagcctggtgggcagagcccaggtggtggacctgctgcagcaggagctgaccgccgccgagcagagaaaccagatcctgagccagcagctgcagcagatggaggccgagcacaacaccctgagaaacaccgtggagaccgagagagaggagagcaagatcctgctggagaagatggagctggaggtggccgagagaaagctgagcttccacaacctgcaggaggagatgcaccacctgctggagcagttcgagcaggccggccaggcccaggccgagctggagagcagatacagcgccctggagcagaagcacaaggccgagatggaggagaagaccagccacatcctgagcctgcagaagaccggccaggagctgcagagcgcctgcgacgccctgaaggaccagaacagcaagctgctgcaggacaagaacgagcaggccgtgcagagcgcccagaccatccagcagctggaggaccagctgcagcagaagagcaaggagatcagccagttcctgaacagactgcccctgcagcagcacgagaccgccagccagaccagcttccccgacgtgtacaacgagggcacccaggccgtgaccgaggagaacatcgccagcctgcagaagagagtggtggagctggagaacgagaagggcgccctgctgctgagcagcatcgagctggaggagctgaaggccgagaacgagaagctgagcagccagatcaccctgctggaggcccagaacagaaccggcgaggccgacagagaggtgagcgagatcagcatcgtggacatcgccaacaagagaagcagcagcgccgaggagagcggccaggacgtgctggagaacaccttcagccagaagcacaaggagctgagcgtgctgctgctggagatgaaggaggcccaggaggagatcgccttcctgaagctgcagctgcagggcaagagagccgaggaggccgaccacgaggtgctggaccagaaggagatgaagcagatggagggcgagggcatcgcccccatcaagatgaaggtgttcctggaggacaccggccaggacttccccctgatgcccaacgaggagagcagcctgcccgccgtggagaaggagcaggccagcaccgagcaccagagcagaaccagcgaggagatcagcctgaacgacgccggcgtggagctgaagagcaccaagcaggacggcgacaagagcctgagcgccgtgcccgacatcggccagtgccaccaggacgagctggagagactgaagagccagatcctggagctggagctgaacttccacaaggcccaggagatctacgagaagaacctggacgagaaggccaaggagatcagcaacctgaaccagctgatcgaggagttcaagaagaacgccgacaacaacagcagcgccttcaccgccctgagcgaggagagagaccagctgctgagccaggtgaaggagctgagcatggtgaccgagctgagagcccaggtgaagcagctggagatgaacctggccgaggccgagagacagagaagactggactacgagagccagaccgcccacgacaacctgctgaccgagcagatccacagcctgagcatcgaggccaagagcaaggacgtgaagatcgaggtgctgcagaacgagctggacgacgtgcagctgcagttcagcgagcagagcaccctgatcagaagcctgcagagccagctgcagaacaaggagagcgaggtgctggagggcgccgagagagtgagacacatcagcagcaaggtggaggagctgagccaggccctgagccagaaggagctggagatcaccaagatggaccagctgctgctggagaagaagagagacgtggagaccctgcagcagaccatcgaggagaaggaccagcaggtgaccgagatcagcttcagcatgaccgagaagatggtgcagctgaacgaggagaagttcagcctgggcgtggagatcaagaccctgaaggagcagctgaacctgctgagcagagccgaggaggccaagaaggagcaggtggaggaggacaacgaggtgagcagcggcctgaagcagaactacgacgagatgagccccgccggccagatcagcaaggaggagctgcagcacgagttcgacctgctgaagaaggagaacgagcagagaaagagaaagctgcaggccgccctgatcaacagaaaggagctgctgcagagagtgagcagactggaggaggagctggccaacctgaaggacgagagcaagaaggagatccccctgagcgagaccgagagaggcgaggtggaggaggacaaggagaacaaggagtacagcgagaagtgcgtgaccagcaagtgccaggagatcgagatctacctgaagcagaccatcagcgagaaggaggtggagctgcagcacatcagaaaggacctggaggagaagctggccgccgaggagcagttccaggccctggtgaagcagatgaaccagaccctgcaggacaagaccaaccagatcgacctgctgcaggccgagatcagcgagaaccaggccatcatccagaagctgatcaccagcaacaccgacgccagcgacggcgacagcgtggccctggtgaaggagaccgtggtgatcagccccccctgcaccggcagcagcgagcactggaagccctag

SEQ ID NO: 83569 - DNA, 126 bp, Artificial Sequence
  Description of Artificial Sequence: Synthetic coding sequence
atgctgagcagactgagcggcctggccaacgtggtgctgcacgagctgagcggcgacgacgacaccgaccagaacatgagagcccccctggaccccgagctgcaccaggagagcgacatggagtag

SEQ ID NO: 83570 - DNA, 4923 bp, Artificial Sequence
  Description of Artificial Sequence: Synthetic coding sequence
atgctgagcagactgagcggcctggccaacgtggtgctgcacgagctgagcggcgacgacgacaccgaccagaacatgagagcccccctggaccccgagctgcaccaggagagcgacatggagttcaacaacaccacccaggaggacgtgcaggagagactggcctacgccgagcagctggtggtggagctgaaggacatcatcagacagaaggacgtgcagctgcagcagaaggacgaggccctgcaggaggagagaaaggccgccgacaacaagatcaagaagctgaagctgcacgccaaggccaagctgaccagcctgaacaagtacatcgaggagatgaaggcccagggcggcaccgtgctgcccaccgagccccagagcgaggagcagctgagcaagcacgacaagagcagcaccgaggaggagatggagatcgagaagatcaagcacaagctgcaggagaaggaggagctgatcagcaccctgcaggcccagctgacccaggcccaggccgagcagcccgcccagagcagcaccgagatggaggagttcgtgatgatgaagcagcagctgcaggagaaggaggagttcatcagcaccctgcaggcccagctgagccagacccaggccgagcaggccgcccagaagctgagagtgctgcagagaaagctggaggagcacgaggagagcctggtgggcagagcccaggtggtggacctgctgcagcaggagctgaccgccgccgagcagagaaaccagatcctgagccagcagctgcagcagatggaggccgagcacaacaccctgagaaacaccgtggagaccgagagagaggagagcaagatcctgctggagaagatggagctggaggtggccgagagaaagctgagcttccacaacctgcaggaggagatgcaccacctgctggagcagttcgagcaggccggccaggcccaggccgagctggagagcagatacagcgccctggagcagaagcacaaggccgagatggaggagaagaccagccacatcctgagcctgcagaagaccggccaggagctgcagagcgcctgcgacgccctgaaggaccagaacagcaagctgctgcaggacaagaacgagcaggccgtgcagagcgcccagaccatccagcagctggaggaccagctgcagcagaagagcaaggagatcagccagttcctgaacagactgcccctgcagcagcacgagaccgccagccagaccagcttccccgacgtgtacaacgagggcacccaggccgtgaccgaggagaacatcgccagcctgcagaagagagtggtggagctggagaacgagaagggcgccctgctgctgagcagcatcgagctggaggagctgaaggccgagaacgagaagctgagcagccagatcaccctgctggaggcccagaacagaaccggcgaggccgacagagaggtgagcgagatcagcatcgtggacatcgccaacaagagaagcagcagcgccgaggagagcggccaggacgtgctggagaacaccttcagccagaagcacaaggagctgagcgtgctgctgctggagatgaaggaggcccaggaggagatcgccttcctgaagctgcagctgcagggcaagagagccgaggaggccgaccacgaggtgctggaccagaaggagatgaagcagatggagggcgagggcatcgcccccatcaagatgaaggtgttcctggaggacaccggccaggacttccccctgatgcccaacgaggagagcagcctgcccgccgtggagaaggagcaggccagcaccgagcaccagagcagaaccagcgaggagatcagcctgaacgacgccggcgtggagctgaagagcaccaagcaggacggcgacaagagcctgagcgccgtgcccgacatcggccagtgccaccaggacgagctggagagactgaagagccagatcctggagctggagctgaacttccacaaggcccaggagatctacgagaagaacctggacgagaaggccaaggagatcagcaacctgaaccagctgatcgaggagttcaagaagaacgccgacaacaacagcagcgccttcaccgccctgagcgaggagagagaccagctgctgagccaggtgaaggagctgagcatggtgaccgagctgagagcccaggtgaagcagctggagatgaacctggccgaggccgagagacagagaagactggactacgagagccagaccgcccacgacaacctgctgaccgagcagatccacagcctgagcatcgaggccaagagcaaggacgtgaagatcgaggtgctgcagaacgagctggacgacgtgcagctgcagttcagcgagcagagcaccctgatcagaagcctgcagagccagctgcagaacaaggagagcgaggtgctggagggcgccgagagagtgagacacatcagcagcaaggtggaggagctgagccaggccctgagccagaaggagctggagatcaccaagatggaccagctgctgctggagaagaagagagacgtggagaccctgcagcagaccatcgaggagaaggaccagcaggtgaccgagatcagcttcagcatgaccgagaagatggtgcagctgaacgaggagaagttcagcctgggcgtggagatcaagaccctgaaggagcagctgaacctgctgagcagagccgaggaggccaagaaggagcaggtggaggaggacaacgaggtgagcagcggcctgaagcagaactacgacgagatgagccccgccggccagatcagcaaggaggagctgcagcacgagttcgacctgctgaagaaggagaacgagcagagaaagagaaagctgcaggccgccctgatcaacagaaaggagctgctgcagagagtgagcagactggaggaggagctggccaacctgaaggacgagagcaagaaggagatccccctgagcgagaccgagagaggcgaggtggaggaggacaaggagaacaaggagtacagcgagaagtgcgtgaccagcaagtgccaggagatcgagatctacctgaagcagaccatcagcgagaaggaggtggagctgcagcacatcagaaaggacctggaggagaagctggccgccgaggagcagttccaggccctggtgaagcagatgaaccagaccctgcaggacaagaccaaccagatcgacctgctgcaggccgagatcagcgagaaccaggccatcatccagaagctgatcaccagcaacaccgacgccagcgacggcgacagcgtggccctggtgaaggagaccgtggtgatcagccccccctgcaccggcagcagcgagcactggaagcccgagctggaggagaagatcctggccctggagaaggagaaggagcagctgcagaagaagctgcaggaggccctgaccagcagaaaggccatcctgaagaaggcccaggagaaggagagacacctgagagaggagctgaagcagcagaaggacgactacaacagactgcaggagcagttcgacgagcagagcaaggagaacgagaacatcggcgaccagctgagacagctgcagatccaggtgagagagagcatcgacggcaagctgcccagcaccgaccagcaggagagctgcagcagcacccccggcctggaggagcccctgttcaaggccaccgagcagcaccacacccagcccgtgctggagagcaacctgtgccccgactggcccagccacagcgaggacgccagcgccctgcagggcggcaccagcgtggcccagatcaaggcccagctgaaggagatcgaggccgagaaggtggagctggagctgaaggtgagcagcaccaccagcgagctgaccaagaagagcgaggaggtgttccagctgcaggagcagatcaacaagcagggcctggagatcgagagcctgaagaccgtgagccacgaggccgaggtgcacgccgagagcctgcagcagaagctggagagcagccagctgcagatcgccggcctggagcacctgagagagctgcagcccaagctggacgagctgcagaagctgatcagcaagaaggaggaggacgtgagctacctgagcggccagctgagcgagaaggaggccgccctgaccaagatccagaccgagatcatcgagcaggaggacctgatcaaggccctgcacacccagctggagatgcaggccaaggagcacgacgagagaatcaagcagctgcaggtggagctgtgcgagatgaagcagaagcccgaggagatcggcgaggagagcagagccaagcagcagatccagagaaagctgcaggccgccctgatcagcagaaaggaggccctgaaggagaacaagagcctgcaggaggagctgagcctggccagaggcaccatcgagagactgaccaagagcctggccgacgtggagagccaggtgagcgcccagaacaaggagaaggacaccgtgctgggcagactggccctgctgcaggaggagagagacaagctgatcaccgagatggacagaagcctgctggagaaccagagcctgagcagcagctgcgagagcctgaagctggccctggagggcctgaccgaggacaaggagaagctggtgaaggagatcgagagcctgaagagcagcaagatcgccgagagcaccgagtggcaggagaagcacaaggagctgcagaaggagtacgagatcctgctgcagagctacgagaacgtgagcaacgaggccgagagaatccagcacgtggtggaggccgtgagacaggagaagcaggagctgtacggcaagctgagaagcaccgaggccaacaagaaggagaccgagaagcagctgcaggaggccgagcaggagatggaggagatgaaggagtag

SEQ ID NO: 83571 - DNA, 9810 bp, Artificial Sequence
  Description of Artificial Sequence: Synthetic coding sequence
atgctgagcagactgagcggcctggccaacgtggtgctgcacgagctgagcggcgacgacgacaccgaccagaacatgagagcccccctggaccccgagctgcaccaggagagcgacatggagttcaacaacaccacccaggaggacgtgcaggagagactggcctacgccgagcagctggtggtggagctgaaggacatcatcagacagaaggacgtgcagctgcagcagaaggacgaggccctgcaggaggagagaaaggccgccgacaacaagatcaagaagctgaagctgcacgccaaggccaagctgaccagcctgaacaagtacatcgaggagatgaaggcccagggcggcaccgtgctgcccaccgagccccagagcgaggagcagctgagcaagcacgacaagagcagcaccgaggaggagatggagatcgagaagatcaagcacaagctgcaggagaaggaggagctgatcagcaccctgcaggcccagctgacccaggcccaggccgagcagcccgcccagagcagcaccgagatggaggagttcgtgatgatgaagcagcagctgcaggagaaggaggagttcatcagcaccctgcaggcccagctgagccagacccaggccgagcaggccgcccagctgagcagcatgcagcaggtggtgagagagaaggacgccagattcgagacccaggtgagactgcacgaggacgagctgctgcagctggtgacccaggccgacgtggagaccgagatgcagcagaagctgagagtgctgcagagaaagctggaggagcacgaggagagcctggtgggcagagcccaggtggtggacctgctgcagcaggagctgaccgccgccgagcagagaaaccagatcctgagccagcagctgcagcagatggaggccgagcacaacaccctgagaaacaccgtggagaccgagagagaggagagcaagatcctgctggagaagatggagctggaggtggccgagagaaagctgagcttccacaacctgcaggaggagatgcaccacctgctggagcagttcgagcaggccggccaggcccaggccgagctggagagcagatacagcgccctggagcagaagcacaaggccgagatggaggagaagaccagccacatcctgagcctgcagaagaccggccaggagctgcagagcgcctgcgacgccctgaaggaccagaacagcaagctgctgcaggacaagaacgagcaggccgtgcagagcgcccagaccatccagcagctggaggaccagctgcagcagaagagcaaggagatcagccagttcctgaacagactgcccctgcagcagcacgagaccgccagccagaccagcttccccgacgtgtacaacgagggcacccaggccgtgaccgaggagaacatcgccagcctgcagaagagagtggtggagctggagaacgagaagggcgccctgctgctgagcagcatcgagctggaggagctgaaggccgagaacgagaagctgagcagccagatcaccctgctggaggcccagaacagaaccggcgaggccgacagagaggtgagcgagatcagcatcgtggacatcgccaacaagagaagcagcagcgccgaggagagcggccaggacgtgctggagaacaccttcagccagaagcacaaggagctgagcgtgctgctgctggagatgaaggaggcccaggaggagatcgccttcctgaagctgcagctgcagggcaagagagccgaggaggccgaccacgaggtgctggaccagaaggagatgaagcagatggagggcgagggcatcgcccccatcaagatgaaggtgttcctggaggacaccggccaggacttccccctgatgcccaacgaggagagcagcctgcccgccgtggagaaggagcaggccagcaccgagcaccagagcagaaccagcgaggagatcagcctgaacgacgccggcgtggagctgaagagcaccaagcaggacggcgacaagagcctgagcgccgtgcccgacatcggccagtgccaccaggacgagctggagagactgaagagccagatcctggagctggagctgaacttccacaaggcccaggagatctacgagaagaacctggacgagaaggccaaggagatcagcaacctgaaccagctgatcgaggagttcaagaagaacgccgacaacaacagcagcgccttcaccgccctgagcgaggagagagaccagctgctgagccaggtgaaggagctgagcatggtgaccgagctgagagcccaggtgaagcagctggagatgaacctggccgaggccgagagacagagaagactggactacgagagccagaccgcccacgacaacctgctgaccgagcagatccacagcctgagcatcgaggccaagagcaaggacgtgaagatcgaggtgctgcagaacgagctggacgacgtgcagctgcagttcagcgagcagagcaccctgatcagaagcctgcagagccagctgcagaacaaggagagcgaggtgctggagggcgccgagagagtgagacacatcagcagcaaggtggaggagctgagccaggccctgagccagaaggagctggagatcaccaagatggaccagctgctgctggagaagaagagagacgtggagaccctgcagcagaccatcgaggagaaggaccagcaggtgaccgagatcagcttcagcatgaccgagaagatggtgcagctgaacgaggagaagttcagcctgggcgtggagatcaagaccctgaaggagcagctgaacctgctgagcagagccgaggaggccaagaaggagcaggtggaggaggacaacgaggtgagcagcggcctgaagcagaactacgacgagatgagccccgccggccagatcagcaaggaggagctgcagcacgagttcgacctgctgaagaaggagaacgagcagagaaagagaaagctgcaggccgccctgatcaacagaaaggagctgctgcagagagtgagcagactggaggaggagctggccaacctgaaggacgagagcaagaaggagatccccctgagcgagaccgagagaggcgaggtggaggaggacaaggagaacaaggagtacagcgagaagtgcgtgaccagcaagtgccaggagatcgagatctacctgaagcagaccatcagcgagaaggaggtggagctgcagcacatcagaaaggacctggaggagaagctggccgccgaggagcagttccaggccctggtgaagcagatgaaccagaccctgcaggacaagaccaaccagatcgacctgctgcaggccgagatcagcgagaaccaggccatcatccagaagctgatcaccagcaacaccgacgccagcgacggcgacagcgtggccctggtgaaggagaccgtggtgatcagccccccctgcaccggcagcagcgagcactggaagcccgagctggaggagaagatcctggccctggagaaggagaaggagcagctgcagaagaagctgcaggaggccctgaccagcagaaaggccatcctgaagaaggcccaggagaaggagagacacctgagagaggagctgaagcagcagaaggacgactacaacagactgcaggagcagttcgacgagcagagcaaggagaacgagaacatcggcgaccagctgagacagctgcagatccaggtgagagagagcatcgacggcaagctgcccagcaccgaccagcaggagagctgcagcagcacccccggcctggaggagcccctgttcaaggccaccgagcagcaccacacccagcccgtgctggagagcaacctgtgccccgactggcccagccacagcgaggacgccagcgccctgcagggcggcaccagcgtggcccagatcaaggcccagctgaaggagatcgaggccgagaaggtggagctggagctgaaggtgagcagcaccaccagcgagctgaccaagaagagcgaggaggtgttccagctgcaggagcagatcaacaagcagggcctggagatcgagagcctgaagaccgtgagccacgaggccgaggtgcacgccgagagcctgcagcagaagctggagagcagccagctgcagatcgccggcctggagcacctgagagagctgcagcccaagctggacgagctgcagaagctgatcagcaagaaggaggaggacgtgagctacctgagcggccagctgagcgagaaggaggccgccctgaccaagatccagaccgagatcatcgagcaggaggacctgatcaaggccctgcacacccagctggagatgcaggccaaggagcacgacgagagaatcaagcagctgcaggtggagctgtgcgagatgaagcagaagcccgaggagatcggcgaggagagcagagccaagcagcagatccagagaaagctgcaggccgccctgatcagcagaaaggaggccctgaaggagaacaagagcctgcaggaggagctgagcctggccagaggcaccatcgagagactgaccaagagcctggccgacgtggagagccaggtgagcgcccagaacaaggagaaggacaccgtgctgggcagactggccctgctgcaggaggagagagacaagctgatcaccgagatggacagaagcctgctggagaaccagagcctgagcagcagctgcgagagcctgaagctggccctggagggcctgaccgaggacaaggagaagctggtgaaggagatcgagagcctgaagagcagcaagatcgccgagagcaccgagtggcaggagaagcacaaggagctgcagaaggagtacgagatcctgctgcagagctacgagaacgtgagcaacgaggccgagagaatccagcacgtggtggaggccgtgagacaggagaagcaggagctgtacggcaagctgagaagcaccgaggccaacaagaaggagaccgagaagcagctgcaggaggccgagcaggagatggaggagatgaaggagaagatgagaaagttcgccaagagcaagcagcagaagatcctggagctggaggaggagaacgacagactgagagccgaggtgcaccccgccggcgacaccgccaaggagtgcatggagaccctgctgagcagcaacgccagcatgaaggaggagctggagagagtgaagatggagtacgagaccctgagcaagaagttccagagcctgatgagcgagaaggacagcctgagcgaggaggtgcaggacctgaagcaccagatcgagggcaacgtgagcaagcaggccaacctggaggccaccgagaagcacgacaaccagaccaacgtgaccgaggagggcacccagagcatccccggcgagaccgaggagcaggacagcctgagcatgagcaccagacccacctgcagcgagagcgtgcccagcgccaagagcgccaaccccgccgtgagcaaggacttcagcagccacgacgagatcaacaactacctgcagcagatcgaccagctgaaggagagaatcgccggcctggaggaggagaagcagaagaacaaggagttcagccagaccctggagaacgagaagaacaccctgctgagccagatcagcaccaaggacggcgagctgaagatgctgcaggaggaggtgaccaagatgaacctgctgaaccagcagatccaggaggagctgagcagagtgaccaagctgaaggagaccgccgaggaggagaaggacgacctggaggagagactgatgaaccagctggccgagctgaacggcagcatcggcaactactgccaggacgtgaccgacgcccagatcaagaacgagctgctggagagcgagatgaagaacctgaagaagtgcgtgagcgagctggaggaggagaagcagcagctggtgaaggagaagaccaaggtggagagcgagatcagaaaggagtacctggagaagatccagggcgcccagaaggagcccggcaacaagagccacgccaaggagctgcaggagctgctgaaggagaagcagcaggaggtgaagcagctgcagaaggactgcatcagataccaggagaagatcagcgccctggagagaaccgtgaaggccctggagttcgtgcagaccgagagccagaaggacctggagatcaccaaggagaacctggcccaggccgtggagcacagaaagaaggcccaggccgagctggccagcttcaaggtgctgctggacgacacccagagcgaggccgccagagtgctggccgacaacctgaagctgaagaaggagctgcagagcaacaaggagagcgtgaagagccagatgaagcagaaggacgaggacctggagagaagactggagcaggccgaggagaagcacctgaaggagaagaagaacatgcaggagaagctggacgccctgagaagagagaaggtgcacctggaggagaccatcggcgagatccaggtgaccctgaacaagaaggacaaggaggtgcagcagctgcaggagaacctggacagcaccgtgacccagctggccgccttcaccaagagcatgagcagcctgcaggacgacagagacagagtgatcgacgaggccaagaagtgggagagaaagttcagcgacgccatccagagcaaggaggaggagatcagactgaaggaggacaactgcagcgtgctgaaggaccagctgagacagatgagcatccacatggaggagctgaagatcaacatcagcagactggagcacgacaagcagatctgggagagcaaggcccagaccgaggtgcagctgcagcagaaggtgtgcgacaccctgcagggcgagaacaaggagctgctgagccagctggaggagaccagacacctgtaccacagcagccagaacgagctggccaagctggagagcgagctgaagagcctgaaggaccagctgaccgacctgagcaacagcctggagaagtgcaaggagcagaagggcaacctggagggcatcatcagacagcaggaggccgacatccagaacagcaagttcagctacgagcagctggagaccgacctgcaggccagcagagagctgaccagcagactgcacgaggagatcaacatgaaggagcagaagatcatcagcctgctgagcggcaaggaggaggccatccaggtggccatcgccgagctgagacagcagcacgacaaggagatcaaggagctggagaacctgctgagccaggaggaggaggagaacatcgtgctggaggaggagaacaagaaggccgtggacaagaccaaccagctgatggagaccctgaagaccatcaagaaggagaacatccagcagaaggcccagctggacagcttcgtgaagagcatgagcagcctgcagaacgacagagacagaatcgtgggcgactaccagcagctggaggagagacacctgagcatcatcctggagaaggaccagctgatccaggaggccgccgccgagaacaacaagctgaaggaggagatcagaggcctgagaagccacatggacgacctgaacagcgagaacgccaagctggacgccgagctgatccagtacagagaggacctgaaccaggtgatcaccatcaaggacagccagcagaagcagctgctggaggtgcagctgcagcagaacaaggagctggagaacaagtacgccaagctggaggagaagctgaaggagagcgaggaggccaacgaggacctgagaagaagcttcaacgccctgcaggaggagaagcaggacctgagcaaggagatcgagagcctgaaggtgagcatcagccagctgaccagacaggtgaccgccctgcaggaggagggcaccctgggcctgtaccacgcccagctgaaggtgaaggaggaggaggtgcacagactgagcgccctgttcagcagcagccagaagagaatcgccgagctggaggaggagctggtgtgcgtgcagaaggaggccgccaagaaggtgggcgagatcgaggacaagctgaagaaggagctgaagcacctgcaccacgacgccggcatcatgagaaacgagaccgagaccgccgaggagagagtggccgagctggccagagacctggtggagatggagcagaagctgctgatggtgaccaaggagaacaagggcctgaccgcccagatccagagcttcggcagaagcatgagcagcctgcagaacagcagagaccacgccaacgaggagctggacgagctgaagagaaagtacgacgccagcctgaaggagctggcccagctgaaggagcagggcctgctgaacagagagagagacgccctgctgagcgagaccgccttcagcatgaacagcaccgaggagaacagcctgagccacctggagaagctgaaccagcagctgctgagcaaggacgagcagctgctgcacctgagcagccagctggaggacagctacaaccaggtgcagagcttcagcaaggccatggccagcctgcagaacgagagagaccacctgtggaacgagctggagaagttcagaaagagcgaggagggcaagcagagaagcgccgcccagcccagcaccagccccgccgaggtgcagagcctgaagaaggccatgagcagcctgcagaacgacagagacagactgctgaaggagctgaagaacctgcagcagcagtacctgcagatcaaccaggagatcaccgagctgcaccccctgaaggcccagctgcaggagtaccaggacaagaccaaggccttccagatcatgcaggaggagctgagacaggagaacctgagctggcagcacgagctgcaccagctgagaatggagaagagcagctgggagatccacgagagaagaatgaaggagcagtacctgatggccatcagcgacaaggaccagcagctgagccacctgcagaacctgatcagagagctgagaagcagcagcagccagacccagcccctgaaggtgcagtaccagagacaggccagccccgagaccagcgccagccccgacggcagccagaacctggtgtacgagaccgagctgctgagaacccagctgaacgacagcctgaaggagatccaccagaaggagctgagaatccagcagctgaacagcaacttcagccagctgctggaggagaagaacaccctgagcatccagctgtgcgacaccagccagagcctgagagagaaccagcagcactacggcgacctgctgaaccactgcgccgtgctggagaagcaggtgcaggagctgcaggccgtgagcaaggagaagggccccctgaacatcgacgtggcccccggcgccccccaggagaagaacggcgtgcacagaaagagcgaccccgaggagctgagagagccccagcagagcttcagcgaggcccagcagcagctgtgcaacaccagacaggaggtgaacgagctgagaaagctgctggaggaggagagagaccagagagtggccgccgagaacgccctgagcgtggccgaggagcagatcagaagactggagcacagcgagtgggacagcagcagaacccccatcatcggcagctgcggcacccaggagcaggccctgctgatcgacctgaccagcaacagctgcagaagaaccagaagcggcgtgggctggaagagagtgctgagaagcctgtgccacagcagaaccagagtgcccctgctggccgccatctacttcctgatgatccacgtgctgctgatcctgtgcttcaccggccacctgtag

SEQ ID NO: 83572 - DNA, 741 bp, Artificial Sequence
  Description of Artificial Sequence: Synthetic coding sequence
atgagctgggccgccgtgctggccgtggccgccgccagattcggccacttctggggctgcagatggcccggccccatggcccagggctgggccggcttcagcgaggaggagctgagaagactgaagcagaccaaggaccccttcgagccccagagaagactgcccgccaagaagagcagacagcagctgcagagagagaaggccctggtggagcagagccagaagctgggcctgcaggacggcagcaccagcctgctgcccgagcagctgctgagcgcccccaagcagagagtgaacgtgcagaagccccccttcagcagccccaccctgcccagccacttcaccctgaccagccccgtgggcgacggccagccccagggcatcgagagccagcccaaggagctgggcctggagaacagccacgacggccacaacaacgtggagatcctgccccccaagcccgactgcaagctggagaagaagaaggtggagctgcaggagaagagcagatgggaggtgctgcagcaggagcagagactgatggaggagaagaacaagagaaagaaggccctgctggccaaggccatcgccgagagaagcaagagaacccaggccgagaccatgaagctgaagagaatccagaaggagctgcaggccctggacgacatggtgagcgccgacatcggcatcctgagaaacagaatcgaccaggccagcctggactacagctacgccagatag

SEQ ID NO: 83573 - DNA, 1185 bp, Artificial Sequence
  Description of Artificial Sequence: Synthetic coding sequence
atgagctgggccgccgtgctggccgtggccgccgccagattcggccacttctggggctgcagatggcccggccccatggcccagggctgggccggcttcagcgaggaggagctgagaagactgaagcagaccaaggaccccttcgagccccagagaagactgcccgccaagaagagcagacagcagctgcagagagagaaggccctggtggagcagagccagaagctgggcctgcaggacggcagcaccagcctgctgcccgagcagctgctgagcgcccccaagcagagagtgaacgtgcagaagccccccttcagcagccccaccctgcccagccacttcaccctgaccagccccgtgggcgacggccagccccagggcatcgagagccagcccaaggagctgggcctggagaacagccacgacggccacaacaacgtggagatcctgccccccaagcccgactgcaagctggagaagaagaaggtggagctgcaggagaagagcagatgggaggtgctgcagcaggagcagagactgatggaggagaagaacaagagaaagaaggccctgctggccaaggccatcgccgagagaagcaagagaacccaggccgagaccatgaagctgaagagaatccagaaggagctgcaggccctggacgacatggtgagcgccgacatcggcatcctgagaaacagaatcgaccaggccagcctggactacagctacgccagaaagagattcgacagagccgaggccgagtacatcgccgccaagctggacatccagagaaagaccgagatcaaggagcagctgaccgagcacctgtgcaccatcatccagcagaacgagctgagaaaggccaagaagctggaggagctgatgcagcagctggacgtggaggccgacgaggagaccctggagctggaggtggaggtggagagactgctgcacgagcaggaggtggagagcagaagacccgtggtgagactggagagacccttccagcccgccgaggagagcgtgaccctggagttcgccaaggagaacagaaagtgccaggagcaggccgtgagccccaaggtggacgaccagtgcggcaacagcagcagcatccccttcctgagccccaactgccccaaccaggagggcaacgacatcagcgccgccctggccacctag

SEQ ID NO: 83574 - DNA, 861 bp, Artificial Sequence
  Description of Artificial Sequence: Synthetic coding sequence
  Description of Combined DNA/RNA Molecule: Synthetic coding sequence
atgcccctggacgccacctggaacatcaccgtgcagtggctggccgtggacatcgcctgcagaaccctgatgttcctgaagctgatggccacctacagcgccgccttcctgcccgtggtgatcggcctggacagacaggccgccgtgctgaaccccctgggcagcagaagcggcgtgagaaagctgctgggcgccgcctggggcctgagcttcctgctggccttcccccagctgttcctgttccacaccgtgcacugagccggccccgtgcccttcacccagtgcgtgaccaagggcagcttcaaggcccagtggcaggagaccacctacaacctgttcaccttctgctgcctgttcctgctgcccctgaccgccatggccatctgctacagcagaatcgtgctgagcgtgagcagaccccagaccagaaagggcagccacgcccccgccggcgagttcgccctgcccagaagcttcgacaactgccccagagtgagactgagagccctgagactggccctgctgatcctgctgaccttcatcctgtgctggaccccctactacctgctgggcatgtggtactggttcagccccaccatgctgaccgaggtgccccccagcctgagccacatcctgttcctgctgggcctgctgaacgcccccctggaccccctgctgtacggcgccttcaccctgggctgcagaagaggccaccaggagctgagcatcgacagcagcaaggagggcagcggcagaatgctgcaggaggagatccacgccttcagacagctggaggtgcagaagaccgtgaccagcagaagagccggcgagaccaagggcatcagcatcaccagcatctag

SEQ ID NO: 83575 - DNA, 879 bp, Artificial Sequence
  Description of Artificial Sequence: Synthetic coding sequence
  Description of Combined DNA/RNA Molecule: Synthetic coding sequence
atgagcgccggcaacggcaccccctgggacgccacctggaacatcaccgtgcagtggctggccgtggacatcgcctgcagaaccctgatgttcctgaagctgatggccacctacagcgccgccttcctgcccgtggtgatcggcctggacagacaggccgccgtgctgaaccccctgggcagcagaagcggcgtgagaaagctgctgggcgccgcctggggcctgagcttcctgctggccttcccccagctgttcctgttccacaccgtgcacugagccggccccgtgcccttcacccagtgcgtgaccaagggcagcttcaaggcccagtggcaggagaccacctacaacctgttcaccttctgctgcctgttcctgctgcccctgaccgccatggccatctgctacagcagaatcgtgctgagcgtgagcagaccccagaccagaaagggcagccacgcccccgccggcgagttcgccctgcccagaagcttcgacaactgccccagagtgagactgagagccctgagactggccctgctgatcctgctgaccttcatcctgtgctggaccccctactacctgctgggcatgtggtactggttcagccccaccatgctgaccgaggtgccccccagcctgagccacatcctgttcctgctgggcctgctgaacgcccccctggaccccctgctgtacggcgccttcaccctgggctgcagaagaggccaccaggagctgagcatcgacagcagcaaggagggcagcggcagaatgctgcaggaggagatccacgccttcagacagctggaggtgcagaagaccgtgaccagcagaagagccggcgagaccaagggcatcagcatcaccagcatctag

SEQ ID NO: 83576 - DNA, 363 bp, Artificial Sequence
  Description of Artificial Sequence: Synthetic coding sequence
atggccagcagcagaagaggcctgctgctgctgctgctgctgaccgcccacctgggccccagcgaggcccagcactggagccacggctggtaccccggcggcaagagagccctgagcagcgcccaggacccccagaacgccctgagaccccccggcagagccctggacaccgccgccggcagccccgtgcagaccgcccacggcctgcccagcgacgccctggcccccctggacgacagcatgccctgggagggcagaaccaccgcccagtggagcctgcacagaaagagacacctggccagaaccctgctgaccgccgccagagagcccagacccgccccccccagcagcaacaaggtgtag

SEQ ID NO: 83577 - DNA, 342 bp, Artificial Sequence
  Description of Artificial Sequence: Synthetic coding sequence
atggccagcagcagaagaggcctgctgctgctgctgctgctgaccgcccacctgggccccagcgaggcccagcactggagccacggctggtaccccggcggcaagagagccctgagcagcgcccaggacccccagaacgccctgagaccccccgccggcagccccgtgcagaccgcccacggcctgcccagcgacgccctggcccccctggacgacagcatgccctgggagggcagaaccaccgcccagtggagcctgcacagaaagagacacctggccagaaccctgctgaccgccgccagagagcccagacccgccccccccagcagcaacaaggtgtag

SEQ ID NO: 83578 - DNA, 339 bp, Artificial Sequence
  Description of Artificial Sequence: Synthetic coding sequence
atggccagcagcagaagaggcctgctgctgctgctgctgctgaccgcccacctgggccccagcgaggcccagcactggagccacggctggtaccccggcggcaagagagccctgagcagcgcccaggacccccagaacgccctgagaccccccggcagccccgtgcagaccgcccacggcctgcccagcgacgccctggcccccctggacgacagcatgccctgggagggcagaaccaccgcccagtggagcctgcacagaaagagacacctggccagaaccctgctgaccgccgccagagagcccagacccgccccccccagcagcaacaaggtgtag

SEQ ID NO: 83579 - DNA, 339 bp, Artificial Sequence; identical to SEQ ID NO: 83578
  Description of Artificial Sequence: Synthetic coding sequence

SEQ ID NO: 83580 - DNA, 342 bp, Artificial Sequence; identical to SEQ ID NO: 83577
  Description of Artificial Sequence: Synthetic coding sequence

SEQ ID NO: 83581 - DNA, 945 bp, Artificial Sequence
  Description of Artificial Sequence: Synthetic coding sequence
atgtacaagatggagtacagctacctgaacagcagcgcctacgagagctgcatggccggcatggacaccagcagcctggccagcgcctacgccgacttcagcagctgcagccaggccagcggcttccagtacaaccccatcagaaccaccttcggcgccaccagcggctgccccagcctgacccccggcagctgcagcctgggcaccctgagagaccaccagagcagcccctacgccgccgtgccctacaagctgttcaccgaccacggcggcctgaacgagaagagaaagcagagaagaatcagaaccaccttcaccagcgcccagctgaaggagctggagagagtgttcgccgagacccactaccccgacatctacaccagagaggagctggccctgaagatcgacctgaccgaggccagagtgcaggtgtggttccagaacagaagagccaagttcagaaagcaggagagagccgccgccgccgccgccgccgccgccaagaacggcagcagcggcaagaagagcgacagcagcagagacgacgagagcaaggaggccaagagcaccgaccccgacagcaccggcggccccggccccaaccccaaccccacccccagctgcggcgccaacggcggcggcggcggcggccccagccccgccggcgcccccggcgccgccggccccggcggccccggcggcgagcccggcaagggcggcgccgccgccgccgccgccgccgccgccgccgccgccgccgccgccgccgccgccgccgccggcggcctggccgccgccggcggccccggccagggctgggcccccggccccggccccatcaccagcatccccgacagcctgggcggccccttcgccagcgtgctgagcagcctgcagagacccaacggcgccaaggccgccctggtgaagagcagcatgttctag

SEQ ID NO: 83582 - DNA, 750 bp, Artificial Sequence
  Description of Artificial Sequence: Synthetic coding sequence
atggccaacagcgccagccccgagcagaaccagaaccactgcagcgccatcaacaacagcatccccctgatgcagggcaacctgcccaccctgaccctgagcggcaagatcagagtgaccgtgaccttcttcctgttcctgctgagcgccaccttcaacgccagcttcctgctgaagctgcagaagtggacccagaagaaggagaagggcaagaagctgagcagaatgaagctgctgctgaagcacctgaccctggccaacctgctggagaccctgatcgtgatgcccctggacggcatgtggaacatcaccgtgcagtggtacgccggcgagctgctgtgcaaggtgctgagctacctgaagctgttcagcatgtacgcccccgccttcatgatggtggtgatcagcctggacagaagcctggccatcaccagacccctggccctgaagagcaacagcaaggtgggccagagcatggtgggcctggcctggatcctgagcagcgtgttcgccggcccccagctgcccctgcaccaccccagcttccaccacgccgacctgcagtgcaagaaccacctgcaccccgacaccggccccagcagcggcccccccagaaccaccaccgagagcgtgcaggagcagtacaccaagagcaccgccgaggacagcaagaacgacggctgcatctgccacttcatctactgcctgctggacagcctgctgtgccccagaaacctggtgctggtgtag

SEQ ID NO: 83583 - DNA, 2055 bp, Artificial Sequence
  Description of Artificial Sequence: Synthetic coding sequence
atggaggagaacctgatcagcatgagagaggaccacagcttccacgtgagatacagaatggaggccagctgcctggagctggccctggagggcgagagactgtgcaagagcggcgactgcagagccggcgtgagcttcttcgaggccgccgtgcaggtgggcaccgaggacctgaagaccctgagcgccatctacagccagctgggcaacgcctacttctacctgcacgactacgccaaggccctggagtaccaccaccacgacctgaccctggccagaaccatcggcgaccagctgggcgaggccaaggccagcggcaacctgggcaacaccctgaaggtgctgggcaacttcgacgaggccatcgtgtgctgccagagacacctggacatcagcagagagctgaacgacaaggtgggcgaggccagagccctgtacaacctgggcaacgtgtaccacgccaagggcaagagcttcggctgccccggcccccaggacgtgggcgagttccccgaggaggtgagagacgccctgcaggccgccgtggacttctacgaggagaacctgagcctggtgaccgccctgggcgacagagccgcccagggcagagccttcggcaacctgggcaacacccactacctgctgggcaacttcagagacgccgtgatcgcccacgagcagagactgctgatcgccaaggagttcggcgacaaggccgccgagagaagagcctacagcaacctgggcaacgcctacatcttcctgggcgagttcgagaccgccagcgagtactacaagaagaccctgctgctggccagacagctgaaggacagagccgtggaggcccagagctgctacagcctgggcaacacctacaccctgctgcaggactacgagaaggccatcgactaccacctgaagcacctggccatcgcccaggagctgaacgacagaatcggcgagggcagagcctgctggagcctgggcaacgcctacaccgccctgggcaaccacgaccaggccatgcacttcgccgagaagcacctggagatcagcagagaggtgggcgacaagagcggcgagctgaccgccagactgaacctgagcgacctgcagatggtgctgggcctgagctacagcaccaacaacagcatcatgagcgagaacaccgagatcgacagcagcctgaacggcgtgagacccaagctgggcagaagacacagcatggagaacatggagctgatgaagctgacccccgagaaggtgcagaactggaacagcgagatcctggccaagcagaagcccctgatcgccaagcccagcgccaagctgctgttcgtgaacagactgaagggcaagaagtacaagaccaacagcagcaccaaggtgctgcaggacgccagcaacagcatcgaccacagaatccccaacagccagagaaagatcagcgccgacaccatcggcgacgagggcttcttcgacctgctgagcagattccagagcaacagaatggacgaccagagatgctgcctgcaggagaagaactgccacaccgccagcaccaccaccagcagcaccccccccaagatgatgctgaagaccagcagcgtgcccgtggtgagccccaacaccgacgagttcctggacctgctggccagcagccagagcagaagactggacgaccagagagccagcttcagcaacctgcccggcctgagactgacccagaacagccagagcgtgctgagccacctgatgaccaacgacaacaaggaggccgacgaggacttcttcgacatcctggtgaagtgccagggcagcagactggacgaccagagatgcgcccccccccccgccaccaccaagggccccaccgtgcccgacgaggacttcttcagcctgatcctgagaagccagggcaagagaatggacgagcagagagtgctgctgcagagagaccagaacagagacaccgacttcggcctgaaggacttcctgcagaacaacgccctgctggagttcaagaacagcggcaagaagagcgccgaccactag

SEQ ID NO: 83584 - DNA, 2055 bp, Artificial Sequence; identical to SEQ ID NO: 83583
  Description of Artificial Sequence: Synthetic coding sequence

SEQ ID NO: 83585 - DNA, 228 bp, Artificial Sequence
  Description of Artificial Sequence: Synthetic coding sequence
atggaggagaacctgatcagcatgagagaggaccacagcttccacgtgagatacagaatggaggccagctgcctggagctggccctggagggcgagagactgtgcaagagcggcgactgcagagccggcgtgagcttcttcgaggccgccgtgcaggtgggcaccgaggacctgaagaccctgagcgccatctacagccagctgggcaacgcctacttctacctgtag

SEQ ID NO: 83586 - DNA, 642 bp, Artificial Sequence
  Description of Artificial Sequence: Synthetic coding sequence
atggaggagaacctgatcagcatgagagaggaccacagcttccacgtgagatacagaatggaggccagctgcctggagctggccctggagggcgagagactgtgcaagagcggcgactgcagagccggcgtgagcttcttcgaggccgccgtgcaggtgggcaccgaggacctgaagaccctgagcgccatctacagccagctgggcaacgcctacttctacctgcacgactacgccaaggccctggagtaccaccaccacgacctgaccctggccagaaccatcggcgaccagctgggcgaggccaaggccagcggcaacctgggcaacaccctgaaggtgctgggcaacttcgacgaggccatcgtgtgctgccagagacacctggacatcagcagagagctgaacgacaaggtgggcgaggccagagccctgtacaacctgggcaacgtgtaccacgccaagggcaagagcttcggctgccccggcccccaggacgtgggcgagttccccgaggaggtgagagacgccctgcaggccgccgtggacttctacgaggagaacctgagcctggtgaccgccctgggcgacagagccgcccagggcagagccttcggcaacctgggcaacacccactactag

SEQ ID NO: 83587 - DNA, 159 bp, Artificial Sequence
  Description of Artificial Sequence: Synthetic coding sequence
atggaggagaacctgatcagcatgagagaggaccacagcttccacgtgagatacagaatggaggccagctgcctggagctggccctggagggcgagagactgtgcaagagcggcgactgcagagccggcgtgagcttcttcgaggccgccgtgcagtag

SEQ ID NO: 83588 - DNA, 1290 bp, Artificial Sequence
  Description of Artificial Sequence: Synthetic coding sequence
atggccagcctgtgggagagcccccagcagtgcatcatcctgagccccctgagcggctggtggttcagcatcggcatcagcatcctgaccagcagcgccctggtgctgaagccccagatgctgaagggcgagctgcagaccagacccagccagagacccagcagaaaggccttcagaagaaacaacttcgagtacaccctggaggccagcaagagcctgagacagaagcccggcgacagcaccatgacctacctgaacaagggccagttctaccccatcaccctgaaggaggtgagcagcagcgagggcatccaccaccccatcagcaaggtgagaagcgtgatcatggtggtgttcgccgaggacaagagcagagaggaccagctgagacactggaagtactggcacagcagacagcacaccgccaagcagagatgcatcgacatcgccgactacaaggagagcttcaacaccatcagcaacatcgaggagatcgcctacaacgccatcagcttcacctgggacatcaacgacgaggccaaggtgttcatcagcgtgaactgcctgagcaccgacttcagcagccagaagggcgtgaagggcctgcccctgaacatccaggtggacacctacagctacaacaacagaagcaacaagcccgtgcacagagcctactgccagatcaaggtgttctgcgacaagggcgccgagagaaagatcagagacgaggagagaaagcagagcaagagaaaggtgagcgacgtgaaggtgcccctgctgcccagccacaagagaatggacatcaccgtgttcaagcccttcatcgacctggacacccagcccgtgctgttcatccccgacgtgcacttcgccaacctgcagagaggcacccacgtgctgcccatcgccagcgaggagctggagggcgagggcagcgtgctgaagagaggcccctacggcaccgaggacgacttcgccgtgccccccagcaccaagctggccagaatcgaggagcccaagagagtgctgctgtacgtgagaaaggagagcgaggaggtgttcgacgccctgatgctgaagacccccagcctgaagggcctgatggaggccatcagcgacaagtacgacgtgccccacgacaagatcggcaagatcttcaagaagtgcaagaagggcatcctggtgaacatggacgacaacatcgtgaagcactacagcaacgaggacaccttccagctgcagatcgaggaggccggcggcagctacaagctgaccctgaccgagatctag

SEQ ID NO: 83589 - DNA, 1857 bp, Artificial Sequence
  Description of Artificial Sequence: Synthetic coding sequence
atgacccaggagtacgacaacaagagacccgtgctggtgctgcagaacgaggccctgtacccccagagaagaagctacaccagcgaggacgaggcctggaagagcttcctggagaaccccctgaccgccgccaccaaggccatgatgagcatcaacggcgacgaggacagcgccgccgccctgggcctgctgtacgactactacaaggtgcccagagagagaagaagcagcaccgccaagcccgaggtggagcaccccgagcccgaccacagcaagagaaacagcatccccatcgtgaccgagcagcccctgatcagcgccggcgagaacagagtgcaggtgctgaagaacgtgcccttcaacatcgtgctgccccacggcaaccagctgggcatcgacaagagaggccacctgaccgcccccgacaccaccgtgaccgtgagcatcgccaccatgcccacccacagcatcaagaccgagacccagccccacggcttcgccgtgggcatcccccccgccgtgtaccaccccgagcccaccgagagagtggtggtgttcgacagaaacctgaacaccgaccagttcagcagcggcgcccaggcccccaacgcccagagaagaacccccgacagcaccttcagcgagaccttcaaggagggcgtgcaggaggtgttcttccccagcgacctgagcctgagaatgcccggcatgaacagcgaggactacgtgttcgacagcgtgagcggcaacaacttcgagtacaccctggaggccagcaagagcctgagacagaagcccggcgacagcaccatgacctacctgaacaagggccagttctaccccatcaccctgaaggaggtgagcagcagcgagggcatccaccaccccatcagcaaggtgagaagcgtgatcatggtggtgttcgccgaggacaagagcagagaggaccagctgagacactggaagtactggcacagcagacagcacaccgccaagcagagatgcatcgacatcgccgactacaaggagagcttcaacaccatcagcaacatcgaggagatcgcctacaacgccatcagcttcacctgggacatcaacgacgaggccaaggtgttcatcagcgtgaactgcctgagcaccgacttcagcagccagaagggcgtgaagggcctgcccctgaacatccaggtggacacctacagctacaacaacagaagcaacaagcccgtgcacagagcctactgccagatcaaggtgttctgcgacaagggcgccgagagaaagatcagagacgaggagagaaagcagagcaagagaaaggtgagcgacgtgaaggtgcccctgctgcccagccacaagagaatggacatcaccgtgttcaagcccttcatcgacctggacacccagcccgtgctgttcatccccgacgtgcacttcgccaacctgcagagaggcacccacgtgctgcccatcgccagcgaggagctggagggcgagggcagcgtgctgaagagaggcccctacggcaccgaggacgacttcgccgtgccccccagcaccaagctggccagaatcgaggagcccaagagagtgctgctgtacgtgagaaaggagagcgaggaggtgttcgacgccctgatgctgaagacccccagcctgaagggcctgatggaggccatcagcgacaagtacgacgtgccccacgacaagatcggcaagatcttcaagaagtgcaagaagggcatcctggtgaacatggacgacaacatcgtgaagcactacagcaacgaggacaccttccagctgcagatcgaggaggccggcggcagctacaagctgaccctgaccgagatctag

SEQ ID NO: 83590 - DNA, 1857 bp, Artificial Sequence
  Description of Artificial Sequence: Synthetic coding sequence
ctgcccaaggaggtggagaacaagagacccgtgctggtgctgcagaacgaggccctgtacccccagagaagaagctacaccagcgaggacgaggcctggaagagcttcctggagaaccccctgaccgccgccaccaaggccatgatgagcatcaacggcgacgaggacagcgccgccgccctgggcctgctgtacgactactacaaggtgcccagagagagaagaagcagcaccgccaagcccgaggtggagcaccccgagcccgaccacagcaagagaaacagcatccccatcgtgaccgagcagcccctgatcagcgccggcgagaacagagtgcaggtgctgaagaacgtgcccttcaacatcgtgctgccccacggcaaccagctgggcatcgacaagagaggccacctgaccgcccccgacaccaccgtgaccgtgagcatcgccaccatgcccacccacagcatcaagaccgagacccagccccacggcttcgccgtgggcatcccccccgccgtgtaccaccccgagcccaccgagagagtggtggtgttcgacagaaacctgaacaccgaccagttcagcagcggcgcccaggcccccaacgcccagagaagaacccccgacagcaccttcagcgagaccttcaaggagggcgtgcaggaggtgttcttccccagcgacctgagcctgagaatgcccggcatgaacagcgaggactacgtgttcgacagcgtgagcggcaacaacttcgagtacaccctggaggccagcaagagcctgagacagaagcccggcgacagcaccatgacctacctgaacaagggccagttctaccccatcaccctgaaggaggtgagcagcagcgagggcatccaccaccccatcagcaaggtgagaagcgtgatcatggtggtgttcgccgaggacaagagcagagaggaccagctgagacactggaagtactggcacagcagacagcacaccgccaagcagagatgcatcgacatcgccgactacaaggagagcttcaacaccatcagcaacatcgaggagatcgcctacaacgccatcagcttcacctgggacatcaacgacgaggccaaggtgttcatcagcgtgaactgcctgagcaccgacttcagcagccagaagggcgtgaagggcctgcccctgaacatccaggtggacacctacagctacaacaacagaagcaacaagcccgtgcacagagcctactgccagatcaaggtgttctgcgacaagggcgccgagagaaagatcagagacgaggagagaaagcagagcaagagaaaggtgagcgacgtgaaggtgcccctgctgcccagccacaagagaatggacatcaccgtgttcaagcccttcatcgacctggacacccagcccgtgctgttcatccccgacgtgcacttcgccaacctgcagagaggcacccacgtgctgcccatcgccagcgaggagctggagggcgagggcagcgtgctgaagagaggcccctacggcaccgaggacgacttcgccgtgccccccagcaccaagctggccagaatcgaggagcccaagagagtgctgctgtacgtgagaaaggagagcgaggaggtgttcgacgccctgatgctgaagacccccagcctgaagggcctgatggaggccatcagcgacaagtacgacgtgccccacgacaagatcggcaagatcttcaagaagtgcaagaagggcatcctggtgaacatggacgacaacatcgtgaagcactacagcaacgaggacaccttccagctgcagatcgaggaggccggcggcagctacaagctgaccctgaccgagatctag

SEQ ID NO: 83591 - DNA, 1878 bp, Artificial Sequence
  Description of Artificial Sequence: Synthetic coding sequence
atgagccaggagagcgacaacaacaagagactggtggccctggtgcccatgcccagcgacccccccttcaacaccagaagagcctacaccagcgaggacgaggcctggaagagctacctggagaaccccctgaccgccgccaccaaggccatgatgagcatcaacggcgacgaggacagcgccgccgccctgggcctgctgtacgactactacaaggtgcccagagacaagagactgctgagcgtgagcaaggccagcgacagccaggaggaccaggagaagagaaactgcctgggcaccagcgaggcccagagcaacctgagcggcggcgagaacagagtgcaggtgctgaagaccgtgcccgtgaacctgagcctgaaccaggaccacctggagaacagcaagagagagcagtacagcatcagcttccccgagagcagcgccatcatccccgtgagcggcatcaccgtggtgaaggccgaggacttcacccccgtgttcatggccccccccgtgcactaccccagaggcgacggcgaggagcagagagtggtgatcttcgagcagacccagtacgacgtgcccagcctggccacccacagcgcctacctgaaggacgaccagagaagcacccccgacagcacctacagcgagagcttcaaggacgccgccaccgagaagttcagaagcgccagcgtgggcgccgaggagtacatgtacgaccagaccagcagcggcaccttccagtacaccctggaggccaccaagagcctgagacagaagcagggcgagggccccatgacctacctgaacaagggccagttctacgccatcaccctgagcgagaccggcgacaacaagtgcttcagacaccccatcagcaaggtgagaagcgtggtgatggtggtgttcagcgaggacaagaacagagacgagcagctgaagtactggaagtactggcacagcagacagcacaccgccaagcagagagtgctggacatcgccgactacaaggagagcttcaacaccatcggcaacatcgaggagatcgcctacaacgccgtgagcttcacctgggacgtgaacgaggaggccaagatcttcatcaccgtgaactgcctgagcaccgacttcagcagccagaagggcgtgaagggcctgcccctgatgatccagatcgacacctacagctacaacaacagaagcaacaagcccatccacagagcctactgccagatcaaggtgttctgcgacaagggcgccgagagaaagatcagagacgaggagagaaagcagaacagaaagaagggcaagggccaggccagccagacccagtgcaacagcagcagcgacggcaagctggccgccatccccctgcagaagaagagcgacatcacctacttcaagaccatgcccgacctgcacagccagcccgtgctgttcatccccgacgtgcacttcgccaacctgcagagaaccggccaggtgtactacaacaccgacgacgagagagagggcggcagcgtgctggtgaagagaatgttcagacccatggaggaggagttcggccccgtgcccagcaagcagatgaaggaggagggcaccaagagagtgctgctgtacgtgagaaaggagaccgacgacgtgttcgacgccctgatgctgaagagccccaccgtgaagggcctgatggaggccatcagcgagaagtacggcctgcccgtggagaagatcgccaagctgtacaagaagagcaagaagggcatcctggtgaacatggacgacaacatcatcgagcactacagcaacgaggacaccttcatcctgaacatggagagcatggtggagggcttcaaggtgaccctgatggagatctag

SEQ ID NO: 83592 - DNA, 1830 bp, Artificial Sequence
  Description of Artificial Sequence: Synthetic coding sequence
atgcccagcgacccccccttcaacaccagaagagcctacaccagcgaggacgaggcctggaagagctacctggagaaccccctgaccgccgccaccaaggccatgatgagcatcaacggcgacgaggacagcgccgccgccctgggcctgctgtacgactactacaaggtgcccagagacaagagactgctgagcgtgagcaaggccagcgacagccaggaggaccaggagaagagaaactgcctgggcaccagcgaggcccagagcaacctgagcggcggcgagaacagagtgcaggtgctgaagaccgtgcccgtgaacctgagcctgaaccaggaccacctggagaacagcaagagagagcagtacagcatcagcttccccgagagcagcgccatcatccccgtgagcggcatcaccgtggtgaaggccgaggacttcacccccgtgttcatggccccccccgtgcactaccccagaggcgacggcgaggagcagagagtggtgatcttcgagcagacccagtacgacgtgcccagcctggccacccacagcgcctacctgaaggacgaccagagaagcacccccgacagcacctacagcgagagcttcaaggacgccgccaccgagaagttcagaagcgccagcgtgggcgccgaggagtacatgtacgaccagaccagcagcggcaccttccagtacaccctggaggccaccaagagcctgagacagaagcagggcgagggccccatgacctacctgaacaagggccagttctacgccatcaccctgagcgagaccggcgacaacaagtgcttcagacaccccatcagcaaggtgagaagcgtggtgatggtggtgttcagcgaggacaagaacagagacgagcagctgaagtactggaagtactggcacagcagacagcacaccgccaagcagagagtgctggacatcgccgactacaaggagagcttcaacaccatcggcaacatcgaggagatcgcctacaacgccgtgagcttcacctgggacgtgaacgaggaggccaagatcttcatcaccgtgaactgcctgagcaccgacttcagcagccagaagggcgtgaagggcctgcccctgatgatccagatcgacacctacagctacaacaacagaagcaacaagcccatccacagagcctactgccagatcaaggtgttctgcgacaagggcgccgagagaaagatcagagacgaggagagaaagcagaacagaaagaagggcaagggccaggccagccagacccagtgcaacagcagcagcgacggcaagctggccgccatccccctgcagaagaagagcgacatcacctacttcaagaccatgcccgacctgcacagccagcccgtgctgttcatccccgacgtgcacttcgccaacctgcagagaaccggccaggtgtactacaacaccgacgacgagagagagggcggcagcgtgctggtgaagagaatgttcagacccatggaggaggagttcggccccgtgcccagcaagcagatgaaggaggagggcaccaagagagtgctgctgtacgtgagaaaggagaccgacgacgtgttcgacgccctgatgctgaagagccccaccgtgaagggcctgatggaggccatcagcgagaagtacggcctgcccgtggagaagatcgccaagctgtacaagaagagcaagaagggcatcctggtgaacatggacgacaacatcatcgagcactacagcaacgaggacaccttcatcctgaacatggagagcatggtggagggcttcaaggtgaccctgatggagatctag

SEQ ID NO: 83593 - DNA, 1878 bp, Artificial Sequence
  Description of Artificial Sequence: Synthetic coding sequence
atgggcaaggacggcagaagcaacaagagactggtggccctggtgcccatgcccagcgacccccccttcaacaccagaagagcctacaccagcgaggacgaggcctggaagagctacctggagaaccccctgaccgccgccaccaaggccatgatgagcatcaacggcgacgaggacagcgccgccgccctgggcctgctgtacgactactacaaggtgcccagagacaagagactgctgagcgtgagcaaggccagcgacagccaggaggaccaggagaagagaaactgcctgggcaccagcgaggcccagagcaacctgagcggcggcgagaacagagtgcaggtgctgaagaccgtgcccgtgaacctgagcctgaaccaggaccacctggagaacagcaagagagagcagtacagcatcagcttccccgagagcagcgccatcatccccgtgagcggcatcaccgtggtgaaggccgaggacttcacccccgtgttcatggccccccccgtgcactaccccagaggcgacggcgaggagcagagagtggtgatcttcgagcagacccagtacgacgtgcccagcctggccacccacagcgcctacctgaaggacgaccagagaagcacccccgacagcacctacagcgagagcttcaaggacgccgccaccgagaagttcagaagcgccagcgtgggcgccgaggagtacatgtacgaccagaccagcagcggcaccttccagtacaccctggaggccaccaagagcctgagacagaagcagggcgagggccccatgacctacctgaacaagggccagttctacgccatcaccctgagcgagaccggcgacaacaagtgcttcagacaccccatcagcaaggtgagaagcgtggtgatggtggtgttcagcgaggacaagaacagagacgagcagctgaagtactggaagtactggcacagcagacagcacaccgccaagcagagagtgctggacatcgccgactacaaggagagcttcaacaccatcggcaacatcgaggagatcgcctacaacgccgtgagcttcacctgggacgtgaacgaggaggccaagatcttcatcaccgtgaactgcctgagcaccgacttcagcagccagaagggcgtgaagggcctgcccctgatgatccagatcgacacctacagctacaacaacagaagcaacaagcccatccacagagcctactgccagatcaaggtgttctgcgacaagggcgccgagagaaagatcagagacgaggagagaaagcagaacagaaagaagggcaagggccaggccagccagacccagtgcaacagcagcagcgacggcaagctggccgccatccccctgcagaagaagagcgacatcacctacttcaagaccatgcccgacctgcacagccagcccgtgctgttcatccccgacgtgcacttcgccaacctgcagagaaccggccaggtgtactacaacaccgacgacgagagagagggcggcagcgtgctggtgaagagaatgttcagacccatggaggaggagttcggccccgtgcccagcaagcagatgaaggaggagggcaccaagagagtgctgctgtacgtgagaaaggagaccgacgacgtgttcgacgccctgatgctgaagagccccaccgtgaagggcctgatggaggccatcagcgagaagtacggcctgcccgtggagaagatcgccaagctgtacaagaagagcaagaagggcatcctggtgaacatggacgacaacatcatcgagcactacagcaacgaggacaccttcatcctgaacatggagagcatggtggagggcttcaaggtgaccctgatggagatctag

SEQ ID NO: 83594 - DNA, 21 bp, Artificial Sequence
  Description of Artificial Sequence: Synthetic coding sequence
atgagccaggagagcgactag

SEQ ID NO: 83595 - DNA, 1737 bp, Artificial Sequence
  Description of Artificial Sequence: Synthetic coding sequence
atgctgagaagactggacaagatcagattcagaggccacaagagagacgacttcctggacctggccgagagccccaacgccagcgacaccgagtgcagcgacgagatccccctgaaggtgcccagaaccagccccagagacagcgaggagctgagagaccccgccggccccggcaccctgatcatggccaccggcgtgcaggacttcaacagaaccgagttcgacagactgaacgagatcaagggccacctggagatcgccctgctggagaagcacttcctgcaggaggagctgagaaagctgagagaggagaccaacgccgagatgctgagacaggagctggacagagagagacagagaagaatggagctggagcagaaggtgcaggaggtgctgaaggccagaaccgaggagcagatggcccagcagccccccaagggccaggcccaggccagcaacggcgccgagagaagaagccagggcctgagcagcagactgcagaagtggttctacgagagattcggcgagtacgtggaggacttcagattccagcccgaggagaacaccgtggagaccgaggagcccctgagcgccagaagactgaccgagaacatgagaagactgaagagaggcgccaagcccgtgaccaacttcgtgaagaacctgagcgccctgagcgactggtacagcgtgtacaccagcgccatcgccttcaccgtgtacatgaacgccgtgtggcacggctgggccatccccctgttcctgttcctggccatcctgagactgagcctgaactacctgatcgccagaggctggagaatccagtggagcatcgtgcccgaggtgagcgagcccgtggagccccccaaggaggacctgaccgtgagcgagaagttccagctggtgctggacgtggcccagaaggcccagaacctgttcggcaagatggccgacatcctggagaagatcaagaacctgttcatgtgggtgcagcccgagatcacccagaagctgtacgtggccctgtgggccgccttcctggccagctgcttcttcccctacagactggtgggcctggccgtgggcctgtacgccggcatcaagttcttcctgatcgacttcatcttcaagagatgccccagactgagagccaagtacgacaccccctacatcatctggagaagcctgcccaccgacccccagctgaaggagagaagcagcgccgccgtgagcagaagactgcagaccaccagcagcagaagctacgtgcccagcgcccccgccggcctgggcaaggaggaggacgccggcagattccacagcaccaagaagggcaacttccacgagatcttcaacctgaccgagaacgagagacccctggccgtgtgcgagaacggctggagatgctgcctgatcaacagagacagaaagatgcccaccgactacatcagaaacggcgtgctgtacgtgaccgagaactacctgtgcttcgagagcagcaagagcggcagcagcaagagaaacaaggtgatcaagctggtggacatcaccgacatccagaagtacaaggtgctgagcgtgctgcccggcagcggcatgggcatcgccgtgagcacccccagcacccagaagcccctggtgttcggcgccatggtgcacagagacgaggccttcgagaccatcctgagccagtacatcaagatcaccagcgccgccgccagcggcggcgacagctag

SEQ ID NO: 83596 - DNA, 1737 bp, Artificial Sequence; identical to SEQ ID NO: 83595
  Description of Artificial Sequence: Synthetic coding sequence

SEQ ID NO: 83597 - DNA, 102 bp, Artificial Sequence
  Description of Artificial Sequence: Synthetic coding sequence
atgctgagaagactggacaagatcagattcagaggccacaagagagacgacttcctggacctggccgagagccccaacgccagcgacaccgagtgcagctag

SEQ ID NO: 83598 - DNA, 1782 bp, Artificial Sequence
  Description of Artificial Sequence: Synthetic coding sequence
atgtggaccctggtgagctgggtggccctgaccgccggcctggtggccggcaccagatgccccgacggccagttctgccccgtggcctgctgcctggaccccggcggcgccagctacagctgctgcagacccctgctggacaagtggcccaccaccctgagcagacacctgggcggcccctgccaggtggacgcccactgcagcgccggccacagctgcatcttcaccgtgagcggcaccagcagctgctgccccttccccgaggccgtggcctgcggcgacggccaccactgctgccccagaggcttccactgcagcgccgacggcagaagctgcttccagagaagcggcaacaacagcgtgggcgccatccagtgccccgacagccagttcgagtgccccgacttcagcacctgctgcgtgatggtggacggcagctggggctgctgccccatgccccaggccagctgctgcgaggacagagtgcactgctgcccccacggcgccttctgcgacctggtgcacaccagatgcatcacccccaccggcacccaccccctggccaagaagctgcccgcccagagaaccaacagagccgtggccctgagcagcagcgtgatgtgccccgacgccagaagcagatgccccgacggcagcacctgctgcgagctgcccagcggcaagtacggctgctgccccatgcccaacgccacctgctgcagcgaccacctgcactgctgcccccaggacaccgtgtgcgacctgatccagagcaagtgcctgagcaaggagaacgccaccaccgacctgctgaccaagctgcccgcccacaccgtgggcgacgtgaagtgcgacatggaggtgagctgccccgacggctacacctgctgcagactgcagagcggcgcctggggctgctgccccttcacccaggccgtgtgctgcgaggaccacatccactgctgccccgccggcttcacctgcgacacccagaagggcacctgcgagcagggcccccaccaggtgccctggatggagaaggcccccgcccacctgagcctgcccgacccccaggccctgaagagagacgtgccctgcgacaacgtgagcagctgccccagcagcgacacctgctgccagctgaccagcggcgagtggggctgctgccccatccccgaggccgtgtgctgcagcgaccaccagcactgctgcccccagggctacacctgcgtggccgagggccagtgccagagaggcagcgagatcgtggccggcctggagaagatgcccgccagaagagccagcctgagccaccccagagacatcggctgcgaccagcacaccagctgccccgtgggccagacctgctgccccagcctgggcggcagctgggcctgctgccagctgccccacgccgtgtgctgcgaggacagacagcactgctgccccgccggctacacctgcaacgtgaaggccagaagctgcgagaaggaggtggtgagcgcccagcccgccaccttcctggccagaagcccccacgtgggcgtgaaggacgtggagtgcggcgagggccacttctgccacgacaaccagacctgctgcagagacaacagacagggctgggcctgctgcccctacagacagggcgtgtgctgcgccgacagaagacactgctgccccgccggcttcagatgcgccgccagaggcaccaagtgcctgagaagagaggcccccagatgggacgcccccctgagagaccccgccctgagacagctgctgtag

SEQ ID NO: 83599 - DNA, 1317 bp, Artificial Sequence
  Description of Artificial Sequence: Synthetic coding sequence
atgtggaccctggtgagctgggtggccctgaccgccggcctggtggccggcaccagatgccccgacggccagttctgccccgtggcctgctgcctggaccccggcggcgccagctacagctgctgcagacccctgctggacaagtggcccaccaccctgagcagacacctgggcggcccctgccaggtggacgcccactgcagcgccggccacagctgcatcttcaccgtgagcggcaccagcagctgctgccccttccccgaggccgtggcctgcggcgacggccaccactgctgccccagaggcttccactgcagcgccgacggcagaagctgcttccagagaagcggcaacaacagcgtgggcgccatccagtgccccgacagccagttcgagtgccccgacttcagcacctgctgcgtgatggtggacggcagctggggctgctgccccatgccccaggccagctgctgcgaggacagagtgcactgctgcccccacggcgccttctgcgacctggtgcacaccagatgcatcacccccaccggcacccaccccctggccaagaagctgcccgcccagagaaccaacagagccgtggccctgagcagcagcgtgatgtgccccgacgccagaagcagatgccccgacggcagcacctgctgcgagctgcccagcggcaagtacggctgctgccccatgcccaacgccacctgctgcagcgaccacctgcactgctgcccccaggacaccgtgtgcgacctgatccagagcaagtgcctgagcaaggagaacgccaccaccgacctgctgaccaagctgcccgcccacaccgtgggcgacgtgaagtgcgacatggaggtgagctgccccgacggctacacctgctgcagactgcagagcggcgcctggggctgctgccccttcacccaggccgtgtgctgcgaggaccacatccactgctgccccgccggcttcacctgcgacacccagaagggcacctgcgagcagggcccccaccaggtgccctggatggagaaggcccccgcccacctgagcctgcccgacccccaggccctgaagagagacgtgccctgcgacaacgtgagcagctgccccagcagcgacacctgctgcagagacaacagacagggctgggcctgctgcccctacagacagggcgtgtgctgcgccgacagaagacactgctgccccgccggcttcagatgcgccgccagaggcaccaagtgcctgagaagagaggcccccagatgggacgcccccctgagagaccccgccctgagacagctgctgtag

SEQ ID NO: 83600 - DNA, 1242 bp, Artificial Sequence
  Description of Artificial Sequence: Synthetic coding sequence
atggccatcaccgccgcccacggcgccagcaccgccgtgcagaccggcgaccccgccagcaaggaccaggtgaccaccccctgggtgcccagcagcgccctgatcgtgagcagcaacgccagaaccagccccagagccgtgctgtggagcatggcccccggcggcgccgccccctgccccagactgcccgccgtgaagaccggctgcaccgccgtgtgcgacctgatccagagcaagtgcctgagcaaggagaacgccaccaccgacctgctgaccaagctgcccgcccacaccgtgggcgacgtgaagtgcgacatggaggtgagctgccccgacggctacacctgctgcagactgcagagcggcgcctggggctgctgccccttcacccaggccgtgtgctgcgaggaccacatccactgctgccccgccggcttcacctgcgacacccagaagggcacctgcgagcagggcccccaccaggtgccctggatggagaaggcccccgcccacctgagcctgcccgacccccaggccctgaagagagacgtgccctgcgacaacgtgagcagctgccccagcagcgacacctgctgccagctgaccagcggcgagtggggctgctgccccatccccgaggccgtgtgctgcagcgaccaccagcactgctgcccccagggctacacctgcgtggccgagggccagtgccagagaggcagcgagatcgtggccggcctggagaagatgcccgccagaagagccagcctgagccaccccagagacatcggctgcgaccagcacaccagctgccccgtgggccagacctgctgccccagcctgggcggcagctgggcctgctgccagctgccccacgccgtgtgctgcgaggacagacagcactgctgccccgccggctacacctgcaacgtgaaggccagaagctgcgagaaggaggtggtgagcgcccagcccgccaccttcctggccagaagcccccacgtgggcgtgaaggacgtggagtgcggcgagggccacttctgccacgacaaccagacctgctgcagagacaacagacagggctgggcctgctgcccctacagacagggcgtgtgctgcgccgacagaagacactgctgccccgccggcttcagatgcgccgccagaggcaccaagtgcctgagaagagaggcccccagatgggacgcccccctgagagaccccgccctgagacagctgctgtag

SEQ ID NO: 83601 - DNA, 789 bp, Artificial Sequence
  Description of Artificial Sequence: Synthetic coding sequence
atgagaaacagctacagattcctggccagcagcctgagcgtggtggtgagcctgctgctgatccccgaggacgtgtgcgagaagatcatcggcggcaacgaggtgaccccccacagcagaccctacatggtgctgctgagcctggacagaaagaccatctgcgccggcgccctgatcgccaaggactgggtgctgaccgccgcccactgcaacctgaacaagagaagccaggtgatcctgggcgcccacagcatcaccagagaggagcccaccaagcagatcatgctggtgaagaaggagttcccctacccctgctacgaccccgccaccagagagggcgacctgaagctgctgcagctgatggagaaggccaagatcaacaagtacgtgaccatcctgcacctgcccaagaagggcgacgacgtgaagcccggcaccatgtgccaggtggccggctggggcagaacccacaacagcgccagctggagcgacaccctgagagaggtgaacatcaccatcatcgacagaaaggtgtgcaacgacagaaaccactacaacttcaaccccgtgatcggcatgaacatggtgtgcgccggcagcctgagaggcggcagagacagctgcaacggcgacagcggcagccccctgctgtgcgagggcgtgttcagaggcgtgaccagcttcggcctggagaacaagtgcggcgaccccagaggccccggcgtgtacatcctgctgagcaagaagcacctgaactggatcatcatgaccatcaagggcgccgtgtag

SEQ ID NO: 83602 - DNA, 741 bp, Artificial Sequence
  Description of Artificial Sequence: Synthetic coding sequence
atgcagcccttcctgctgctgctggccttcctgctgacccccggcgccggcaccgaggagatcatcggcggccacgaggccaagccccacagcagaccctacatggccttcgtgcagttcctgcaggagaagagcagaaagagatgcggcggcatcctggtgagaaaggacttcgtgctgaccgccgcccactgccagggcagcagcatcaacgtgaccctgggcgcccacaacatcaaggagcaggagagaacccagcagttcatccccgtgaagagacccatcccccaccccgcctacaaccccaagaacttcagcaacgacatcatgctgctgcagctggagagaaaggccaagtggaccaccgccgtgagacccctgagactgcccagcagcaaggcccaggtgaagcccggccagctgtgcagcgtggccggctggggctacgtgagcatgagcaccctggccaccaccctgcaggaggtgctgctgaccgtgcagaaggactgccagtgcgagagactgttccacggcaactacagcagagccaccgagatctgcgtgggcgaccccaagaagacccagaccggcttcaagggcgacagcggcggccccctggtgtgcaaggacgtggcccagggcatcctgagctacggcaacaagaagggcaccccccccggcgtgtacatcaaggtgagccacttcctgccctggatcaagagaaccatgaagagactgtag

SEQ ID NO: 83603 - DNA, 459 bp, Artificial Sequence
  Description of Artificial Sequence: Synthetic coding sequence
atgcagcccatcctgctgctgctggccttcctgctgctgcccagagccgaccagctggagagaaaggccaagagaaccagagccgtgcagcccctgagactgcccagcaacaaggcccaggtgaagcccggccagacctgcagcgtggccggctggggccagaccgcccccctgggcaagcacagccacaccctgcaggaggtgaagatgaccgtgcaggaggacagaaagtgcgagagcgacctgagacactactacgacagcaccatcgagctgtgcgtgggcgaccccgagatcaagaagaccagcttcaagggcgacagcggcggccccctggtgtgcaacaaggtggcccagggcatcgtgagctacggcagaaacaacggcatgccccccagagcctgcaccaaggtgagcagcttcgtgcactggatcaagaagaccatgaagagatactag

SEQ ID NO: 83604 - DNA, 609 bp, Artificial Sequence
  Description of Artificial Sequence: Synthetic coding sequence
atgcagcccatcctgctgctgctggccttcctgctgctgcccagagccgacgccggcgagatcatcggcggccacgaggccaagccccacagcagaccctacatggcctacctgatgatctgggaccagaagagcctgaagagatgcggcggcttcctgatcagagacgacttcgtgctgaccgccgcccactgctggggcagactggagagaaaggccaagagaaccagagccgtgcagcccctgagactgcccagcaacaaggcccaggtgaagcccggccagacctgcagcgtggccggctggggccagaccgcccccctgggcaagcacagccacaccctgcaggaggtgaagatgaccgtgcaggaggacagaaagtgcgagagcgacctgagacactactacgacagcaccatcgagctgtgcgtgggcgaccccgagatcaagaagaccagcttcaagggcgacagcggcggccccctggtgtgcaacaaggtggcccagggcatcgtgagctacggcagaaacaacggcatgccccccagagcctgcaccaaggtgagcagcttcgtgcactggatcaagaagaccatgaagagatactag

SEQ ID NO: 83605 - DNA, 846 bp, Artificial Sequence
  Description of Artificial Sequence: Synthetic coding sequence
atgaagagcctgagcctgctgcacctgttccccctgcccagagccaagagagagcagggcggcaacaacagcagcagcaaccagggcagcctgcccgagaagatgcagcccatcctgctgctgctggccttcctgctgctgcccagagccgacgccggcgagatcatcggcggccacgaggccaagccccacagcagaccctacatggcctacctgatgatctgggaccagaagagcctgaagagatgcggcggcttcctgatcagagacgacttcgtgctgaccgccgcccactgctggggcagcagcatcaacgtgaccctgggcgcccacaacatcaaggagcaggagcccacccagcagttcatccccgtgaagagacccatcccccaccccgcctacaaccccaagaacttcagcaacgacatcatgctgctgcagctggagagaaaggccaagagaaccagagccgtgcagcccctgagactgcccagcaacaaggcccaggtgaagcccggccagacctgcagcgtggccggctggggccagaccgcccccctgggcaagcacagccacaccctgcaggaggtgaagatgaccgtgcaggaggacagaaagtgcgagagcgacctgagacactactacgacagcaccatcgagctgtgcgtgggcgaccccgagatcaagaagaccagcttcaagggcgacagcggcggccccctggtgtgcaacaaggtggcccagggcatcgtgagctacggcagaaacaacggcatgccccccagagcctgcaccaaggtgagcagcttcgtgcactggatcaagaagaccatgaagagatactag

SEQ ID NO: 83606 - DNA, 708 bp, Artificial Sequence
  Description of Artificial Sequence: Synthetic coding sequence
atgcagaccttccccagcggcgagatcatcggcggccacgaggccaagccccacagcagaccctacatggcctacctgatgatctgggaccagaagagcctgaagagatgcggcggcttcctgatcagagacgacttcgtgctgaccgccgcccactgctggggcagcagcatcaacgtgaccctgggcgcccacaacatcaaggagcaggagcccacccagcagttcatccccgtgaagagacccatcccccaccccgcctacaaccccaagaacttcagcaacgacatcatgctgctgcagctggagagaaaggccaagagaaccagagccgtgcagcccctgagactgcccagcaacaaggcccaggtgaagcccggccagacctgcagcgtggccggctggggccagaccgcccccctgggcaagcacagccacaccctgcaggaggtgaagatgaccgtgcaggaggacagaaagtgcgagagcgacctgagacactactacgacagcaccatcgagctgtgcgtgggcgaccccgagatcaagaagaccagcttcaagggcgacagcggcggccccctggtgtgcaacaaggtggcccagggcatcgtgagctacggcagaaacaacggcatgccccccagagcctgcaccaaggtgagcagcttcgtgcactggatcaagaagaccatgaagagatactag

SEQ ID NO: 83607 - DNA, 483 bp, Artificial Sequence
  Description of Artificial Sequence: Synthetic coding sequence
atgcagcccttcctgctgctgctggccttcctgctgacccccggcgccggcaccgaggagatcatcggcggccacgaggccaagccccacagcagaccctacatggccttcgtgcagttcctgcaggagaagagcagaaagagatgcggcggcatcctggtgagaaaggacttcgtgctgaccgccgcccactgccagggcagcagcatcaacgtgaccctgggcgcccacaacatcaaggagcaggagagaacccagcagttcatccccgtgaagagacccatcccccaccccgcctacaaccccaagaacttcagcaacgacatcatgctgctgcagggcgacagcggcggccccctggtgtgcaaggacgtggcccagggcatcctgagctacggcaacaagaagggcaccccccccggcgtgtacatcaaggtgagccacttcctgccctggatcaagagaaccatgaagagactgtag

SEQ ID NO: 83608 - DNA, 768 bp, Artificial Sequence
  Description of Artificial Sequence: Synthetic coding sequence
atgcagcccctgctgctgctgctggccttcctgctgcccaccggcgccgaggccggcgagatcatcggcggcagagagagcagaccccacagcagaccctacatggcctacctgcagatccagagccccgccggccagagcagatgcggcggcttcctggtgagagaggacttcgtgctgaccgccgcccactgctggggcagcaacatcaacgtgaccctgggcgcccacaacatccagagaagagagaacacccagcagcacatcaccgccagaagagccatcagacacccccagtacaaccagagaaccatccagaacgacatcatgctgctgcagctgagcagaagagtgagaagaaacagaaacgtgaaccccgtggccctgcccagagcccaggagggcctgagacccggcaccctgtgcaccgtggccggctggggcagagtgagcatgagaagaggcaccgacaccctgagagaggtgcagctgagagtgcagagagacagacagtgcctgagaatcttcggcagctacgaccccagaagacagatctgcgtgggcgacagaagagagagaaaggccgccttcaagggcgacagcggcggccccctgctgtgcaacaacgtggcccacggcatcgtgagctacggcaagagcagcggcgtgccccccgaggtgttcaccagagtgagcagcttcctgccctggatcagaaccaccatgagaagcttcaagctgctggaccagatggagacccccctgtag

SEQ ID NO: 83609 - DNA, 348 bp, Artificial Sequence
  Description of Artificial Sequence: Synthetic coding sequence
atgcagcccttcctgctgctgctggccttcctgctgacccccggcgccggcaccgaggagatcatcggcggccacgaggccaagccccacagcagaccctacatggccttcgtgcagttcctgcaggagaagagcagaaagagatgcggcggcatcctggtgagaaaggacttcgtgctgaccgccgcccactgccagggcagaggcgacagcggcggccccctggtgtgcaaggacgtggcccagggcatcctgagctacggcaacaagaagggcaccccccccggcgtgtacatcaaggtgagccacttcctgccctggatcaagagaaccatgaagagactgtag

SEQ ID NO: 83610 - DNA, 774 bp, Artificial Sequence
  Description of Artificial Sequence: Synthetic coding sequence
atggaggcctgcgtgagcagcctgctggtgctggccctgggcgccctgagcgtgggcagcagcttcggcacccagatcatcggcggcagagaggtgatcccccacagcagaccctacatggccagcctgcagagaaacggcagccacctgtgcggcggcgtgctggtgcaccccaagtgggtgctgaccgccgcccactgcctggcccagagaatggcccagctgagactggtgctgggcctgcacaccctggacagccccggcctgaccttccacatcaaggccgccatccagcaccccagatacaagcccgtgcccgccctggagaacgacctggccctgctgcagctggacggcaaggtgaagcccagcagaaccatcagacccctggccctgcccagcaagagacaggtggtggccgccggcaccagatgcagcatggccggctggggcctgacccaccagggcggcagactgagcagagtgctgagagagctggacctgcaggtgctggacaccagaatgtgcaacaacagcagattctggaacggcagcctgagccccagcatggtgtgcctggccgccgacagcaaggaccaggccccctgcaagggcgacagcggcggccccctggtgtgcggcaagggcagagtgctggccagagtgctgagcttcagcagcagagtgtgcaccgacatcttcaagccccccgtggccaccgccgtggccccctacgtgagctggatcagaaaggtgaccggcagaagcgcctag

SEQ ID NO: 83611 - DNA, 3108 bp, Artificial Sequence
  Description of Artificial Sequence: Synthetic coding sequence
atggccgccgagaccctgaacttcggccccgagtggctgagagccctgagcggcggcggcagcgtggccagccccccccccagccccgccatgcccaagtacaagctggccgactacagatacggcagagaggagatgctggccctgtacgtgaaggagaacaaggtgcccgaggagctgcaggacaaggagttcgccgccgtgctgcaggacgagcccctgcagcccctggccctggagcccctgaccgaggaggagcagagaaacttcagcctgagcgtgaacagcgtggccgtgctgagactgatgggcaagggcgccggcccccccctggccggcaccagcagaggcagaggcagcaccagaagcagaggcagaggcagaggcgacagctgcttctaccagagaagcatcgaggagggcgacggcgccttcggcagaagccccagagagatccagagaagccagagctgggacgacagaggcgagagaagattcgagaagagcgccagaagagacggcgccagatgcggcttcgaggagggcggcgccggccccagaaaggagcacgccagaagcgacagcgagaactggagaagcctgagagaggagcaggaggaggaggaggagggcagctggagactgggcgccggccccagaagagacggcgacagatggagaagcgccagccccgacggcggccccagaagcgccggctggagagagcacggcgagagaagaagaaagttcgagttcgacctgagaggcgacagaggcggctgcggcgaggaggagggcagaggcggcggcggcagcagccacctgagaagatgcagagcccccgagggcttcgaggaggacaaggacggcctgcccgagtggtgcctggacgacgaggacgaggagatgggcaccttcgacgccagcggcgccttcctgcccctgaagaagggccccaaggagcccatccccgaggagcaggagctggacttccagggcctggaggaggaggaggagcccagcgagggcctggaggaggagggccccgaggccggcggcaaggagctgacccccctgcccccccaggaggagaagagcagcagccccagccccctgcccaccctgggccccctgtggggcaccaacggcgacggcgacgagaccgccgagaaggagccccccgccgccgaggacgacatcagaggcatccagctgagccccggcgtgggcagcagcgccggcccccccggcgacctggaggacgacgagggcctgaagcacctgcagcaggaggccgagaagctggtggccagcctgcaggacagcagcctggaggaggagcagttcaccgccgccatgcagacccagggcctgagacacagcgccgccgccaccgccctgcccctgagccacggcgccgccagaaagtggttctacaaggacccccagggcgagatccagggccccttcaccacccaggagatggccgagtggttccaggccggctacttcagcatgagcctgctggtgaagagaggctgcgacgagggcttccagcccctgggcgaggtgatcaagatgtggggcagagtgcccttcgcccccggccccagccccccccccctgctgggcaacatggaccaggagagactgaagaagcagcaggagctggccgccgccgccctgtaccagcagctgcagcaccagcagttcctgcagctggtgagcagcagacagctgccccagtgcgccctgagagagaaggccgccctgggcgacctgaccccccccccccccccccccccccagcagcagcagcagcagctgaccgccttcctgcagcagctgcaggccctgaagccccccagaggcggcgaccagaacctgctgcccaccatgagcagaagcctgagcgtgcccgacagcggcagactgtgggacgtgcacaccagcgccagcagccagagcggcggcgaggccagcctgtgggacatccccatcaacagcagcacccagggccccatcctggagcagctgcagctgcagcacaagttccaggagagaagagaggtggagctgagagccaagagagaggaggaggagagaaagagaagagaggagaagagaagacagcagcagcaggaggagcagaagagaagacaggaggaggaggagctgttcagaagaaagcacgtgagacagcaggagctgctgctgaagctgctgcagcagcagcaggccgtgcccgtgccccccgcccccagcagccccccccccctgtgggccggcctggccaagcagggcctgagcatgaagaccctgctggagctgcagctggagggcgagagacagctgcacaagcagcccccccccagagagcccgccagagcccaggcccccaaccacagagtgcagctgggcggcctgggcaccgcccccctgaaccagtgggtgagcgaggccggccccctgtggggcggccccgacaagagcggcggcggcagcagcggcctgggcctgtgggaggacacccccaagagcggcggcagcctggtgagaggcctgggcctgaagaacagcagaagcagccccagcctgagcgacagctacagccacctgagcggcagacccatcagaaagaagaccgaggaggaggagaagctgctgaagctgctgcagggcatccccagaccccaggacggcttcacccagtggtgcgagcagatgctgcacaccctgagcgccaccggcagcctggacgtgcccatggccgtggccatcctgaaggaggtggagagcccctacgacgtgcacgactacatcagaagctgcctgggcgacaccctggaggccaaggagttcgccaagcagttcctggagagaagagccaagcagaaggccagccagcagagacagcagcagcaggaggcctggctgagcagcgccagcctgcagaccgccttccaggccaaccacagcaccaagctgggccccggcgagggcagcaaggccaagagaagagccctgatgctgcacagcgaccccagcatcctgggctacagcctgcacggcagcagcggcgagatcgagagcgtggacgactactag

SEQ ID NO: 83612 - DNA, 2265 bp, Artificial Sequence
  Description of Artificial Sequence: Synthetic coding sequence
agcagcttccccagccccagactgccccaggtgttccacagactggacgacgaggacgaggagatgggcaccttcgacgccagcggcgccttcctgcccctgaagaagggccccaaggagcccatccccgaggagcaggagctggacttccagggcctggaggaggaggaggagcccagcgagggcctggaggaggagggccccgaggccggcggcaaggagctgacccccctgcccccccaggaggagaagagcagcagccccagccccctgcccaccctgggccccctgtggggcaccaacggcgacggcgacgagaccgccgagaaggagccccccgccgccgaggacgacatcagaggcatccagctgagccccggcgtgggcagcagcgccggcccccccggcgacctggaggacgacgagggcctgaagcacctgcagcaggaggccgagaagctggtggccagcctgcaggacagcagcctggaggaggagcagttcaccgccgccatgcagacccagggcctgagacacagcgccgccgccaccgccctgcccctgagccacggcgccgccagaaagtggttctacaaggacccccagggcgagatccagggccccttcaccacccaggagatggccgagtggttccaggccggctacttcagcatgagcctgctggtgaagagaggctgcgacgagggcttccagcccctgggcgaggtgatcaagatgtggggcagagtgcccttcgcccccggccccagccccccccccctgctgggcaacatggaccaggagagactgaagaagcagcaggagctggccgccgccgccctgtaccagcagctgcagcaccagcagttcctgcagctggtgagcagcagacagctgccccagtgcgccctgagagagaaggccgccctgggcgacctgaccccccccccccccccccccccccagcagcagcagcagcagctgaccgccttcctgcagcagctgcaggccctgaagccccccagaggcggcgaccagaacctgctgcccaccatgagcagaagcctgagcgtgcccgacagcggcagactgtgggacgtgcacaccagcgccagcagccagagcggcggcgaggccagcctgtgggacatccccatcaacagcagcacccagggccccatcctggagcagctgcagctgcagcacaagttccaggagagaagagaggtggagctgagagccaagagagaggaggaggagagaaagagaagagaggagaagagaagacagcagcagcaggaggagcagaagagaagacaggaggaggaggagctgttcagaagaaagcacgtgagacagcaggagctgctgctgaagctgctgcagcagcagcaggccgtgcccgtgccccccgcccccagcagccccccccccctgtgggccggcctggccaagcagggcctgagcatgaagaccctgctggagctgcagctggagggcgagagacagctgcacaagcagcccccccccagagagcccgccagagcccaggcccccaaccacagagtgcagctgggcggcctgggcaccgcccccctgaaccagtgggtgagcgaggccggccccctgtggggcggccccgacaagagcggcggcggcagcagcggcctgggcctgtgggaggacacccccaagagcggcggcagcctggtgagaggcctgggcctgaagaacagcagaagcagccccagcctgagcgacagctacagccacctgagcggcagacccatcagaaagaagaccgaggaggaggagaagctgctgaagctgctgcagggcatccccagaccccaggacggcttcacccagtggtgcgagcagatgctgcacaccctgagcgccaccggcagcctggacgtgcccatggccgtggccatcctgaaggaggtggagagcccctacgacgtgcacgactacatcagaagctgcctgggcgacaccctggaggccaaggagttcgccaagcagttcctggagagaagagccaagcagaaggccagccagcagagacagcagcagcaggaggcctggctgagcagcgccagcctgcagaccgccttccaggccaaccacagcaccaagctgggccccggcgagggcagcaaggccaagagaagagccctgatgctgcacagcgaccccagcatcctgggctacagcctgcacggcagcagcggcgagatcgagagcgtggacgactactag

SEQ ID NO: 83613 - DNA, 3900 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagaggcagaggcgagtgcggcttctaccagagaagcttcgacgaggtggagggcgtgttcggcagaggcggcggcagagagatgcacagaagccagagctgggaggagagaggcgacagaagattcgagaagcccggcagaaaggacgtgggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccgacggccccagaagcgccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggaggaggagctggccagaagaaagcaggaggaggccctgagaagacagagagagcaggagatcgccctgagaagacagagagaggaggaggagagacagcagcaggaggaggccctgagaagactggaggagagaagaagagaggaggaggagagaagaaagcaggaggagctgctgagaaagcaggaggaggaggccgccaagtgggccagagaggaggaggaggcccagagaagactggaggagaacagactgagaatggaggaggaggccgccagactgagacacgaggaggaggagagaaagagaaaggagctggaggtgcagagacagaaggagctgatgagacagagacagcagcagcaggaggccctgagaagactgcagcagcagcagcagcagcagcagctggcccagatgaagctgcccagcagcagcacctggggccagcagagcaacaccaccgcctgccagagccaggccaccctgagcctggccgagatccagaagctggaggaggagagagagagacagctgagagaggagcagagaagacagcagagagagctgatgaaggccctgcagcagcagcagcagcagcagcagcagaagctgagcggctggggcaacgtgagcaagcccagcggcaccaccaagagcctgctggagatccagcaggaggaggccagacagatgcagaagcagcagcagcagcagcagcagcaccagcagcccaacagagccagaaacaacacccacagcaacctgcacaccagcatcggcaacagcgtgtggggcagcatcaacaccggcccccccaaccagtgggccagcgacctggtgagcagcatctggagcaacgccgacaccaagaacagcaacatgggcttctgggacgacgccgtgaaggaggtgggccccagaaacagcaccaacaagaacaagaacaacgccagcctgagcaagagcgtgggcgtgagcaacagacagaacaagaaggtggaggaggaggagaagctgctgaagctgttccagggcgtgaacaaggcccaggacggcttcacccagtggtgcgagcagatgctgcacgccctgaacaccgccaacaacctggacgtgcccaccttcgtgagcttcctgaaggaggtggagagcccctacgaggtgcacgactacatcagagcctacctgggcgacaccagcgaggccaaggagttcgccaagcagttcctggagagaagagccaagcagaaggccaaccagcagagacagcagcagcagctgccccagcagcagcagcagcagcccccccagcagcccccccagcagccccagcagcaggacagcgtgtggggcatgaaccacagcaccctgcacagcgtgttccagaccaaccagagcaacaaccagcagagcaacttcgaggccgtgcagagcggcaagaagaagaagaagcagaagatggtgagagccgaccccagcctgctgggcttcagcgtgaacgccagcagcgagagactgaacatgggcgagatcgagaccctggacgactactag

SEQ ID NO: 83614 - DNA, 3966 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagaggcagaggcgagtgcggcttctaccagagaagcttcgacgaggtggagggcgtgttcggcagaggcggcggcagagagatgcacagaagccagagctgggaggagagaggcgacagaagattcgagaagcccggcagaaaggacgtgggcaagaagaacggctactactgcatgtacagccccgtgctgctgctgggccagcccctgtgccagggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccgacggccccagaagcgccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggaggaggagctggccagaagaaagcaggaggaggccctgagaagacagagagagcaggagatcgccctgagaagacagagagaggaggaggagagacagcagcaggaggaggccctgagaagactggaggagagaagaagagaggaggaggagagaagaaagcaggaggagctgctgagaaagcaggaggaggaggccgccaagtgggccagagaggaggaggaggcccagagaagactggaggagaacagactgagaatggaggaggaggccgccagactgagacacgaggaggaggagagaaagagaaaggagctggaggtgcagagacagaaggagctgatgagacagagacagcagcagcaggaggccctgagaagactgcagcagcagcagcagcagcagcagctggcccagatgaagctgcccagcagcagcacctggggccagcagagcaacaccaccgcctgccagagccaggccaccctgagcctggccgagatccagaagctggaggaggagagagagagacagctgagagaggagcagagaagacagcagagagagctgatgaaggccctgcagcagcagcagcagcagcagcagcagaagctgagcggctggggcaacgtgagcaagcccagcggcaccaccaagagcctgctggagatccagcaggaggaggccagacagatgcagaagcagcagcagcagcagcagcagcaccagcagcccaacagagccagaaacaacacccacagcaacctgcacaccagcatcggcaacagcgtgtggggcagcatcaacaccggcccccccaaccagtgggccagcgacctggtgagcagcatctggagcaacgccgacaccaagaacagcaacatgggcttctgggacgacgccgtgaaggaggtgggccccagaaacagcaccaacaagaacaagaacaacgccagcctgagcaagagcgtgggcgtgagcaacagacagaacaagaaggtggaggaggaggagaagctgctgaagctgttccagggcgtgaacaaggcccaggacggcttcacccagtggtgcgagcagatgctgcacgccctgaacaccgccaacaacctggacgtgcccaccttcgtgagcttcctgaaggaggtggagagcccctacgaggtgcacgactacatcagagcctacctgggcgacaccagcgaggccaaggagttcgccaagcagttcctggagagaagagccaagcagaaggccaaccagcagagacagcagcagcagctgccccagcagcagcagcagcagcccccccagcagcccccccagcagccccagcagcaggacagcgtgtggggcatgaaccacagcaccctgcacagcgtgttccagaccaaccagagcaacaaccagcagagcaacttcgaggccgtgcagagcggcaagaagaagaagaagcagaagatggtgagagccgaccccagcctgctgggcttcagcgtgaacgccagcagcgagagactgaacatgggcgagatcgagaccctggacgactactag

SEQ ID NO: 83615 - DNA, 3966 bp, Artificial Sequence; identical to SEQ ID NO: 83614
  Description of Artificial Sequence: Synthetic coding sequence

SEQ ID NO: 83616 - DNA, 3900 bp, Artificial Sequence; identical to SEQ ID NO: 83613
  Description of Artificial Sequence: Synthetic coding sequence

SEQ ID NO: 83617 - DNA, 2163 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagatag

SEQ ID NO: 83618 - DNA, 282 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagctag

SEQ ID NO: 83619 - DNA, 303 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgcctag

SEQ ID NO: 83620 - DNA, 42 bp, Artificial Sequence
  Description of Artificial Sequence: Synthetic coding sequence
atggccgccgagacccagaccctgaacttcggccccgagtag

SEQ ID NO: 83621 - DNA, 348 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggctag

SEQ ID NO: 83622 - DNA, 321 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggctag

SEQ ID NO: 83623 - DNA, 342 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtgtag

SEQ ID NO: 83624 - DNA, 2619 bp, Artificial Sequence
  Description of Artificial Sequence: Synthetic coding sequence
atgaccaagctgcccgacgaccccggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccgacggccccagaagcgccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggaggaggagctggccagaagaaagcaggaggaggccctgagaagacagagagagcaggagatcgccctgagaagacagagagaggaggaggagagacagcagcaggaggaggccctgagaagactggaggagagaagaagagaggaggaggagagaagaaagcaggaggagctgctgagaaagcaggaggaggaggccgccaagtgggccagagaggaggaggaggcccagagaagactggaggagaacagactgagaatggaggaggaggccgccagactgagacacgaggaggaggagagaaagagaaaggagctggaggtgcagagacagaaggagctgatgagacagagacagcagcagcaggaggccctgagaagactgcagcagcagcagcagcagcagcagctggcccagatgaagctgcccagcagcagcacctggggccagcagagcaacaccaccgcctgccagagccaggccaccctgagcctggccgagatccagaagctggaggaggagagagagagacagctgagagaggaggagagcagcgccagcttctgcttctacgccaccgccaaggcccccgccgagggcgtggacgagagcagcagcgccgccgccgccaccgccaccgccgagaccctgagactgggcgagtgccagcagaccttcagataccacgagatcagcagcggcgaccccgccggcagaggccaggccaacgccaaggccgccgccgccgccgccgccacccccgccaccaagcagagcagctag

SEQ ID NO: 83625 - DNA, 2364 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagaggcagaggcgagtgcggcttctaccagagaagcttcgacgaggtggagggcgtgttcggcagaggcggcggcagagagatgcacagaagccagagctgggaggagagaggcgacagaagattcgagaagcccggcagaaaggacgtgggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccgacggccccagaagcgccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggtgggcaagagagacagctag

SEQ ID NO: 83626 - DNA, 3882 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagaggcagaggcgagtgcggcttctaccagagaagcttcgacgaggtggagggcgtgttcggcagaggcggcggcagagagatgcacagaagccagagctgggaggagagaggcgacagaagattcgagaagcccggcagaaaggacgtgggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggaggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggaggaggagctggccagaagaaagcaggaggaggccctgagaagacagagagagcaggagatcgccctgagaagacagagagaggaggaggagagacagcagcaggaggaggccctgagaagactggaggagagaagaagagaggaggaggagagaagaaagcaggaggagctgctgagaaagcaggaggaggaggccgccaagtgggccagagaggaggaggaggcccagagaagactggaggagaacagactgagaatggaggaggaggccgccagactgagacacgaggaggaggagagaaagagaaaggagctggaggtgcagagacagaaggagctgatgagacagagacagcagcagcaggaggccctgagaagactgcagcagcagcagcagcagcagcagctggcccagatgaagctgcccagcagcagcacctggggccagcagagcaacaccaccgcctgccagagccaggccaccctgagcctggccgagatccagaagctggaggaggagagagagagacagctgagagaggagcagagaagacagcagagagagctgatgaaggccctgcagcagcagcagcagcagcagcagcagaagctgagcggctggggcaacgtgagcaagcccagcggcaccaccaagagcctgctggagatccagcaggaggaggccagacagatgcagaagcagcagcagcagcagcagcagcaccagcagcccaacagagccagaaacaacacccacagcaacctgcacaccagcatcggcaacagcgtgtggggcagcatcaacaccggcccccccaaccagtgggccagcgacctggtgagcagcatctggagcaacgccgacaccaagaacagcaacatgggcttctgggacgacgccgtgaaggaggtgggccccagaaacagcaccaacaagaacaagaacaacgccagcctgagcaagagcgtgggcgtgagcaacagacagaacaagaaggtggaggaggaggagaagctgctgaagctgttccagggcgtgaacaaggcccaggacggcttcacccagtggtgcgagcagatgctgcacgccctgaacaccgccaacaacctggacgtgcccaccttcgtgagcttcctgaaggaggtggagagcccctacgaggtgcacgactacatcagagcctacctgggcgacaccagcgaggccaaggagttcgccaagcagttcctggagagaagagccaagcagaaggccaaccagcagagacagcagcagcagctgccccagcagcagcagcagcagcccccccagcagcccccccagcagccccagcagcaggacagcgtgtggggcatgaaccacagcaccctgcacagcgtgttccagaccaaccagagcaacaaccagcagagcaacttcgaggccgtgcagagcggcaagaagaagaagaagcagaagatggtgagagccgaccccagcctgctgggcttcagcgtgaacgccagcagcgagagactgaacatgggcgagatcgagaccctggacgactactag

SEQ ID NO: 83627 - DNA, 3963 bp, Artificial Sequence
  Description of Artificial Sequence: Synthetic coding sequence
atggccgccgagacccagaccctgaacttcggccccgagtggctgagagccctgagcagcggcggcagcatcaccagcccccccctgagccccgccctgcccaagtacaagctggccgactacagatacggcagagaggagatgctggccctgttcctgaaggacaacaagatccccagcgacctgctggacaaggagttcctgcccatcctgcaggaggagcccctgccccccctggccctggtgcccttcaccgaggaggagcagagaaacttcagcatgagcgtgaacagcgccgccgtgctgagactgaccggcagaggcggcggcggcaccgtggtgggcgcccccagaggcagaagcagcagcagaggcagaggcagaggcagaggcgagtgcggcttctaccagagaagcttcgacgaggtggagggcgtgttcggcagaggcggcggcagagagatgcacagaagccagagctgggaggagagaggcgacagaagattcgagaagcccggcagaaaggacgtgggcaagaagaacggctactactgcatgtacagccccgtgctgctgctgggccagcccctgtgccagggcagacccaacttcgaggagggcggccccaccagcgtgggcagaaagcacgagttcatcagaagcgagagcgagaactggagaatcttcagagaggagcagaacggcgaggacgaggacggcggctggagactggccggcagcagaagagacggcgagagatggagaccccacagccccgacggccccagaagcgccggctggagagagcacatggagagaagaagaagattcgagttcgacttcagagacagagacgacgagagaggctacagaagagtgagaagcggcagcggcagcatcgacgacgacagagacagcctgcccgagtggtgcctggaggacgccgaggaggagatgggcaccttcgacagcagcggcgccttcctgagcctgaagaaggtgcagaaggagcccatccccgaggagcaggagatggacttcagacccgtggacgagggcgaggagtgcagcgacagcgagggcagccacaacgaggaggccaaggagcccgacaagaccaacaagaaggagggcgagaagaccgacagagtgggcgtggccagcgaggagaccccccagaccagcagcagcagcgccagacccggcacccccagcgaccaccagagccaggaggccagccagttcgagagaaaggacgagcccaagaccgagcagaccgagaaggccgaggaggagaccagaatggagaacagcctgcccgccaaggtgcccagcagaggcgacgagatggtggccgacgtgcagcagcccctgagccagatccccagcgacaccgccagccccctgctgatcctgcccccccccgtgcccaaccccagccccaccctgagacccgtggagacccccgtggtgggcgcccccggcatgggcagcgtgagcaccgagcccgacgacgaggagggcctgaagcacctggagcagcaggccgagaagatggtggcctacctgcaggacagcgccctggacgacgagagactggccagcaagctgcaggagcacagagccaagggcgtgagcatccccctgatgcacgaggccatgcagaagtggtactacaaggacccccagggcgagatccagggccccttcaacaaccaggagatggccgagtggttccaggccggctacttcaccatgagcctgctggtgaagagagcctgcgacgagagcttccagcccctgggcgacatcatgaagatgtggggcagagtgcccttcagccccggccccgccccccccccccacatgggcgagctggaccaggagagactgaccagacagcaggagctgaccgccctgtaccagatgcagcacctgcagtaccagcagttcctgatccagcagcagtacgcccaggtgctggcccagcagcagaaggccgccctgagcagccagcagcagcagcagctggccctgctgctgcagcagttccagaccctgaagatgagaatcagcgaccagaacatcatccccagcgtgaccagaagcgtgagcgtgcccgacaccggcagcatctgggagctgcagcccaccgccagccagcccaccgtgtgggagggcggcagcgtgtgggacctgcccctggacaccaccacccccggccccgccctggagcagctgcagcagctggagaaggccaaggccgccaagctggagcaggagagaagagaggccgagatgagagccaagagagaggaggaggagagaaagagacaggaggagctgagaagacagcaggaggagatcctgagaagacagcaggaggaggagagaaagagaagagaggaggaggagctggccagaagaaagcaggaggaggccctgagaagacagagagagcaggagatcgccctgagaagacagagagaggaggaggagagacagcagcaggaggaggccctgagaagactggaggagagaagaagagaggaggaggagagaagaaagcaggaggagctgctgagaaagcaggaggaggaggccgccaagtgggccagagaggaggaggaggcccagagaagactggaggagaacagactgagaatggaggaggaggccgccagactgagacacgaggaggaggagagaaagagaaaggagctggaggtgcagagacagaaggagctgatgagacagagacagcagcagcaggaggccctgagaagactgcagcagcagcagcagcagcagcagctggcccagatgaagctgcccagcagcagcacctggggccagcagagcaacaccaccgcctgccagagccaggccaccctgagcctggccgagatccagaagctggaggaggagagagagagacagctgagagaggagcagagaagacagcagagagagctgatgaaggccctgcagcagcagcagcagcagcagcagcagaagctgagcggctggggcaacgtgagcaagcccagcggcaccaccaagagcctgctggagatccagcaggaggaggccagacagatgcagaagcagcagcagcagcagcagcagcaccagcagcccaacagagccagaaacaacacccacagcaacctgcacaccagcatcggcaacagcgtgtggggcagcatcaacaccggcccccccaaccagtgggccagcgacctggtgagcagcatctggagcaacgccgacaccaagaacagcaacatgggcttctgggacgacgccgtgaaggaggtgggccccagaaacagcaccaacaagaacaagaacaacgccagcctgagcaagagcgtgggcgtgagcaacagacagaacaagaaggtggaggaggaggagaagctgctgaagctgttccagggcgtgaacaaggcccaggacggcttcacccagtggtgcgagcagatgctgcacgccctgaacaccgccaacaacctggacgtgcccaccttcgtgagcttcctgaaggaggtggagagcccctacgaggtgcacgactacatcagagcctacctgggcgacaccagcgaggccaaggagttcgccaagcagttcctggagagaagagccaagcagaaggccaaccagcagagacagcagcagcagctgccccagcagcagcagcagcagcccccccagcagcccccccagcagccccagcagcaggacagcgtgtggggcatgaaccacagcaccctgcacagcgtgttccagaccaaccagagcaacaaccagcagagcaacttcgaggccgtgcagagcggcaagaagaagaagaagcagaagatggtgagagccgaccccagcctgctgggcttcagcgtgaacgccagcagcgagagactgaacatgggcgagatcgagaccctggacgactactag

SEQ ID NO: 83628 - DNA, 2085 bp, Artificial Sequence
  Description of Artificial Sequence: Synthetic coding sequence
atgagcggcggcgaggtggtgtgcagcggctggctgagaaagagcccccccgagaagaagctgaagagatacgcctggaagagaagatggttcgtgctgagaagcggcagactgaccggcgaccccgacgtgctggagtactacaagaacgaccacgccaagaagcccatcagaatcatcgacctgaacctgtgccagcaggtggacgccggcctgaccttcaacaagaaggagttcgagaacagctacatcttcgacatcaacaccatcgacagaatcttctacctggtggccgacagcgaggaggagatgaacaagtgggtgagatgcatctgcgacatctgcggcttcaaccccaccgaggaggaccccgtgaagccccccggcagcagcctgcaggcccccgccgacctgcccctggccatcaacaccgccccccccagcacccaggccgacagcagcagcgccaccctgccccccccctaccagctgatcaacgtgcccccccacctggagaccctgggcatccaggaggacccccaggactacctgctgctgatcaactgccagagcaagaagcccgagcccaccagaacccacgccgacagcgccaagagcaccagcagcgagaccgactgcaacgacaacgtgcccagccacaagaaccccgccagcagccagagcaagcacggcatgaacggcttcttccagcagcagatgatctacgacagcccccccagcagagcccccagcgccagcgtggacagcagcctgtacaacctgcccagaagctacagccacgacgtgctgcccaaggtgagccccagcagcaccgaggccgacggcgagctgtacgtgttcaacacccccagcggcaccagcagcgtggagacccagatgagacacgtgagcatcagctacgacatcccccccacccccggcaacacctaccagatccccagaaccttccccgagggcaccctgggccagaccagcaagctggacaccatccccgacatccccccccccagaccccccaagccccaccccgcccacgacagaagccccgtggagacctgcagcatccccagaaccgccagcgacaccgacagcagctactgcatccccaccgccggcatgagccccagcagaagcaacaccatcagcaccgtggacctgaacaagctgagaaaggacgccagcagccaggactgctacgacatccccagagccttccccagcgacagaagcagcagcctggagggcttccacaaccacttcaaggtgaagaacgtgctgaccgtgggcagcgtgagcagcgaggagctggacgagaactacgtgcccatgaaccccaacagcccccccagacagcacagcagcagcttcaccgagcccatccaggaggccaactacgtgcccatgacccccggcaccttcgacttcagcagcttcggcatgcaggtgcccccccccgcccacatgggcttcagaagcagccccaagaccccccccagaagacccgtgcccgtggccgactgcgagcccccccccgtggacagaaacctgaagcccgacagaaaggtgaagcccgcccccctggagatcaagcccctgcccgagtgggaggagctgcaggcccccgtgagaagccccatcaccagaagcttcgccagagacagcagcagattccccatgagccccagacccgacagcgtgcacagcaccaccagcagcagcgacagccacgacagcgaggagaactacgtgcccatgaaccccaacctgagcagcgaggaccccaacctgttcggcagcaacagcctggacggcggcagcagccccatgatcaagcccaagggcgacaagcaggtggagtacctggacctggacctggacagcggcaagagcaccccccccagaaagcagaagagcagcggcagcggcagcagcgtggccgacgagagagtggactacgtggtggtggaccagcagaagaccctggccctgaagagcaccagagaggcctggaccgacggcagacagagcaccgagagcgagacccccgccaagagcgtgaagtag

SEQ ID NO: 83629 - DNA, 2175 bp, Artificial Sequence
  Description of Artificial Sequence: Synthetic coding sequence
atgagcggcggcgaggtggtgtgcagcggctggctgagaaagagcccccccgagaagaagctgaagagatacgcctggaagagaagatggttcgtgctgagaagcggcagactgaccggcgaccccgacgtgctggagtactacaagaacgaccacgccaagaagcccatcagaatcatcgacctgaacctgtgccagcaggtggacgccggcctgaccttcaacaagaaggagttcgagaacagctacatcttcgacatcaacaccatcgacagaatcttctacctggtggccgacagcgaggaggagatgaacaagtgggtgagatgcatctgcgacatctgcggcttcaaccccaccgaggaggaccccgtgaagccccccggcagcagcctgcaggcccccgccgacctgcccctggccatcaacaccgccccccccagcacccaggccgacagcagcagcgccaccctgccccccccctaccagctgatcaacgtgcccccccacctggagaccctgggcatccaggaggacccccaggactacctgctgctgatcaactgccagagcaagaagcccgagcccaccagaacccacgccgacagcgccaagagcaccagcagcgagaccgactgcaacgacaacgtgcccagccacaagaaccccgccagcagccagagcaagcacggcatgaacggcttcttccagcagcagatgatctacgacagcccccccagcagagcccccagcgccagcgtggacagcagcctgtacaacctgcccagaagctacagccacgacgtgctgcccaaggtgagccccagcagcaccgaggccgacggcgagctgtacgtgttcaacacccccagcggcaccagcagcgtggagacccagatgagacacgtgagcatcagctacgacatcccccccacccccggcaacacctaccagatccccagaaccttccccgagggcaccctgggccagaccagcaagctggacaccatccccgacatccccccccccagaccccccaagccccaccccgcccacgacagaagccccgtggagacctgcagcatccccagaaccgccagcgacaccgacagcagctactgcatccccaccgccggcatgagccccagcagaagcaacaccatcagcaccgtggacctgaacaagctgagaaaggacgccagcagccaggactgctacgacatccccagagccttccccagcgacagaagcagcagcctggagggcttccacaaccacttcaaggtgaagaacgtgctgaccgtgggcagcgtgagcagcgaggagctggacgagaactacgtgcccatgaaccccaacagcccccccagacagcacagcagcagcttcaccgagcccatccaggaggccaactacgtgcccatgacccccggcaccttcgacttcagcagcttcggcatgcaggtgcccccccccgcccacatgggcttcagaagcagccccaagaccccccccagaagacccgtgcccgtggccgactgcgagcccccccccgtggacagaaacctgaagcccgacagaaagggccagagccccaagatcctgagactgaagccccacggcctggagagaaccgacagccagaccatcggcgacttcgccaccagaagaaaggtgaagcccgcccccctggagatcaagcccctgcccgagtgggaggagctgcaggcccccgtgagaagccccatcaccagaagcttcgccagagacagcagcagattccccatgagccccagacccgacagcgtgcacagcaccaccagcagcagcgacagccacgacagcgaggagaactacgtgcccatgaaccccaacctgagcagcgaggaccccaacctgttcggcagcaacagcctggacggcggcagcagccccatgatcaagcccaagggcgacaagcaggtggagtacctggacctggacctggacagcggcaagagcaccccccccagaaagcagaagagcagcggcagcggcagcagcgtggccgacgagagagtggactacgtggtggtggaccagcagaagaccctggccctgaagagcaccagagaggcctggaccgacggcagacagagcaccgagagcgagacccccgccaagagcgtgaagtag

SEQ ID NO: 83630 - DNA, 1776 bp, Artificial Sequence
  Description of Artificial Sequence: Synthetic coding sequence
atgaacaagtgggtgagatgcatctgcgacatctgcggcttcaaccccaccgaggaggaccccgtgaagccccccggcagcagcctgcaggcccccgccgacctgcccctggccatcaacaccgccccccccagcacccaggccgacagcagcagcgccaccctgccccccccctaccagctgatcaacgtgcccccccacctggagaccctgggcatccaggaggacccccaggactacctgctgctgatcaactgccagagcaagaagcccgagcccaccagaacccacgccgacagcgccaagagcaccagcagcgagaccgactgcaacgacaacgtgcccagccacaagaaccccgccagcagccagagcaagcacggcatgaacggcttcttccagcagcagatgatctacgacagcccccccagcagagcccccagcgccagcgtggacagcagcctgtacaacctgcccagaagctacagccacgacgtgctgcccaaggtgagccccagcagcaccgaggccgacggcgagctgtacgtgttcaacacccccagcggcaccagcagcgtggagacccagatgagacacgtgagcatcagctacgacatcccccccacccccggcaacacctaccagatccccagaaccttccccgagggcaccctgggccagaccagcaagctggacaccatccccgacatccccccccccagaccccccaagccccaccccgcccacgacagaagccccgtggagacctgcagcatccccagaaccgccagcgacaccgacagcagctactgcatccccaccgccggcatgagccccagcagaagcaacaccatcagcaccgtggacctgaacaagctgagaaaggacgccagcagccaggactgctacgacatccccagagccttccccagcgacagaagcagcagcctggagggcttccacaaccacttcaaggtgaagaacgtgctgaccgtgggcagcgtgagcagcgaggagctggacgagaactacgtgcccatgaaccccaacagcccccccagacagcacagcagcagcttcaccgagcccatccaggaggccaactacgtgcccatgacccccggcaccttcgacttcagcagcttcggcatgcaggtgcccccccccgcccacatgggcttcagaagcagccccaagaccccccccagaagacccgtgcccgtggccgactgcgagcccccccccgtggacagaaacctgaagcccgacagaaaggtgaagcccgcccccctggagatcaagcccctgcccgagtgggaggagctgcaggcccccgtgagaagccccatcaccagaagcttcgccagagacagcagcagattccccatgagccccagacccgacagcgtgcacagcaccaccagcagcagcgacagccacgacagcgaggagaactacgtgcccatgaaccccaacctgagcagcgaggaccccaacctgttcggcagcaacagcctggacggcggcagcagccccatgatcaagcccaagggcgacaagcaggtggagtacctggacctggacctggacagcggcaagagcaccccccccagaaagcagaagagcagcggcagcggcagcagcgtggccgacgagagagtggactacgtggtggtggaccagcagaagaccctggccctgaagagcaccagagaggcctggaccgacggcagacagagcaccgagagcgagacccccgccaagagcgtgaagtag

SEQ ID NO: 83631 - DNA, 1917 bp, Artificial Sequence
  Description of Artificial Sequence: Synthetic coding sequence
atgagcggcgaccccgacgtgctggagtactacaagaacgaccacagcaagaagcccctgagaatcatcaacctgaacttctgcgagcaggtggacgccggcctgaccttcaacaagaaggagctgcaggacagcttcgtgttcgacatcaagaccagcgagagaaccttctacctggtggccgagaccgaggaggacatgaacaagtgggtgcagagcatctgccagatctgcggcttcaaccaggccgaggagagcaccgacagcctgagaaacgtgagcagcgccggccacggccccagaagcagccccgccgagctgagcagcagcagccagcacctgctgagagagagaaagagcagcgcccccagccacagcagccagcccaccctgttcaccttcgagccccccgtgagcaaccacatgcagcccaccctgagcaccagcgccccccaggagtacctgtacctgcaccagtgcatcagcagaagagccgagaacgccagaagcgccagcttcagccagggcaccagagccagcttcctgatgagaagcgacaccgccgtgcagaagctggcccagggcaacggccactgcgtgaacggcatcagcggccaggtgcacggcttctacagcctgcccaagcccagcagacacaacaccgagttcagagacagcacctacgacctgcccagaagcctggccagccacggccacaccaagggcagcctgaccggcagcgagaccgacaacgaggacgtgtacaccttcaagacccccagcaacaccctgtgcagagagttcggcgacctgctggtggacaacatggacgtgcccgccacccccctgagcgcctaccagatccccagaaccttcaccctggacaagaaccacaacgccatgaccgtggccacccccggcgacagcgccatcgcccccccccccagaccccccaagcccagccaggccgagacccccagatggggcagcccccagcagagaccccccatcagcgagaacagcagaagcgtggccgccaccatccccagaagaaacaccctgcccgccatggacaacagcagactgcacagagccagcagctgcgagacctacgagtacccccagagaggcggcgagagcgccggcagaagcgccgagagcatgagcgacggcgtgggcagcttcctgcccggcaagatgatcgtgggcagaagcgacagcaccaacagcgaggacaactacgtgcccatgaaccccggcagcagcaccctgctggccatggagagagccggcgacaacagccagagcgtgtacatccccatgagccccggcgcccaccacttcgacagcctgggctaccccagcaccaccctgcccgtgcacagaggccccagcagaggcagcgagatccagcccccccccgtgaacagaaacctgaagcccgacagaaaggccaagcccacccccctggacctgagaaacaacaccgtgatcgacgagctgcccttcaagagccccatcaccaagagctggagcagagccaaccacaccttcaacagcagcagcagccagtactgcagacccatcagcacccagagcatcaccagcaccgacagcggcgacagcgaggagaactacgtgcccatgcagaaccccgtgagcgccagccccgtgcccagcggcaccaacagccccgcccccaagaagagcaccggcagcgtggactacctggccctggacttccagcccagcagccccagcccccacagaaagcccagcaccagcagcgtgaccagcgacgagaaggtggactacgtgcaggtggacaaggagaagacccaggccctgcagaacaccatgcaggagtggaccgacgtgagacagagcagcgagcccagcaagggcgccaagctgtag

SEQ ID NO: 83632 - DNA, 2031 bp, Artificial Sequence
  Description of Artificial Sequence: Synthetic coding sequence
atgagcggcggcggcgacgtggtgtgcaccggctggctgagaaagagcccccccgagaagaagctgagaagatacgcctggaagaagagatggttcatcctgagaagcggcagaatgagcggcgaccccgacgtgctggagtactacaagaacgaccacagcaagaagcccctgagaatcatcaacctgaacttctgcgagcaggtggacgccggcctgaccttcaacaagaaggagctgcaggacagcttcgtgttcgacatcaagaccagcgagagaaccttctacctggtggccgagaccgaggaggacatgaacaagtgggtgcagagcatctgccagatctgcggcttcaaccaggccgaggagagcaccgacagcctgagaaacgtgagcagcgccggccacggccccagaagcagccccgccgagctgagcagcagcagccagcacctgctgagagagagaaagagcagcgcccccagccacagcagccagcccaccctgttcaccttcgagccccccgtgagcaaccacatgcagcccaccctgagcaccagcgccccccaggagtacctgtacctgcaccagtgcatcagcagaagagccgagaacgccagaagcgccagcttcagccagggcaccagagccagcttcctgatgagaagcgacaccgccgtgcagaagctggcccagggcaacggccactgcgtgaacggcatcagcggccaggtgcacggcttctacagcctgcccaagcccagcagacacaacaccgagttcagagacagcacctacgacctgcccagaagcctggccagccacggccacaccaagggcagcctgaccggcagcgagaccgacaacgaggacgtgtacaccttcaagacccccagcaacaccctgtgcagagagttcggcgacctgctggtggacaacatggacgtgcccgccacccccctgagcgcctaccagatccccagaaccttcaccctggacaagaaccacaacgccatgaccgtggccacccccggcgacagcgccatcgcccccccccccagaccccccaagcccagccaggccgagacccccagatggggcagcccccagcagagaccccccatcagcgagaacagcagaagcgtggccgccaccatccccagaagaaacaccctgcccgccatggacaacagcagactgcacagagccagcagctgcgagacctacgagtacccccagagaggcggcgagagcgccggcagaagcgccgagagcatgagcgacggcgtgggcagcttcctgcccggcaagatgatcgtgggcagaagcgacagcaccaacagcgaggacaactacgtgcccatgaaccccggcagcagcaccctgctggccatggagagagccggcgacaacagccagagcgtgtacatccccatgagccccggcgcccaccacttcgacagcctgggctaccccagcaccaccctgcccgtgcacagaggccccagcagaggcagcgagatccagcccccccccgtgaacagaaacctgaagcccgacagaaaggccaagcccacccccctggacctgagaaacaacaccgtgatcgacgagctgcccttcaagagccccatcaccaagagctggagcagagccaaccacaccttcaacagcagcagcagccagtactgcagacccatcagcacccagagcatcaccagcaccgacagcggcgacagcgaggagaactacgtgcccatgcagaaccccgtgagcgccagccccgtgcccagcggcaccaacagccccgcccccaagaagagcaccggcagcgtggactacctggccctggacttccagcccagcagccccagcccccacagaaagcccagcaccagcagcgtgaccagcgacgagaaggtggactacgtgcaggtggacaaggagaagacccaggccctgcagaacaccatgcaggagtggaccgacgtgagacagagcagcgagcccagcaagggcgccaagctgtag

SEQ ID NO: 83633 - DNA, 396 bp, Artificial Sequence
  Description of Artificial Sequence: Synthetic coding sequence
atgagcggcgaccccgacgtgctggagtactacaagaacgaccacagcaagaagcccctgagaatcatcaacctgaacttctgcgagcaggtggacgccggcctgaccttcaacaagaaggagctgcaggacagcttcgtgttcgacatcaagaccagcgagagaaccttctacctggtggccgagaccgaggaggacatgaacaagtgggtgcagagcatctgccagatctgcggcttcaaccaggccgaggagagcaccgacagcctgagaaacgtgagcagcgccggccacggccccagaagcagccccgccgagctgagcagcagcagccagcacctgctgagagagagaaagagcagcgcccccagccacagcagccagcccaccctgtag

SEQ ID NO: 83634 - DNA, 309 bp, Artificial Sequence
  Description of Artificial Sequence: Synthetic coding sequence
atgagcggcgaccccgacgtgctggagtactacaagaacgaccacagcaagaagcccctgagaatcatcaacctgaacttctgcgagcaggtggacgccggcctgaccttcaacaagaaggagctgcaggacagcttcgtgttcgacatcaagaccagcgagagaaccttctacctggtggccgagaccgaggaggacatgaacaagtgggtgcagagcatctgccagatctgcggcttcaaccaggccgaggagagcaccgacagcctgagaaacgtgagcagcgccggccacggccccagaagctag

SEQ ID NO: 83635 - DNA, 993 bp, Artificial Sequence
  Description of Artificial Sequence: Synthetic coding sequence
atggaggccgtggccaagttcgacttcaccgccagcggcgaggacgagctgagcttccacaccggcgacgtgctgaagatcctgagcaaccaggaggagtggttcaaggccgagctgggcagccaggagggctacgtgcccaagaacttcatcgacatccagttccccaagtggttccacgagggcctgagcagacaccaggccgagaacctgctgatgggcaaggaggtgggcttcttcatcatcagagccagccagagcagccccggcgacttcagcatcagcgtgagacacgaggacgacgtgcagcacttcaaggtgatgagagacaacaagggcaactacttcctgtggaccgagaagttccccagcctgaacaagctggtggactactacagaaccaacagcatcagcagacagaagcagatcttcctgagagacagaaccagagaggaccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggacgacgagctgggcttccacagcggcgaggtggtggaggtgctggacagcagcaaccccagctggtggaccggcagactgcacaacaagctgggcctgttccccgccaactacgtggcccccatgaccagatag

SEQ ID NO: 83636 - DNA, 654 bp, Artificial Sequence
  Description of Artificial Sequence: Synthetic coding sequence
atggtgagcagaagacccctgagcacccccggcagagagctgacccacggccagggcggctggctgctgcaccaccccggccagcccgagctgcccagaggcctgctgcacctgtgccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggacgacgagctgggcttccacagcggcgaggtggtggaggtgctggacagcagcaaccccagctggtggaccggcagactgcacaacaagctgggcctgttccccgccaactacgtggcccccatgaccagatag

SEQ ID NO: 83637 - DNA, 993 bp, Artificial Sequence; identical to SEQ ID NO: 83635
  Description of Artificial Sequence: Synthetic coding sequence

SEQ ID NO: 83638 - DNA, 294 bp, Artificial Sequence
  Description of Artificial Sequence: Synthetic coding sequence
atggaggccgtggccaagttcgacttcaccgccagcggcgaggacgagctgagcttccacaccggcgacgtgctgaagatcctgagcaaccaggaggagtggttcaaggccgagctgggcagccaggagggctacgtgcccaagaacttcatcgacatccagttccccaagtggttccacgagggcctgagcagacaccaggccgagaacctgctgatgggcaaggaggtgggcttcttcatcatcagagccagccagagcagccccggcgacttcagcatcagcgtgagatag

SEQ ID NO: 83639 - DNA, 795 bp, Artificial Sequence
  Description of Artificial Sequence: Synthetic coding sequence
atgctggagttcgtgagcctgctggccagaaaggacagcaacaacagcgtgagcaagcccagacacaagctgaaccccttcagcagcaagagacacgaggacgacgtgcagcacttcaaggtgatgagagacaacaagggcaactacttcctgtggaccgagaagttccccagcctgaacaagctggtggactactacagaaccaacagcatcagcagacagaagcagatcttcctgagagacagaaccagagaggaccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggacgacgagctgggcttccacagcggcgaggtggtggaggtgctggacagcagcaaccccagctggtggaccggcagactgcacaacaagctgggcctgttccccgccaactacgtggcccccatgaccagatag

SEQ ID NO: 83640 - DNA, 837 bp, Artificial Sequence
  Description of Artificial Sequence: Synthetic coding sequence
atggaggccgtggccaagttcgacttcaccgccagcggcgaggacgagctgagcttccacaccggcgacgtgctgaagatcctgagcaaccaggaggagtggttcaaggccgagctgggcagccaggagggctacgtgcccaagaacttcatcgacatccagttccccaagcacgaggacgacgtgcagcacttcaaggtgatgagagacaacaagggcaactacttcctgtggaccgagaagttccccagcctgaacaagctggtggactactacagaaccaacagcatcagcagacagaagcagatcttcctgagagacagaaccagagaggaccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggaggtgctggacagcagcaaccccagctggtggaccggcagactgcacaacaagctgggcctgttccccgccaactacgtggcccccatgaccagatag

SEQ ID NO: 83641 - DNA, 915 bp, Artificial Sequence
  Description of Artificial Sequence: Synthetic coding sequence
atgctggagttcgtgagcctgctggccagaaaggacagcaacaacagcgtgagcaagcccagacacaagctgaaccccttcagcagcaagagatggttccacgagggcctgagcagacaccaggccgagaacctgctgatgggcaaggaggtgggcttcttcatcatcagagccagccagagcagccccggcgacttcagcatcagcgtgagacacgaggacgacgtgcagcacttcaaggtgatgagagacaacaagggcaactacttcctgtggaccgagaagttccccagcctgaacaagctggtggactactacagaaccaacagcatcagcagacagaagcagatcttcctgagagacagaaccagagaggaccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggacgacgagctgggcttccacagcggcgaggtggtggaggtgctggacagcagcaaccccagctggtggaccggcagactgcacaacaagctgggcctgttccccgccaactacgtggcccccatgaccagatag

SEQ ID NO: 83642 - DNA, 777 bp, Artificial Sequence
  Description of Artificial Sequence: Synthetic coding sequence
atgggcaaggaggtgggcttcttcatcatcagagccagccagagcagccccggcgacttcagcatcagcgtgagacacgaggacgacgtgcagcacttcaaggtgatgagagacaacaagggcaactacttcctgtggaccgagaagttccccagcctgaacaagctggtggactactacagaaccaacagcatcagcagacagaagcagatcttcctgagagacagaaccagagaggaccagggccacagaggcaacagcctggacagaagaagccagggcggcccccacctgagcggcgccgtgggcgaggagatcagacccagcatgaacagaaagctgagcgaccacccccccaccctgcccctgcagcagcaccagcaccagccccagcccccccagtacgcccccgccccccagcagctgcagcagcccccccagcagagatacctgcagcaccaccacttccaccaggagagaagaggcggcagcctggacatcaacgacggccactgcggcaccggcctgggcagcgagatgaacgccgccctgatgcacagaagacacaccgaccccgtgcagctgcaggccgccggcagagtgagatgggccagagccctgtacgacttcgaggccctggaggacgacgagctgggcttccacagcggcgaggtggtggaggtgctggacagcagcaaccccagctggtggaccggcagactgcacaacaagctgggcctgttccccgccaactacgtggcccccatgaccagatag

SEQ ID NO: 83643 - DNA, 507 bp, Artificial Sequence
  Description of Artificial Sequence: Synthetic coding sequence
atgttctggaagctgagcctgagcctgttcctggtggccgtgctggtgaaggtggccgaggccagaaagaacagacccgccggcgccatccccagcccctacaaggacggcagcagcaacaacagcgagagatggcagcaccagatcaaggaggtgctggccagcagccaggaggccctggtggtgaccgagagaaagtacctgaagagcgactggtgcaagacccagcccctgagacagaccgtgagcgaggagggctgcagaagcagaaccatcctgaacagattctgctacggccagtgcaacagcttctacatccccagacacgtgaagaaggaggaggagagcttccagagctgcgccttctgcaagccccagagagtgaccagcgtgctggtggagctggagtgccccggcctggacccccccttcagactgaagaagatccagaaggtgaagcagtgcagatgcatgagcgtgaacctgagcgacagcgacaagcagtag

SEQ ID NO: 83644 - DNA, 1443 bp, Artificial Sequence
  Description of Artificial Sequence: Synthetic coding sequence
atggccggcaccagatgggtgctgggcgccctgctgagaggctgcggctgcaactgcagcagctgcagaagaaccggcgccgcctgcctgcccttctacagcgccgccggcagcatccccagcggcgtgagcggcagaagaagactgctgctgctgctgggcgccgccgccgccgccgccagccagaccagaggcctgcagaccggccccgtgccccccggcagactggccggcccccccgccgtggccaccagcgccgccgccgccgccgccgccagctacagcgccctgagagccagcctgctgccccagagcctggccgccgccgccgccgtgcccaccagaagctacagccaggagagcaagaccacctacctggaggacctgccccccccccccgagtacgagctggcccccagcaagctggaggaggaggtggacgacgtgttcctgatcagagcccagggcctgccctggagctgcaccatggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83645 - DNA, 957 bp, Artificial Sequence
  Description of Artificial Sequence: Synthetic coding sequence
atggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83646 - DNA, 1362 bp, Artificial Sequence
  Description of Artificial Sequence: Synthetic coding sequence
gccgccgccgtgcccaccagaagctacagccaggtgagaggcagaagagagggccccggcgccagaagcctgcccggcagagtgcacgccccccccagacccagcgtgcccccctgcgcccccagaggccacgccagaggcagcgccaccctggccgcccaccccccccccagcaccctgtgcagctactgggccctggagcagggcaagctgagccaggccagcggcctgctgctggtgctgttcagccccagagtgagcggcagactgggcagcgagagcaagaccacctacctggaggacctgccccccccccccgagtacgagctggcccccagcaagctggaggaggaggtggacgacgtgttcctgatcagagcccagggcctgccctggagctgcaccatggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83647 - DNA, 957 bp, Artificial Sequence; identical to SEQ ID NO: 83645
  Description of Artificial Sequence: Synthetic coding sequence

SEQ ID NO: 83648 - DNA, 1254 bp, Artificial Sequence
  Description of Artificial Sequence: Synthetic coding sequence
tgacccccccccagcaccctgtgcagctactgggccctggagcagggcaagctgagccaggccagcggcctgctgctggtgctgttcagccccagagtgagcggcagactgggcagcgtgagcgtggccggcgtgaacgtggaggccctgttccccgcctggcccatggagagcaagaccacctacctggaggacctgccccccccccccgagtacgagctggcccccagcaagctggaggaggaggtggacgacgtgttcctgatcagagcccagggcctgccctggagctgcaccatggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83649 - DNA, 1239 bp, Artificial Sequence
  Description of Artificial Sequence: Synthetic coding sequence
atggccggcaccagatgggtgctgggcgccctgctgagaggctgcggctgcaactgcagcagctgcagaagaaccggcgccgcctgcctgcccttctacagcgccgccggcagcatccccgccgccgccgtgcccaccagaagctacagccaggagagcaagaccacctacctggaggacctgccccccccccccgagtacgagctggcccccagcaagctggaggaggaggtggacgacgtgttcctgatcagagcccagggcctgccctggagctgcaccatggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83650 - DNA, 1089 bp, Artificial Sequence
  Description of Artificial Sequence: Synthetic coding sequence
atggagagcaagaccacctacctggaggacctgccccccccccccgagtacgagctggcccccagcaagctggaggaggaggtggacgacgtgttcctgatcagagcccagggcctgccctggagctgcaccatggaggacgtgctgaacttcttcagcgactgcagaatcagaaacggcgagaacggcatccacttcctgctgaacagagacggcaagagaagaggcgacgccctgatcgagatggagagcgagcaggacgtgcagaaggccctggagaagcacagaatgtacatgggccagagatacgtggaggtgtacgagatcaacaacgaggacgtggacgccctgatgaagagcctgcaggtgaagagcagccccgtggtgaacgacggcgtggtgagactgagaggcctgccctacagctgcaacgagaaggacatcgtggacttcttcgccggcctgaacatcgtggacatcaccttcgtgatggactacagaggcagaagaaagaccggcgaggcctacgtgcagttcgaggagcccgagatggccaaccaggccctgctgaagcacagagaggagatcggcaacagatacatcgagatcttccccagcagaagaaacgaggtgagaacccacgtgggcagctacaagggcaagaagatcgccagcttccccaccgccaagtacatcaccgagcccgagatggtgttcgaggagcacgaggtgaacgaggacatccagcccatgaccgccttcgagagcgagaaggagatcgagctgcccaaggaggtgcccgagaagctgcccgaggccgccgacttcggcaccaccagcagcctgcacttcgtgcacatgagaggcctgcccttccaggccaacgcccaggacatcatcaacttcttcgcccccctgaagcccgtgagaatcaccatggagtacagcagcagcggcaaggccaccggcgaggccgacgtgcacttcgagacccacgaggacgccgtggccgccatgctgaaggacagaagccacgtgcaccacagatacatcgagctgttcctgaacagctgccccaagggcaagtag

SEQ ID NO: 83651 - DNA, 1401 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagagccaccctggagaaggtgagaaagagaatgtacggcgactacgacgagatgagacagaagatcagacagctgacccaggagctgagcgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagatcgagagcctgaagaagaagctgcagcagaagcagctgctgatcctgcagctgctggagaagatcagcttcctggagggcgagaacaacgagctgcagagcagactggactacctgaccgagacccaggccaagaccgaggtggagaccagagagatcggcgtgggctgcgacctgctgcccagccagaccggcagaaccagagagatcgtgatgcccagcagaaactacaccccctacaccagagtgctggagctgaccatgaagaagaccctgacctag

SEQ ID NO: 83652 - DNA, 1194 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagatcgagagcctgaagaagaagctgcagcagaagcagctgctgatcctgcagctgctggagaagatcagcttcctggagggcgagaacaacgagctgcagagcagactggactacctgaccgagacccaggccaagaccgaggtggagaccagagagatcggcgtgggctgcgacctgctgcccagccagaccggcagaaccagagagatcgtgatgcccagcagaaactacaccccctacaccagagtgctggagctgaccatgaagaagaccctgacctag

SEQ ID NO: 83653 - DNA, 1248 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagaacaacgagctgcagagcagactggactacctgaccgagacccaggccaagaccgaggtggagaccagagagatcggcgtgggctgcgacctgctgcccagacagagcagaaagttcgagaaggtgctgaacgagttcgtgcagctgctgcccctgccccaccacctgctgtgggccttcggcaacgtgtgctggagaagacacttcggcctgctgcagtag

SEQ ID NO: 83654 - DNA, 1317 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagagccaccctggagaaggtgagaaagagaatgtacggcgactacgacgagatgagacagaagatcagacagctgacccaggagctgagcgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagaacaacgagctgcagagcagactggactacctgaccgagacccaggccaagaccgaggtggagaccagagagatcggcgtgggctgcgacctgctgcccagccagaccggcagaaccagagagatcgtgatgcccagcagaaactacaccccctacaccagagtgctggagctgaccatgaagaagaccctgacctag

SEQ ID NO: 83655 - DNA, 1338 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagagccaccctggagaaggtgagaaagagaatgtacggcgactacgacgagatgagacagaagatcagacagctgacccaggagctgagcgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagatcgagagcctgaagaagaagctgcagcagaagcagctgctgatcctgcagctgctggagaagatcagcttcctggagggcgagaacaacgagctgcagagcagactggactacctgaccgagacccaggccaagaccgaggtggagaccagagagatcggcgtgggctgcgacctgctgcccagaagatgcaagcagagcagccagagaaagaactag

SEQ ID NO: 83656 - DNA, 1653 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagagccaccctggagaaggtgagaaagagaatgtacggcgactacgacgagatgagacagaagatcagacagctgacccaggagctgagcgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagatcgagagcctgaagaagaagctgcagcagaagcagctgctgatcctgcagctgctggagaagatcagcttcctggagggcgagaacaacgagctgcagagcagactggactacctgaccgagacccaggccaagaccgaggtggagaccagagagatcggcgtgggctgcgacctgctgcccagactgcccttcagacagaacgacagcagcagccactgccagaagagcggcagccccatcagcagcgaggagagaagaagaagagacaagcagcacctggacgacatcaccgccgccagactgctgcccctgcaccacatgcccacccagctgctgagcatcgaggagagcctggccctgcagaagcagcagaagcagaactacgaggagatgcaggccaagctggccgcccagaagctggccgagagactgaacatcaagatgagaagctacaaccccgagggcgagagcagcggcagatacagagaggtgagagacgaggacgacgactggagcagcgacgagttctag

SEQ ID NO: 83657 - DNA, 1308 bp, Artificial Sequence
  Description of Artificial Sequence: Synthetic coding sequence
atgctgagaagcaccagcaccgtgaccctgctgagcggcggcgccgccagaacccccggcgcccccagcagaagagccaacgtgtgcagactgagactgaccgtgccccccgagagccccgtgcccgagcagtgcgagaagaagatcgagagaaaggagcagctgctggacctgagcaacggcgagcccaccagaaagctgccccagggcgtggtgtacggcgtggtgagaagaagcgaccagaaccagcagaaggagatggtggtgtacggctggagcaccagccagctgaaggaggagatgaactacatcaaggacgtgagccacgcccagcaggagtacctggagaaccacatccagacccagagcagcgccctggacagattcaacgccatgaacagcgccctggccagcgacagcatcggcctgcagaagaccctggtggacgtgaccctggagaacagcaacatcaaggaccagatcagaaacctgcagcagacctacgaggccagcatggacaagctgagagagaagcagagacagctggaggtggcccaggtggagaaccagctgctgaagatgaaggtggagagcagccaggaggccaacgccgaggtgatgagagagatgaccaagaagctgtacagccagtacgaggagaagctgcaggaggagcagagaaagcacagcgccgagaaggaggccctgctggaggagaccaacagcttcctgaaggccatcgaggaggccaacaagaagatgcaggccgccgagatcagcctggaggagaaggaccagagaatcggcgagctggacagactgatcgagagaatggagaaggagagacaccagctgcagctgcagctgctggagcacgagaccgagatgagcggcgagctgaccgacagcgacaaggagagataccagcagctggaggaggccagcgccagcctgagagagagaatcagacacctggacgacatggtgcactgccagcagaagaaggtgaagcagatggtggaggagatcgagagcctgaagaagaagctgcagcagaagcagctgctgatcctgcagctgctggagaagatcagcttcctggagggcgagaacaacgagctgcagagcagactggactacctgaccgagacccaggccaagaccgaggtggagaccagagagatcggcgtgggctgcgacctgctgcccagccagaccggcagaaccagagagatcgtgatgcccagcagaaactacaccccctacaccagagtgctggagctgaccatgaagaagaccctgacctag

SEQ ID NO: 83658 - DNA, 1401 bp, Artificial Sequence; identical to SEQ ID NO: 83651
  Description of Artificial Sequence: Synthetic coding sequence

SEQ ID NO: 83659 - DNA, 1317 bp, Artificial Sequence; identical to SEQ ID NO: 83654
  Description of Artificial Sequence: Synthetic coding sequence

SEQ ID NO: 83660 - DNA, 1401 bp, Artificial Sequence; identical to SEQ ID NO: 83651
  Description of Artificial Sequence: Synthetic coding sequence

SEQ ID NO: 83661 - DNA, 2328 bp, Artificial Sequence
  Description of Artificial Sequence: Synthetic coding sequence
atggagaagttcggcatgaacttcggcggcggccccagcaagaaggacctgctggagaccatcgagacccagaagaagcagctgctgcagtaccaggccagactgaaggacgtggtgagagcctacaagagcctgctgaaggagaaggaggccctggaggccagcatcaaggtgctgagcgtgagccacgaggccgacgtgggcctggccggcgtgcagctgcccggcctgaccttccccgacagcgtggacgacagatgcagcacccacagcgaggacagcaccggcaccgccaccagcctggacaccgccgccagcctgaccagcaccaagggcgagttcggcgtggaggacgacagacccgccagaggcccccccccccccaagagcgaggaggccagctggagcgagagcggcgtgagcagcagcagcggcgacggccccttcgccggcggcgaggtggacaagagactgcaccagctgaagacccagctggccaccctgaccagcagcctggccaccgtgacccaggagaagagcagaatggaggccagctacctggccgacaagaagaagatgaagcaggacctggaggacgccagcaacaaggccgaggaggagagagccagactggagggcgagctgaagggcctgcaggagcagatcgccgagaccaaggccagactgatcacccagcagcacgacagagcccaggagcagagcgaccacgccctgatgctgagagagctgcagaagctgctgcaggaggagagaacccagagacaggacctggagctgagactggaggagaccagagaggccctggccggcagagcctacgccgccgagcagatggagggcttcgagctgcagaccaagcagctgaccagagaggtggaggagctgaagagcgagctgcaggccatcagagacgagaagaaccagcccgaccccagactgcaggagctgcaggaggaggccgccagactgaagagccacttccaggcccagctgcagcaggagatgagaaagaccgccctggccgaggaccagctgagacagcagagccaggtggaggagcagagagtggccgccctggagaaccagatcagcgaggtgagcgagctgctgggcacctacgagaaggccaagcagaaggaccagctggccatccagaagctgaaggagagaatcctgcagctggacctggagaacaagaccctggccctggccgccagcagcagaagccccctggacagccacggcgaggagagcagcctggacgtgaacgtgctgaaggacaagatggagaagctgaagagactgctgcaggtggccgccagaaagagccaggtgaccctggacgtggagaagctgtgcgacctggagatcatgcccagcagcgaggccgccgacggcgagaaggccaccgccctgtactaccagcaggagctgaagcagctgaaggaggagttcgagagatacaagatgagagcccaggtggtgctgaagagcaagaacaccaaggacggcaacctgggcaaggagctggaggccgcccaggagcagctggccgagctgaaggagaagtacatcagcctgagactgagctgcgaggagctggagcaccagcaccagcaggaggccgacgactggaagcaggagctggccagactgcagcagctgcacagacaggagctggagagatgccagctggacttcagagacagaaccctgaagctggaggaggagctgcacaagcagagagacagagccctggccgtgctgaccgagaaggacctggagctggagcagctgagaagcgtggccctggccagcggcctgcccggcagaagaagccccgtgggcggcggcggccccggcgaccccgccgacaccagcagcagcgacagcctgacccaggccctgcagctggccgccgccaacgagcccaccttcttcctgtacgccgagcagctggccagaaaggaggtggagatcaccagcctgagaaagcagaagcacagactggaggtggaggtgcaccagctgcaggacagactgctggaggagggcgagagacacagagaggaggtggccgccctgcagagccacatcgagaagaacatcagagaccagagcagagagggcgccaacctggagtacctgaagaacatcatctacagattcctgaccctgcccgacagcctgggcagacagcagaccctgaccgccatcctgaccatcctgcacttcagccccgaggagaagcaggtgatcatgagactgcccaccagcgccagctggtggcccagcggcaagagatag

SEQ ID NO: 83662 - DNA, 5055 bp, Artificial Sequence
  Description of Artificial Sequence: Synthetic coding sequence
atggaggacctggtgcaggacggcgtggccagccccgccacccccggcaccggcaagagcaagctggagaccctgcccaaggaggacctgatcaagttcgccaagaagcagatgatgctgatccagaaggccaagagcagatgcaccgagctggagaaggagatcgaggagctgagaagcaagcccgtgaccgagggcaccggcgacatcatcaaggccctgaccgagagactggacgccctgctgctggagaaggccgagaccgagcagcagtgcctgagcctgaagaaggagaacatcaagatgaagcaggaggtggaggacagcgtgaccaagatgggcgacgcccacaaggagctggagcagagccacatcaactacgtgaaggagatcgagaacctgaagaacgagctgatggccgtgagaagcaagtacagcgaggacaaggccaacctgcagaagcagctggaggaggccatgaacacccagctggagctgagcgagcagctgaagttccagaacaacagcgaggacaacgtgaagaagctgcaggaggagatcgagaagatcagacccggcttcgaggagcagatcctgtacctgcagaagcagctggacgccaccaccgacgagaagaaggagaccgtgacccagctgcagaacatcatcgaggccaacagccagcactaccagaagaacatcaacagcctgcaggaggagctgctgcagctgaaggccatccaccaggaggaggtgaaggagctgatgtgccagatcgaggccagcgccaaggagcacgaggccgagatcaacaagctgaacgagctgaaggagaacctggtgaagcagtgcgaggccagcgagaagaacatccagaagaagtacgagtgcgagctggagaacctgagaaaggccaccagcaacgccaaccaggacaaccagatctgcagcatcctgctgcaggagaacaccttcgtggagcaggtggtgaacgagaaggtgaagcacctggaggacaccctgaaggagctggagagccagcacagcatcctgaaggacgaggtgacctacatgaacaacctgaagctgaagctggagatggacgcccagcacatcaaggacgagttcttccacgagagagaggacctggagttcaagatcaacgagctgctgctggccaaggaggagcagggctgcgtgatcgagaagctgaagagcgagctggccggcctgaacaagcagttctgctacaccgtggagcagcacaacagagaggtgcagagcctgaaggagcagcaccagaaggagatcagcgagctgaacgagaccttcctgagcgacagcgagaaggagaagctgaccctgatgttcgagatccagggcctgaaggagcagtgcgagaacctgcagcaggagaagcaggaggccatcctgaactacgagagcctgagagagatcatggagatcctgcagaccgagctgggcgagagcgccggcaagatcagccaggagttcgagagcatgaagcagcagcaggccagcgacgtgcacgagctgcagcagaagctgagaaccgccttcaccgagaaggacgccctgctggagaccgtgaacagactgcagggcgagaacgagaagctgctgagccagcaggagctggtgcccgagctggagaacaccatcaagaacctgcaggagaagaacggcgtgtacctgctgagcctgagccagagagacaccatgctgaaggagctggagggcaagatcaacagcctgaccgaggagaaggacgacttcatcaacaagctgaagaacagccacgaggagatggacaacttccacaagaagtgcgagagagaggagagactgatcctggagctgggcaagaaggtggagcagaccatccagtacaacagcgagctggagcagaaggtgaacgagctgaccggcggcctggaggagaccctgaaggagaaggaccagaacgaccagaagctggagaagctgatggtgcagatgaaggtgctgagcgaggacaaggaggtgctgagcgccgaggtgaagagcctgtacgaggagaacaacaagctgagcagcgagaagaagcagctgagcagagacctggaggtgttcctgagccagaaggaggacgtgatcctgaaggagcacatcacccagctggagaagaagctgcagctgatggtggaggagcaggacaacctgaacaagctgctggagaacgagcaggtgcagaagctgttcgtgaagacccagctgtacggcttcctgaaggagatgggcagcgaggtgagcgaggacagcgaggagaaggacgtggtgaacgtgctgcaggccgtgggcgagagcctggccaagatcaacgaggagaagtgcaacctggccttccagagagacgagaaggtgctggagctggagaaggagatcaagtgcctgcaggaggagagcgtggtgcagtgcgaggagctgaagagcctgctgagagactacgagcaggagaaggtgctgctgagaaaggagctggaggagatccagagcgagaaggaggccctgcagagcgacctgctggagatgaagaacgccaacgagaagaccagactggagaaccagaacctgctgatccaggtggaggaggtgagccagacctgcagcaagagcgagatccacaacgagaaggagaagtgcttcatcaaggagcacgagaacctgaagcccctgctggagcagaaggagctgagagacagaagagccgagctgatcctgctgaaggacagcctggccaagagccccagcgtgaagaacgaccccctgagcagcgtgaaggagctggaggagaagatcgagaacctggagaaggagtgcaaggagaaggaggagaagatcaacaagatcaagctggtggccgtgaaggccaagaaggagctggacagcagcagaaaggagacccagaccgtgaaggaggagctggagagcctgagaagcgagaaggaccagctgagcgccagcatgagagacctgatccagggcgccgagagctacaagaacctgctgctggagtacgagaagcagagcgagcagctggacgtggagaaggagagagccaacaacttcgagcacagaatcgaggacctgaccagacagctgagaaacagcaccctgcagtgcgagaccatcaacagcgacaacgaggacctgctggccagaatcgagaccctgcagagcaacgccaagctgctggaggtgcagatcctggaggtgcagagagccaaggccatggtggacaaggagctggaggccgagaagctgcagaaggagcagaagatcaaggagcacgccaccaccgtgaacgagctggaggagctgcaggtgcagctgcagaagcagaagaagcagctgcagaagaccatgcaggagctggagctggtgaagaaggacgcccagcagaccaccctgatgaacatggagatcgccgactacgagagactgatgaaggagctgaaccagaagctgaccaacaagaacaacaagatcgaggacctggagcaggagatcaagatccagaagcagaagcaggagaccctgcaggaggagatcaccagcctgcagagcagcgtgcagcagtacgaggagaagaacaccaagatcaagcagctgctggtgaagaccaagaaggagctggccgacagcaagcaggccgagaccgaccacctgatcctgcaggccagcctgaagggcgagctggaggccagccagcagcaggtggaggtgtacaagatccagctggccgagatcaccagcgagaagcacaagatccacgagcacctgaagaccagcgccgagcagcaccagagaaccctgagcgcctaccagcagagagtgaccgccctgcaggaggagtgcagagccgccaaggccgagcaggccaccgtgaccagcgagttcgagagctacaaggtgagagtgcacaacgtgctgaagcagcagaagaacaagagcatgagccaggccgagaccgagggcgccaagcaggagagagagcacctggagatgctgatcgaccagctgaagatcaagctgcaggacagccagaacaacctgcagatcaacgtgagcgagctgcagaccctgcagagcgagcacgacaccctgctggagagacacaacaagatgctgcaggagaccgtgagcaaggaggccgagctgagagagaagctgtgcagcatccagagcgagaacatgatgatgaagagcgagcacacccagaccgtgagccagctgaccagccagaacgaggtgctgagaaacagcttcagagaccaggtgagacacctgcaggaggagcacagaaagaccgtggagaccctgcagcagcagctgagcaagatggaggcccagctgttccagctgaagaacgagcccaccaccagaagccccgtgagcagccagcagagcctgaagaacctgagagagagaagaaacaccgacctgcccctgctggacatgcacaccgtgaccagagaggagggcgagggcatggagaccaccgacaccgagagcgtgagcagcgccagcacctacacccagagcctggagcagctgctgaacagccccgagaccaagctggagccccccctgtggcacgccgagttcaccaaggaggagctggtgcagaagctgagcagcaccaccaagagcgccgaccacctgaacggcctgctgagagagaccgaggccaccaacgccatcctgatggagcagatcaagctgctgaagagcgagatcagaagactggagagaaaccaggagagagagaagagcgccgccaacctggagtacctgaagaacgtgctgctgcagttcatcttcctgaagcccggcagcgagagagagagactgctgcccgtgatcaacaccatgctgcagctgagccccgaggagaagggcaagctggccgccgtggcccagggcgaggaggagaacgccagcagaagcagcggctgggccagctacctgcacagctggagcggcctgagatag

SEQ ID NO: 83663 - DNA, 2052 bp, Artificial Sequence
  Description of Artificial Sequence: Synthetic coding sequence
atgtgccagatcgaggccagcgccaaggagcacgaggccgagatcaacaagctgaacgagctgaaggagaacctggtgaagcagtgcgaggccagcgagaagaacatccagaagaagtacgagtgcgagctggagaacctgagaaaggccaccagcaacgccaaccaggacaaccagatctgcagcatcctgctgcaggagaacaccttcgtggagcaggtggtgaacgagaaggtgaagcacctggaggacaccctgaaggagctggagagccagcacagcatcctgaaggacgaggtgacctacatgaacaacctgaagctgaagctggagatggacgcccagcacatcaaggacgagttcttccacgagagagaggacctggagttcaagatcaacgagctgctgctggccaaggaggagcagggctgcgtgatcgagaagctgaagagcgagctggccggcctgaacaagcagttctgctacaccgtggagcagcacaacagagaggtgcagagcctgaaggagcagcaccagaaggagatcagcgagctgaacgagaccttcctgagcgacagcgagaaggagaagctgaccctgatgttcgagatccagggcctgaaggagcagtgcgagaacctgcagcaggagaagcaggaggccatcctgaactacgagagcctgagagagatcatggagatcctgcagaccgagctgggcgagagcgccggcaagatcagccaggagttcgagagcatgaagcagcagcaggccagcgacgtgcacgagctgcagcagaagctgagaaccgccttcaccgagaaggacgccctgctggagaccgtgaacagactgcagggcgagaacgagaagctgctgagccagcaggagctggtgcccgagctggagaacaccatcaagaacctgcaggagaagaacggcgtgtacctgctgagcctgagccagagagacaccatgctgaaggagctggagggcaagatcaacagcctgaccgaggagaaggacgacttcatcaacaagctgaagaacagccacgaggagatggacaacttccacaagaagtgcgagagagaggagagactgatcctggagctgggcaagaaggtggagcagaccatccagtacaacagcgagctggagcagaaggtgaacgagctgaccggcggcctggaggagaccctgaaggagaaggaccagaacgaccagaagctggagaagctgatggtgcagatgaaggtgctgagcgaggacaaggaggtgctgagcgccgaggtgaagagcctgtacgaggagaccatcaacagcgtgcagaagaagcagctgagcagagacctggaggtgttcctgagccagaaggaggacgtgatcctgaaggagcacatcacccagctggagaagaagctgcagctgatggtggaggagcaggacaacctgaacaagctgctggagaacgagcaggtgcagaagctgttcgtgaagacccagctgtacggcttcctgaaggagatgggcagcgaggtgagcgaggacagcgaggagaaggacgtggtgaacgtgctgcaggccgtgggcgagagcctggccaagatcaacgaggagaagtgcaacctggccttccagagagacgagaaggtgctggagctggagaaggagatcaagtgcctgcaggaggagagcgtggtgcagtgcgaggagctgaagagcctgctgagagactacgagcaggagaaggtgctgctgagaaaggagctggaggagatccagagcgagaaggaggccctgcagagcgacctgctggagatgaagaacgccaacgagaagaccagactggagaaccagaacctgctgatccaggtggaggaggtgagccagacctgcagcaagagcgagatccacaacgagaaggagaagtgcttcatcaaggagcacgagaacctgaagcccctgctggagcagaaggagctgagagacagaagagccgagctgatcctgctgaaggacagcctggccaagagccccagcaagaagtag

SEQ ID NO: 83664 - DNA, 1347 bp, Artificial Sequence
  Description of Artificial Sequence: Synthetic coding sequence
atggaggacctggtgcaggacggcgtggccagccccgccacccccggcaccggcaagagcaagctggagaccctgcccaaggaggacctgatcaagttcgccaagaagcagatgatgctgatccagaaggccaagagcagatgcaccgagctggagaaggagatcgaggagctgagaagcaagcccgtgaccgagggcaccggcgacatcatcaaggccctgaccgagagactggacgccctgctgctggagaaggccgagaccgagcagcagtgcctgagcctgaagaaggagaacatcaagatgaagcaggaggtggaggacagcgtgaccaagatgggcgacgcccacaaggagctggagcagagccacatcaactacgtgaaggagatcgagaacctgaagaacgagctgatggccgtgagaagcaagtacagcgaggacaaggccaacctgcagaagcagctggaggaggccatgaacacccagctggagctgagcgagcagctgaagttccagaacaacagcgaggacaacgtgaagaagctgcaggaggagatcgagaagatcagacccggcttcgaggagcagatcctgtacctgcagaagcagctggacgccaccaccgacgagaagaaggagaccgtgacccagctgcagaacatcatcgaggccaacagccagcactaccagaagaacatcaacagcctgcaggaggagctgctgcagctgaaggccatccaccaggaggaggtgaaggagctgatgtgccagatcgaggccagcgccaaggagcacgaggccgagatcaacaagctgaacgagctgaaggagaacctggtgaagcagtgcgaggccagcgagaagaacatccagaagaagtacgagtgcgagctggagaacctgagaaaggccaccagcaacgccaaccaggacaaccagatctgcagcatcctgctgcaggagaacaccttcgtggagcaggtggtgaacgagaaggtgaagcacctggaggacaccctgaaggagctggagagccagcacagcatcctgaaggacgaggtgacctacatgaacaacctgaagctgaagctggagatggacgcccagcacatcaaggacgagttcttccacgagagagaggacctggagttcaagatcaacgagctgctgctggccaaggaggagcagggctgcgtgatcgagaagctgaagagcgagctggccggcctgaacaagcagttctgctacaccgtggagcagcacaacagagaggtgcagagcctgaaggagcagcaccagaaggagatcagcgagctgaacgagaccttcctgagcgacagctag

SEQ ID NO: 83665 - DNA, 1878 bp, Artificial Sequence
  Description of Artificial Sequence: Synthetic coding sequence
atggcccaggccctgagcgaggaggagttccagagaatgcaggcccagctgctggagctgagaaccaacaactaccagctgagcgacgagctgagaaagaacggcgtggagctgaccagcctgagacagaaggtggcctacctggacaaggagttcagcaaggcccagaaggccctgagcaagagcaagaaggcccaggaggtggaggtgctgctgagcgagaacgagatgctgcaggccaagctgcacagccaggaggaggacttcagactgcagaacagcaccctgatggccgagttcagcaaggagagatacggcaaggaggccggcaagttcagcgccgtgagcgagggccagggcgacccccccggcggccccgcccccaccgtgctggcccccatgcccctggccgaggtggagctgaagtgggagatggagaaggaggagaagagactgctgtgggagcagctgcagggcctggagagcagcaagcaggccgagaccagcagactgcaggaggagctggccaagctgagcgagaagctgaagaagaagcaggagagcttctgcagactgcagaccgagaaggagaccctgttcaacgacagcagaaacaagatcgaggagctgcagcagagaaaggaggccgaccacaaggcccagctggccagaacccagaagctgcagcaggagctggaggccgccaaccagagcctggccgagctgagagaccagagacagggcgagagactggagcacgccgccgccctgagagccctgcaggaccaggtgagcatccagagcgccgacgcccaggagcaggtggagggcctgctggccgagaacaacgccctgagaaccagcctggccgccctggagcagatccagaccgccaagacccaggagctgaacatgctgagagagcagaccaccggcctggccgccgagctgcagcagcagcaggccgagtacgaggacctgatgggccagaaggacgacctgaacagccagctgcaggagagcctgagagccaacagcagactgctggagcagctgcaggagatcggccaggagaaggagcagctgacccaggagctgcaggaggccagaaagagcgccgagaagagaaaggccatgctggacgagctggccatggagaccctgcaggagaagagccagcacaaggaggagctgggcgccgtgagactgagacacgagaaggaggtgctgggcgtgagagccagatacgagagagagctgagagagctgcacgaggacaagaagagacaggaggaggagctgagaggccagatcagagaggagaaggccagaaccagagagctggagaccctgcagcagaccgtggaggagctgcaggcccaggtgcacagcatggacggcgccaagggctggttcgagagaagactgaaggaggccgagggcaaggaggaggagctgcaggacgtgagagaccagctggagcaggcccaggaggagagagactgccacctgaagaccatcagcagcctgaagcaggaggtgaaggacaccgtggacggccagagaatcctggagaagaagggcagcgccgccctgaaggacctgaagagacagctgcacctggagagaaagagagccgacaagctgcaggagagactgcaggacatcctgaccaacagcaagagcagaagcggcctggaggagctggtgctgagcgagatgaacagccccagcagaacccagaccggcgacagcagcagcatcagcagcttcagctacagagagatcctgagagagaaggagagcagcgccgtgcccgccagagtgagaggcaaggaggagcccaccgcccccgccagcctgaaccccaagatctag

SEQ ID NO: 83666 - DNA, 2433 bp, Artificial Sequence
  Description of Artificial Sequence: Synthetic coding sequence
atggcccaggccctgagcgaggaggagttccagagaatgcaggcccagctgctggagctgagaaccaacaactaccagctgagcgacgagctgagaaagaacggcgtggagctgaccagcctgagacagaaggtggcctacctggacaaggagttcagcaaggcccagaaggccctgagcaagagcaagaaggcccaggaggtggaggtgctgctgagcgagaacgagatgctgcaggccaagctgcacagccaggaggaggacttcagactgcagaacagcaccctgatggccgagttcagcaagctgtgcagccagatggagcagctggagcaggagaaccagcagctgaaggagggcgccgccggcgccggcgtggcccaggccggccccctggtggacggcgagctgctgagactgcaggccgagaacaccgccctgcagaagaacgtggccgccctgcaggagagatacggcaaggaggccggcaagttcagcgccgtgagcgagggccagggcgacccccccggcggccccgcccccaccgtgctggcccccatgcccctggccgaggtggagctgaagtgggagatggagaaggaggagaagagactgctgtgggagcagctgcagggcctggagagcagcaagcaggccgagaccagcagactgcaggaggagctggccaagctgagcgagaagctgaagaagaagcaggagagcttctgcagactgcagaccgagaaggagaccctgttcaacgacagcagaaacaagatcgaggagctgcagcagagaaaggaggccgaccacaaggcccagctggccagaacccagaagctgcagcaggagctggaggccgccaaccagagcctggccgagctgagagaccagagacagggcgagagactggagcacgccgccgccctgagagccctgcaggaccagatccagaccgccaagacccaggagctgaacatgctgagagagcagaccaccggcctggccgccgagctgcagcagcagcaggccgagtacgaggacctgatgggccagaaggacgacctgaacagccagctgcaggagagcctgagagccaacagcagactgctggagcagctgcaggagatcggccaggagaaggagcagctgacccaggagctgcaggaggccagaaagagcgccgagaagagaaaggccatgctggacgagctggccatggagaccctgcaggagaagagccagcacaaggaggagctgggcgccgtgagactgagacacgagaaggaggtgctgggcgtgagagccagatacgagagagagctgagagagctgcacgaggacaagaagagacaggaggaggagctgagaggccagatcagagaggagaaggccagaaccagagagctggagaccctgcagcagaccgtggaggagctgcaggcccaggtgcacagcatggacggcgccaagggctggttcgagagaagactgaaggaggccgaggagagcctgcagcagcagcagcaggagcaggaggaggccctgaagcagtgcagagagcagcacgccgccgagctgaagggcaaggaggaggagctgcaggacgtgagagaccagctggagcaggcccaggaggagagagactgccacctgaagaccatcagcagcctgaagcaggaggtgaaggacaccgtggacggccagagaatcctggagaagaagggcagcgccgccctgaaggacctgaagagacagctgcacctggagagaaagagagccgacaagctgcaggagagactgcaggacatcctgaccaacagcaagagcagaagcggcctggaggagctggtgctgagcgagatgaacagccccagcagaacccagaccggcgacagcagcagcatcagcagcttcagctacagagagatcctgagagagaaggagagcagcgccgtgcccgccagaagcctgagcagcagcccccaggcccagccccccagacccgccgagctgagcgacgaggaggtggccgagctgttccagagactggccgagacccagcaggagaagtggatgctggaggagaaggtgaagcacctggaggtgagcagcgccagcatggccgaggacctgtgcagaaagagcgccatcatcgagacctacgtgatggacagcagaatcgacgtgagcgtggccgccggccacaccgacagaagcggcctgggcagcgtgctgagagacctggtgaagcccggcgacgagaacctgagagagatgaacaagaagctgcagaacatgctggaggagcagctgaccaagaacatgcacctgcacaaggacatggaggtgctgagccaggagatcgtgagactgagcaaggagtgcgtgggcccccccgaccccgacctggagcccggcgagaccagctag

SEQ ID NO: 83667 - DNA, 2526 bp, Artificial Sequence
  Description of Artificial Sequence: Synthetic coding sequence
atggcccaggccctgagcgaggaggagttccagagaatgcaggcccagctgctggagctgagaaccaacaactaccagctgagcgacgagctgagaaagaacggcgtggagctgaccagcctgagacagaaggtggcctacctggacaaggagttcagcaaggcccagaaggccctgagcaagagcaagaaggcccaggaggtggaggtgctgctgagcgagaacgagatgctgcaggccaagctgcacagccaggaggaggacttcagactgcagaacagcaccctgatggccgagttcagcaagctgtgcagccagatggagcagctggagcaggagaaccagcagctgaaggagggcgccgccggcgccggcgtggcccaggccggccccctggtggacggcgagctgctgagactgcaggccgagaacaccgccctgcagaagaacgtggccgccctgcaggagagatacggcaaggaggccggcaagttcagcgccgtgagcgagggccagggcgacccccccggcggccccgcccccaccgtgctggcccccatgcccctggccgaggtggagctgaagtgggagatggagaaggaggagaagagactgctgtgggagcagctgcagggcctggagagcagcaagcaggccgagaccagcagactgcaggaggagctggccaagctgagcgagaagctgaagaagaagcaggagagcttctgcagactgcagaccgagaaggagaccctgttcaacgacagcagaaacaagatcgaggagctgcagcagagaaaggaggccgaccacaaggcccagctggccagaacccagaagctgcagcaggagctggaggccgccaaccagagcctggccgagctgagagaccagagacagggcgagagactggagcacgccgccgccctgagagccctgcaggaccaggtgagcatccagagcgccgacgcccaggagcaggtggagggcctgctggccgagaacaacgccctgagaaccagcctggccgccctggagcagatccagaccgccaagacccaggagctgaacatgctgagagagcagaccaccggcctggccgccgagctgcagcagcagcaggccgagtacgaggacctgatgggccagaaggacgacctgaacagccagctgcaggagagcctgagagccaacagcagactgctggagcagctgcaggagatcggccaggagaaggagcagctgacccaggagctgcaggaggccagaaagagcgccgagaagagaaaggccatgctggacgagctggccatggagaccctgcaggagaagagccagcacaaggaggagctgggcgccgtgagactgagacacgagaaggaggtgctgggcgtgagagccagatacgagagagagctgagagagctgcacgaggacaagaagagacaggaggaggagctgagaggccagatcagagaggagaaggccagaaccagagagctggagaccctgcagcagaccgtggaggagctgcaggcccaggtgcacagcatggacggcgccaagggctggttcgagagaagactgaaggaggccgaggagagcctgcagcagcagcagcaggagcaggaggaggccctgaagcagtgcagagagcagcacgccgccgagctgaagggcaaggaggaggagctgcaggacgtgagagaccagctggagcaggcccaggaggagagagactgccacctgaagaccatcagcagcctgaagcaggaggtgaaggacaccgtggacggccagagaatcctggagaagaagggcagcgccgccctgaaggacctgaagagacagctgcacctggagagaaagagagccgacaagctgcaggagagactgcaggacatcctgaccaacagcaagagcagaagcggcctggaggagctggtgctgagcgagatgaacagccccagcagaacccagaccggcgacagcagcagcatcagcagcttcagctacagagagatcctgagagagaaggagagcagcgccgtgcccgccagaagcctgagcagcagcccccaggcccagccccccagacccgccgagctgagcgacgaggaggtggccgagctgttccagagactggccgagacccagcaggagaagtggatgctggaggagaaggtgaagcacctggaggtgagcagcgccagcatggccgaggacctgtgcagaaagagcgccatcatcgagacctacgtgatggacagcagaatcgacgtgagcgtggccgccggccacaccgacagaagcggcctgggcagcgtgctgagagacctggtgaagcccggcgacgagaacctgagagagatgaacaagaagctgcagaacatgctggaggagcagctgaccaagaacatgcacctgcacaaggacatggaggtgctgagccaggagatcgtgagactgagcaaggagtgcgtgggcccccccgaccccgacctggagcccggcgagaccagctag

SEQ ID NO: 83668 - DNA, 2391 bp, Artificial Sequence
  Description of Artificial Sequence: Synthetic coding sequence
atggcccaggccctgagcgaggaggagttccagagaatgcaggcccagctgctggagctgagaaccaacaactaccagctgagcgacgagctgagaaagaacggcgtggagctgaccagcctgagacagaaggtggcctacctggacaaggagttcagcaaggcccagaagctgtgcagccagatggagcagctggagcaggagaaccagcagctgaaggagggcgccgccggcgccggcgtggcccaggccggccccctggtggacggcgagctgctgagactgcaggccgagaacaccgccctgcagaagaacgtggccgccctgcaggagagatacggcaaggaggccggcaagttcagcgccgtgagcgagggccagggcgacccccccggcggccccgcccccaccgtgctggcccccatgcccctggccgaggtggagctgaagtgggagatggagaaggaggagaagagactgctgtgggagcagctgcagggcctggagagcagcaagcaggccgagaccagcagactgcaggaggagctggccaagctgagcgagaagctgaagaagaagcaggagagcttctgcagactgcagaccgagaaggagaccctgttcaacgacagcagaaacaagatcgaggagctgcagcagagaaaggaggccgaccacaaggcccagctggccagaacccagaagctgcagcaggagctggaggccgccaaccagagcctggccgagctgagagaccagagacagggcgagagactggagcacgccgccgccctgagagccctgcaggaccaggtgagcatccagagcgccgacgcccaggagcaggtggagggcctgctggccgagaacaacgccctgagaaccagcctggccgccctggagcagatccagaccgccaagacccaggagctgaacatgctgagagagcagaccaccggcctggccgccgagctgcagcagcagcaggccgagtacgaggacctgatgggccagaaggacgacctgaacagccagctgcaggagagcctgagagccaacagcagactgctggagcagctgcaggagatcggccaggagaaggagcagctgacccaggagctgcaggaggccagaaagagcgccgagaagagaaaggccatgctggacgagctggccatggagaccctgcaggagaagagccagcacaaggaggagctgggcgccgtgagactgagacacgagaaggaggtgctgggcgtgagagccagatacgagagagagctgagagagctgcacgaggacaagaagagacaggaggaggagctgagaggccagatcagagaggagaaggccagaaccagagagctggagaccctgcagcagaccgtggaggagctgcaggcccaggtgcacagcatggacggcgccaagggctggttcgagagaagactgaaggaggccgaggagagcctgcagcagcagcagcaggagcaggaggaggccctgaagcagtgcagagagcagcacgccgccgagctgaagggcaaggaggaggagctgcaggacgtgagagaccagctggagcaggcccaggaggagagagactgccacctgaagaccatcagcagcctgaagcaggaggtgaaggacaccgtggacggccagagaatcctggagaagaagggcagcgccgccctgaaggacctgaagagacagctgcacctggagagaaagagagccgacaagctgcaggagagactgcaggacatcctgaccaacagcaagagcagaagcggcctggaggagctggtgctgagcgagatgaacagccccagcagaacccagaccggcgacagcagcagcatcagcagcttcagctacagagagatcctgagagagaaggagagcagcgccgtgcccgccagaagcctgagcagcagcccccaggcccagccccccagacccgccgagctgagcgacgaggaggtggccgagctgttccagagactggccgagacccagcaggagaagtggatgctggaggagaaggtgaagcacctggaggtgagcagcgccagcatggccgaggacctgtgcagaaagagcgccatcatcgagacctacgtgatggacagcagaatcgacgtgagcgtggccgccggccacaccgacagaagcggcctgggcagcgtgctgagagacctggtgaagcccggcgacgagaacctgagagagatgaacaagaagctgcagaacatgctggaggagcagctgaccaagaacatgcacctgcacaaggacatggaggtgctgagccaggagatcgtgagactgagcaaggagtgcgtgggcccccccgaccccgacctggagcccggcgagaccagctag

SEQ ID NO: 83669 - DNA, 2433 bp, Artificial Sequence
  Description of Artificial Sequence: Synthetic coding sequence
atggcccaggccctgagcgaggaggagttccagagaatgcaggcccagctgctggagctgagaaccaacaactaccagctgagcgacgagctgagaaagaacggcgtggagctgaccagcctgagacagaaggtggcctacctggacaaggagttcagcaaggcccagaagagccccggcccctgcctgcccctgcaggaggtggaggtgctgctgagcgagaacgagatgctgcaggccaagctgcacagccaggaggaggacttcagactgcagaacagcaccctgatggccgagttcagcaagctgtgcagccagatggagcagctggagcaggagaaccagcagctgaaggagggcgccgccggcgccggcgtggcccaggccggccccctggtggacggcgagctgctgagactgcaggccgagaacaccgccctgcagaagaacgtggccgccctgcaggagagatacggcaaggaggccggcaagttcagcgccgtgagcgagggccagggcgacccccccggcggccccgcccccaccgtgctggcccccatgcccctggccgaggtggagctgaagtgggagatggagaaggaggagaagagactgctgtgggagcagctgcagggcctggagagcagcaagcaggccgagaccagcagactgcaggaggagctggccaagctgagcgagaagctgaagaagaagcaggagagcttctgcagactgcagaccgagaaggagaccctgttcaacgacagcagaaacaagatcgaggagctgcagcagagaaaggaggccgaccacaaggcccagctggccagaacccagaagctgcagcaggagctggaggccgccaaccagagcctggccgagctgagagaccagagacagggcgagagactggagcacgccgccgccctgagagccctgcaggaccagatccagaccgccaagacccaggagctgaacatgctgagagagcagaccaccggcctggccgccgagctgcagcagcagcaggccgagtacgaggacctgatgggccagaaggacgacctgaacagccagctgcaggagagcctgagagccaacagcagactgctggagcagctgcaggagatcggccaggagaaggagcagctgacccaggagctgcaggaggccagaaagagcgccgagaagagaaaggccatgctggacgagctggccatggagaccctgcaggagaagagccagcacaaggaggagctgggcgccgtgagactgagacacgagaaggaggtgctgggcgtgagagccagatacgagagagagctgagagagctgcacgaggacaagaagagacaggaggaggagctgagaggccagatcagagaggagaaggccagaaccagagagctggagaccctgcagcagaccgtggaggagctgcaggcccaggtgcacagcatggacggcgccaagggctggttcgagagaagactgaaggaggccgaggagagcctgcagcagcagcagcaggagcaggaggaggccctgaagcagtgcagagagcagcacgccgccgagctgaagggcaaggaggaggagctgcaggacgtgagagaccagctggagcaggcccaggaggagagagactgccacctgaagaccatcagcagcctgaagcaggaggtgaaggacaccgtggacggccagagaatcctggagaagaagggcagcgccgccctgaaggacctgaagagacagctgcacctggagagaaagagagccgacaagctgcaggagagactgcaggacatcctgaccaacagcaagagcagaagcggcctggaggagctggtgctgagcgagatgaacagccccagcagaacccagaccggcgacagcagcagcatcagcagcttcagctacagagagatcctgagagagaaggagagcagcgccgtgcccgccagaagcctgagcagcagcccccaggcccagccccccagacccgccgagctgagcgacgaggaggtggccgagctgttccagagactggccgagacccagcaggagaagtggatgctggaggagaaggtgaagcacctggaggtgagcagcgccagcatggccgaggacctgtgcagaaagagcgccatcatcgagacctacgtgatggacagcagaatcgacgtgagcgtggccgccggccacaccgacagaagcggcctgggcagcgtgctgagagacctggtgaagcccggcgacgagaacctgagagagatgaacaagaagctgcagaacatgctggaggagcagctgaccaagaacatgcacctgcacaaggacatggaggtgctgagccaggagatcgtgagactgagcaaggagtgcgtgggcccccccgaccccgacctggagcccggcgagaccagctag

SEQ ID NO: 83670 - DNA, 1425 bp, Artificial Sequence
  Description of Artificial Sequence: Synthetic coding sequence
atgaagagagtgctggtgctgctgctggccgtggccttcggccacgccctggagagaggcagagactacgagaagaacaaggtgtgcaaggagttcagccacctgggcaaggaggacttcaccagcctgagcctggtgctgtacagcagaaagttccccagcggcaccttcgagcaggtgagccagctggtgaaggaggtggtgagcctgaccgaggcctgctgcgccgagggcgccgaccccgactgctacgacaccagaaccagcgccctgagcgccaagagctgcgagagcaacagccccttccccgtgcaccccggcaccgccgagtgctgcaccaaggagggcctggagagaaagctgtgcatggccgccctgaagcaccagccccaggagttccccacctacgtggagcccaccaacgacgagatctgcgaggccttcagaaaggaccccaaggagtacgccaaccagttcatgtgggagtacagcaccaactacggccaggcccccctgagcctgctggtgagctacaccaagagctacctgagcatggtgggcagctgctgcaccagcgccagccccaccgtgtgcttcctgaaggagagactgcagctgaagcacctgagcctgctgaccaccctgagcaacagagtgtgcagccagtacgccgcctacggcgagaagaagagcagactgagcaacctgatcaagctggcccagaaggtgcccaccgccgacctggaggacgtgctgcccctggccgaggacatcaccaacatcctgagcaagtgctgcgagagcgccagcgaggactgcatggccaaggagctgcccgagcacaccgtgaagctgtgcgacaacctgagcaccaagaacagcaagttcgaggactgctgccaggagaagaccgccatggacgtgttcgtgtgcacctacttcatgcccgccgcccagctgcccgagctgcccgacgtggagctgcccaccaacaaggacgtgtgcgaccccggcaacaccaaggtgatggacaagtacaccttcgagctgagcagaagaacccacctgcccgaggtgttcctgagcaaggtgctggagcccaccctgaagagcctgggcgagtgctgcgacgtggaggacagcaccacctgcttcaacgccaagggccccctgctgaagaaggagctgagcagcttcatcgacaagggccaggagctgtgcgccgactacagcgagaacaccttcaccgagtacaagaagaagctggccgagagactgaaggccaagctgcccgacgccacccccaccgagctggccaagctggtgaacaagcacagcgacttcgccagcaactgctgcagcatcaacagcccccccctgtactgcgacagcgagatcgacgccgagctgaagaacatcctgtag

SEQ ID NO: 83671 - DNA, 438 bp, Artificial Sequence
  Description of Artificial Sequence: Synthetic coding sequence
atgaagagagtgctggtgctgctgctggccgtggccttcggccacgccctggagagaggcagagactacgagaagaacaaggtgtgcaaggagttcagccacctgggcaaggaggacttcaccagcctgagcctggtgctgtacagcagaaagttccccagcggcaccttcgagcaggtgagccagctggtgaaggaggtggtgagcctgaccgaggcctgctgcgccgagggcgccgaccccgactgctacgacaccagaaccagcgccctgagcgccaagagctgcgagagcaacagccccttccccgtgcaccccggcaccgccgagtgctgcaccaaggagggcctggagagaaagctgtgcatggccgccctgaagcaccagccccaggagttccccacctacgtggagcccaccaacgacgagatctgctag

SEQ ID NO: 83672 - DNA, 1482 bp, Artificial Sequence
  Description of Artificial Sequence: Synthetic coding sequence
atgctgtggagctggagcgaggagagaggcggcgccgccagactgagcggcagaaagatgaagagagtgctggtgctgctgctggccgtggccttcggccacgccctggagagaggcagagactacgagaagaacaaggtgtgcaaggagttcagccacctgggcaaggaggacttcaccagcctgagcctggtgctgtacagcagaaagttccccagcggcaccttcgagcaggtgagccagctggtgaaggaggtggtgagcctgaccgaggcctgctgcgccgagggcgccgaccccgactgctacgacaccagaaccagcgccctgagcgccaagagctgcgagagcaacagccccttccccgtgcaccccggcaccgccgagtgctgcaccaaggagggcctggagagaaagctgtgcatggccgccctgaagcaccagccccaggagttccccacctacgtggagcccaccaacgacgagatctgcgaggccttcagaaaggaccccaaggagtacgccaaccagttcatgtgggagtacagcaccaactacggccaggcccccctgagcctgctggtgagctacaccaagagctacctgagcatggtgggcagctgctgcaccagcgccagccccaccgtgtgcttcctgaaggagagactgcagctgaagcacctgagcctgctgaccaccctgagcaacagagtgtgcagccagtacgccgcctacggcgagaagaagagcagactgagcaacctgatcaagctggcccagaaggtgcccaccgccgacctggaggacgtgctgcccctggccgaggacatcaccaacatcctgagcaagtgctgcgagagcgccagcgaggactgcatggccaaggagctgcccgagcacaccgtgaagctgtgcgacaacctgagcaccaagaacagcaagttcgaggactgctgccaggagaagaccgccatggacgtgttcgtgtgcacctacttcatgcccgccgcccagctgcccgagctgcccgacgtggagctgcccaccaacaaggacgtgtgcgaccccggcaacaccaaggtgatggacaagtacaccttcgagctgagcagaagaacccacctgcccgaggtgttcctgagcaaggtgctggagcccaccctgaagagcctgggcgagtgctgcgacgtggaggacagcaccacctgcttcaacgccaagggccccctgctgaagaaggagctgagcagcttcatcgacaagggccaggagctgtgcgccgactacagcgagaacaccttcaccgagtacaagaagaagctggccgagagactgaaggccaagctgcccgacgccacccccaccgagctggccaagctggtgaacaagcacagcgacttcgccagcaactgctgcagcatcaacagcccccccctgtactgcgacagcgagatcgacgccgagctgaagaacatcctgtag

SEQ ID NO: 83673 - DNA, 669 bp, Artificial Sequence
  Description of Artificial Sequence: Synthetic coding sequence
atggccgccagcgtgagacaggccagaagcctgctgggcgtggccgccaccctggcccccggcagcagaggctacagagccagacccccccccagaagaagacccggccccagatggcccgaccccgaggacctgctgacccccagatggcagctgggccccagatacgccgccaagcagttcgccagatacggcgccgccagcggcgtggtgcccggcagcctgtggcccagccccgagcagctgagagagctggaggccgaggagagagagtggtaccccagcctggccaccatgcaggagagcctgagagtgaagcagctggccgaggagcagaagagaagagagagagagcagcacatcgccgagtgcatggccaagatgccccagatgatcgtgaactggcagcagcagcagagagagaactgggagaaggcccaggccgacaaggagagaagagccagactgcaggccgaggcccaggagctgctgggctaccaggtggaccccagaagcgccagattccaggagctgctgcaggacctggagaagaaggagagaaagagactgaaggaggagaagcagaagagaaagaaggaggccagagccgccgccctggccgccgccgtggcccaggaccccgccgccagcggcgcccccagcagctag

SEQ ID NO: 83674 - DNA, 1038 bp, Artificial Sequence
  Description of Artificial Sequence: Synthetic coding sequence
atggtggccgccctgctgggcggcggcggcgaggccagaggcggcaccgtgcccggcgcctggctgtgcctgatggccctgctgcagctgctgggcagcgcccccagaggcagcggcctggcccacggcagaagactgatctgctggcaggccctgctgcagtgccagggcgagcccgagtgcagctacgcctacaaccagtacgccgaggcctgcgcccccgtgctggcccagcacggcggcggcgacgcccccggcgccgccgccgccgccttccccgccagcgccgccagcttcagcagcagatggagatgccccagccactgcatcagcgccctgatccagctgaaccacaccagaagaggccccgccctggaggactgcgactgcgcccaggacgagaactgcaagagcaccaagagagccatcgagccctgcctgcccagaaccagcggcggcggcgccggcggccccggcgccggcggcgtgatgggctgcaccgaggccagaagaagatgcgacagagacagcagatgcaacctggccctgagcagatacctgacctactgcggcaaggtgttcaacggcctgagatgcaccgacgagtgcagaaccgtgatcgaggacatgctggccatgcccaaggccgccctgctgaacgactgcgtgtgcgacggcctggagagacccatctgcgagagcgtgaaggagaacatggccagactgtgcttcggcgccgagctgggcaacggccccggcagcagcggcagcgacggcggcctggacgactactacgacgaggactacgacgacgagcagagaaccggcggcgccggcggcgagcagcccctggacgacgacgacggcgtgccccacccccccagacccggcagcggcgccgccgccagcggcggcagaggcgacctgccctacggccccggcagaagaagcagcggcggcggcggcagactggcccccagaggcgcctggacccccctggccagcatcctgctgctgctgctgggccccctgttctag

SEQ ID NO: 83675 - DNA, 942 bp, Artificial Sequence
  Description of Artificial Sequence: Synthetic coding sequence
atgtgcaccgccctgagccccaaggtgagaagcggccccggcctgagcgacatgcaccagtacagccagtggctggccagcagacacgaggccaacctgctgcccatgaaggaggacctggccctgtggctgaccaacctgctgggcaaggagatcaccgccgagaccttcatggagaagctggacaacggcgccctgctgtgccagctggccgagaccatgcaggagaagttcaaggagagcatggacgccaacaagcccaccaagaacctgcccctgaagaagatcccctgcaagaccagcgcccccagcggcagcttcttcgccagagacaacaccgccaacttcctgagctggtgcagagacctgggcgtggacgagacctgcctgttcgagagcgagggcctggtgctgcacaagcagcccagagaggtgtgcctgtgcctgctggagctgggcagaatcgccgccagatacggcgtggagccccccggcctgatcaagctggagaaggagatcgagcaggaggagaccctgagcgcccccagccccagccccagccccagcagcaagagcagcggcaagaagagcaccggcaacctgctggacgacgccgtgaagagaatcagcgaggaccccccctgcaagtgccccaacaagttctgcgtggagagactgagccagggcagatacagagtgggcgagaagatcctgttcatcagaatgctgcacaacaagcacgtgatggtgagagtgggcggcggctgggagaccttcgccggctacctgctgaagcacgacccctgcagaatgctgcagatcagcagagtggacggcaagaccagccccatccagagcaagagccccaccctgaaggacatgaaccccgacaactacctggtggtgagcgccagctacaaggccaagaaggagatcaagtag

SEQ ID NO: 83676 - DNA, 942 bp, Artificial Sequence; identical to SEQ ID NO: 83675
  Description of Artificial Sequence: Synthetic coding sequence

SEQ ID NO: 83677 - DNA, 942 bp, Artificial Sequence; identical to SEQ ID NO: 83675
  Description of Artificial Sequence: Synthetic coding sequence

SEQ ID NO: 83678 - DNA, 546 bp, Artificial Sequence
  Description of Artificial Sequence: Synthetic coding sequence
atgtgcaccgccctgagccccaaggtgagaagcggccccggcctgagcgacatgcaccagtacagccagtggctggccagcagacacgaggccaacctgctgcccatgaaggaggacctggccctgtggctgaccaacctgctgggcaaggagatcaccgccgagaccttcatggagaagctggacaacggcgccctgctgtgccagctggccgagaccatgcaggagaagttcaaggagagcatggacgccaacaagcccaccaagaacctgcccctgaagaagatcccctgcaagaccagcgcccccagcggcagcttcttcgccagagacaacaccgccaacttcctgagctggtgcagagacctgggcgtggacgagacctgcctgttcgagagcgagggcctggtgctgcacaagcagcccagagaggtgtgcctgtgcctgctggagctgggcagaatcgccgccagatacggcgtggagccccccggcctgatcaagctggagaaggagatcgagcaggaggagaccctgagcgcctag

SEQ ID NO: 83679 - DNA, 618 bp, Artificial Sequence
  Description of Artificial Sequence: Synthetic coding sequence
atgtgcaccgccctgagccccaaggtgagaagcggccccggcctgagcgacatgcaccagtacagccagtggctggccagcagacacgaggccaacctgctgcccatgaaggaggacctggccctgtggctgaccaacctgctgggcaaggagatcaccgccgagaccttcatggagaagctggacaacggcgccctgctgtgccagctggccgagaccatgcaggagaagttcaaggagagcatggacgccaacaagcccaccaagaacctgcccctgaagaagatcccctgcaagaccagcgcccccagcggcagcttcttcgccagagacaacaccgccaacttcctgagctggtgcagagacctgggcgtggacgagacctgcctgttcgagagcgagggcctggtgctgcacaagcagcccagagaggtgtgcctgtgcctgctggagctgggcagaatcgccgccagatacggcgtggagccccccggcctgatcaagctggagaaggagatcgagcaggaggagaccctgagcgcccccagccccagccccagccccagcagcaagagcagcggcaagaagagcaccggcaacctgctggacgacgcctag

SEQ ID NO: 83680 - DNA, 411 bp, Artificial Sequence
  Description of Artificial Sequence: Synthetic coding sequence
atgtgcaccgccctgagccccaaggtgagaagcggccccggcctgagcgacatgcaccagtacagccagtggctggccagcagacacgaggccaacctgctgcccatgaaggaggacctggccctgtggctgaccaacctgctgggcaaggagatcaccgccgagaccttcatggagaagctggacaacggcgccctgctgtgccagctggccgagaccatgcaggagaagttcaaggagagcatggacgccaacaagcccaccaagaacctgcccctgaagaagatcccctgcaagaccagcgcccccagcggcagcttcttcgccagagacaacaccgccaacttcctgagctggtgcagagacctgggcgtggacgagacctgcctgttcgagagcgagggcctgtag

SEQ ID NO: 83681 - DNA, 468 bp, Artificial Sequence
  Description of Artificial Sequence: Synthetic coding sequence
atgtgcaccgccctgagccccaaggtgagaagcggccccggcctgagcgacatgcaccagtacagccagtggctggccagcagacacgaggccaacctgctgcccatgaaggaggacctggccctgtggctgaccaacctgctgggcaaggagatcaccgccgagaccttcatggagaagctggacaacggcgccctgctgtgccagctggccgagaccatgcaggagaagttcaaggagagcatggacgccaacaagcccaccaagaacctgcccctgaagaagatcccctgcaagaccagcgcccccagcggcagcttcttcgccagagacaacaccgccaacttcctgagctggtgcagagacctgggcgtggacgagacctgcctgttcgagagcgagggcctggtgctgcacaagcagcccagagaggtgtgcctgtgcctgctggagctgggcagaatctag

SEQ ID NO: 83682 - DNA, 2043 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtgcctgctggaggtggccagaagaggcgccagactgggcctgctggcccccagactggtgcagttcgagcaggagatcgagagagagctgagagccgccccccccgcccccaacgcccccgccgccggcgaggacaccaccgagaccgcccccgcccccggcacccccgccagaggccccagaatgacccccagcgacctgagaaacctggacgagctggtgagagagatcctgggcagatgcacctgccccgaccagttccccatgatcaaggtgagcgagggcaagtacagagtgggcgacagcagcctgctgatcttcgtgagagtgctgagaagccacgtgatggtgagagtgggcggcggctgggacaccctggagcactacctggacaagcacgacccctgcagatgcagcagcaccgcccacagacccccccagcccagagtgtgcaccttcagcccccagagagtgagccccaccaccagccccagacccgccagccccgtgcccggcagcgagagaagaggcagcagacccgagatgacccccgtgagcctgagaagcaccaaggagggccccgagaccccccccagacccagagaccagctgcccccccaccccagaagcagaagatacagcggcgacagcgacagcagcgccagcagcgcccagagcggccccctgggcaccagaagcgacgacaccggcaccggccccagaagagagagacccagcagaagactgaccaccggcacccccgccagccccagaagaccccccctgagaagccagagcagagacagactggacagaggcagacccagaggcgcccccggcggcagaggcgcccagctgagcgtgcccagccccgccagaagagccagaagccagagcagagaggagcaggccgtgctgctggtgagaagagacagagacggccagcacagctgggtgcccagaggcagaggcagcggcggcagcggcagaagcaccccccagacccccagagccagaagccccgccgcccccagactgagcagagtgagcagccccagccccgagctgggcaccacccccgccagcatcttcagaacccccctgcagctggacccccagcaggagcagcagctgttcagaagactggaggaggagttcctggccaacgccagagccctggaggccgtggccagcgtgacccccaccggccccgcccccgaccccgccagagcccccgacccccccgcccccgacagcgcctactgcagcagcagcagcagcagcagcagcctgagcgtgctgggcggcaagtgcggccagcccggcgacagcggcagaaccgccaacggcctgcccggccccagaagccaggccctgagcagcagcagcgacgagggcagcccctgccccggcatgggcggccccctggacgcccccggcagccccctggcctgcaccgagcccagcagaacctgggccagaggcagaatggacacccagcccgacagaaagcccagcagaatccccacccccagaggccccagaagacccagcggccccgccgagctgggcacctggcacgccctgcacagcgtgacccccagagccgagcccgacagctggatgtag

SEQ ID NO: 83683 - DNA, 1014 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtgcctgctggaggtggccagaagaggcgccagactgggcctgctggcccccagactggtgcagttcgagcaggagatcgagagagagctgagagccgccccccccgcccccaacgcccccgccgccggcgaggacaccaccgagaccgcccccgcccccggcacccccgccagaggccccagaatgacccccagcgacctgagaaacctggacgagctggtgagagagatcctgggcagatgcacctgccccgaccagttccccatgatcaaggtgagcgagggcaagtacagagtgggcgacagcagcctgctgatcttcgtgagagtgctgagaagccacgtgatggtgagagtgggcggcggctgggacaccctggagcactacctggacaagcacgacccctgcagatgcagcagcaccgcccacagacccccccagcccagagtgtgcaccttcagcccccagagagtgagccccaccaccagccccagacccgccagccccgtgcccggcagcgagagaagaggcagcagacccgagatgacccccgtgagcctgagaagcaccaaggagggccccgagaccccccccagatag

SEQ ID NO: 83684 - DNA, 990 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtgcctgctggaggtggccagaagaggcgccagactgggcctgctggcccccagactggtgcagttcgagcaggagatcgagagagagctgagagccgccccccccgcccccaacgcccccgccgccggcgaggacaccaccgagaccgcccccgcccccggcacccccgccagaggccccagaatgacccccagcgacctgagaaacctggacgagctggtgagagagatcctgggcagatgcacctgccccgaccagttccccatgatcaaggtgagcgagggcaagtacagagtgggcgacagcagcctgctgatcttcgtgagagtgctgagaagccacgtgatggtgagagtgggcggcggctgggacaccctggagcactacctggacaagcacgacccctgcagatgcagcagcaccggccccggcatcagctgcccccccatccccgcccccgccgccacccccggcaccgtgaccccccagccccccccccccagagccgcccccctggtgcccgccgtgatgacccaggccctggcccccggcggcagcgaccccgccggcggctag

SEQ ID NO: 83685 - DNA, 1614 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtgcctgctggaggtggccagaagaggcgccagactgggcctgctggcccccagactggtgcagttcgagcaggagatcgagagagagctgagagccgccccccccgcccccaacgcccccgccgccggcgaggacaccaccgagaccgcccccgcccccggcacccccgccagaggccccagaatgacccccagcgacctgagaaacctggacgagctggtgagagagatcctgggcagatgcacctgccccgaccagttccccatgatcaaggtgagcgagggcaagtacagagtgggcgacagcagcctgctgatcttcgtgagagtgctgagaagccacgtgatggtgagagtgggcggcggctgggacaccctggagcactacctggacaagcacgacccctgcagatgcagcagcaccgcccacagacccccccagcccagagtgtgcaccttcagcccccagagagtgagccccaccaccagccccagacccgccagccccgtgcccggcagcgagagaagaggcagcagacccgagatgacccccgtgagcctgagaagcaccaaggagggccccgagaccccccccagacccagagaccagctgcccccccaccccagaagcagaagatacagcggcgacagcgacagcagcgccagcagcgcccagagcggccccctgggcaccagaagcgacgacaccggcaccggccccagaagagagagacccagcagaagactgaccaccggcacccccgccagccccagaagaccccccgcctgcgccgccagccccgagaccggctggatcgccgccggccccggcggcccccaggaggccggcgagcccagctgcagaagccccgccctgcccggcggccccggcgccagagccgccagaagcagactgtgctgcctgtgcgccggcatcgagaccggcagcacccacggctgccagggcgccggcgccgtgggcgccagagccggcgccccccccagactgcccgtgcccgccgccctgcagcaccccggcttccccggcagccccgcccccgtgcagagctgggccccccacagacccgccagcagcgcccacccctgcagcagcaccagaagcagaagcagcagctgcagcggcgcctggaagagaagcagctggcccatgcccggccccctgagactgctgctggcctag

SEQ ID NO: 83686 - DNA, 1614 bp, Artificial Sequence; identical to SEQ ID NO: 83685
  Description of Artificial Sequence: Synthetic coding sequence

SEQ ID NO: 83687 - DNA, 1614 bp, Artificial Sequence; identical to SEQ ID NO: 83685
  Description of Artificial Sequence: Synthetic coding sequence

SEQ ID NO: 83688 - DNA, 417 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtag

SEQ ID NO: 83689 - DNA, 432 bp, Artificial Sequence
  Description of Artificial Sequence: Synthetic coding sequence
atggccgaccccgtggccggcatcgccggcagcgccgccaagagcgtgagacccttcagaagcagcgaggcctacgtggaggccatgaaggaggacctggccgagtggctgaacgccctgtacggcctgggcctgcccggcggcggcgacggcttcctgaccggcctggccaccggcaccaccctgtgccagcacgccaacgccgtgaccgaggccgccagagccctggccgccgccagacccgccagaggcgtggccttccaggcccacagcgtggtgcccggcagcttcatggccagagacaacgtggccaccttcatcggctggtgcagagtggagctgggcgtgcccgaggtgctgatgttcgagaccgaggacctggtgctgagaaagaacgagaagagcgtggtgctgtgcctgctggaggtgtag

SEQ ID NO: 83690 - DNA, 1614 bp, Artificial Sequence; identical to SEQ ID NO: 83685
  Description of Artificial Sequence: Synthetic coding sequence

SEQ ID NO: 83691 - DNA, 2037 bp, Artificial Sequence
  Description of Artificial Sequence: Synthetic coding sequence
atggcccccagcctgagccccggccccgccgccctgagaagagccccccagctgctgctgctgctgctggccgccgagtgcgccctggccgccctgctgcccgccagagaggccacccagttcctgagacccagacagagaagagccttccaggtgttcgaggaggccaagcagggccacctggagagagagtgcgtggaggagctgtgcagcagagaggaggccagagaggtgttcgagaacgaccccgagaccgactacttctaccccagatacctggactgcatcaacaagtacggcagcccctacaccaagaacagcggcttcgccacctgcgtgcagaacctgcccgaccagtgcacccccaacccctgcgacagaaagggcacccaggcctgccaggacctgatgggcaacttcttctgcctgtgcaaggccggctggggcggcagactgtgcgacaaggacgtgaacgagtgcagccaggagaacggcggctgcctgcagatctgccacaacaagcccggcagcttccactgcagctgccacagcggcttcgagctgagcagcgacggcagaacctgccaggacatcgacgagtgcgccgacagcgaggcctgcggcgaggccagatgcaagaacctgcccggcagctacagctgcctgtgcgacgagggcttcgcctacagcagccaggagaaggcctgcagagacgtggacgagtgcctgcagggcagatgcgagcaggtgtgcgtgaacagccccggcagctacacctgccactgcgacggcagaggcggcctgaagctgagccaggacatggacacctgcgaggacatcctgccctgcgtgcccttcagcgtggccaagagcgtgaagagcctgtacctgggcagaatgttcagcggcacccccgtgatcagactgagattcaagagactgcagcccaccagactggtggccgagttcgacttcagaaccttcgaccccgagggcatcctgctgttcgccggcggccaccaggacagcacctggatcgtgctggccctgagagccggcagactggagctgcagctgagatacaacggcgtgggcagagtgaccagcagcggccccgtgatcaaccacggcatgtggcagaccatcagcgtggaggagctggccagaaacctggtgatcaaggtgaacagagacgccgtgatgaagatcgccgtggccggcgacctgttccagcccgagagaggcctgtaccacctgaacctgaccgtgggcggcatccccttccacgagaaggacctggtgcagcccatcaaccccagactggacggctgcatgagaagctggaactggctgaacggcgaggacaccaccatccaggagaccgtgaaggtgaacaccagaatgcagtgcttcagcgtgaccgagagaggcagcttctaccccggcagcggcttcgccttctacagcctggactacatgagaacccccctggacgtgggcaccgagagcacctgggaggtggaggtggtggcccacatcagacccgccgccgacaccggcgtgctgttcgccctgtgggcccccgacctgagagccgtgcccctgagcgtggccctggtggactaccacagcaccaagaagctgaagaagcagctggtggtgctggccgtggagcacaccgccctggccctgatggagatcaaggtgtgcgacggccaggagcacgtggtgaccgtgagcctgagagacggcgaggccaccctggaggtggacggcaccagaggccagagcgaggtgagcgccgcccagctgcaggagagactggccgtgctggagagacacctgagaagccccgtgctgaccttcgccggcggcctgcccgacgtgcccgtgaccagcgcccccgtgaccgccttctacagaggctgcatgaccctggaggtgaacagaagactgctggacctggacgaggccgcctacaagcacagcgacatcaccgcccacagctgcccccccgtggagcccgccgccgcctag

SEQ ID NO: 83692 - DNA, 1875 bp, Artificial Sequence
  Description of Artificial Sequence: Synthetic coding sequence
atgtgcatgtgccaggccagccccccccccgccgccctggccggctgcctgctgagcagctgcgtgcagcccgccagagagcacggcggcgccttcagcaaggccgagtggctgagcaactgcatcaacaagtacggcagcccctacaccaagaacagcggcttcgccacctgcgtgcagaacctgcccgaccagtgcacccccaacccctgcgacagaaagggcacccaggcctgccaggacctgatgggcaacttcttctgcctgtgcaaggccggctggggcggcagactgtgcgacaaggacgtgaacgagtgcagccaggagaacggcggctgcctgcagatctgccacaacaagcccggcagcttccactgcagctgccacagcggcttcgagctgagcagcgacggcagaacctgccaggacatcgacgagtgcgccgacagcgaggcctgcggcgaggccagatgcaagaacctgcccggcagctacagctgcctgtgcgacgagggcttcgcctacagcagccaggagaaggcctgcagagacgtggacgagtgcctgcagggcagatgcgagcaggtgtgcgtgaacagccccggcagctacacctgccactgcgacggcagaggcggcctgaagctgagccaggacatggacacctgcgaggacatcctgccctgcgtgcccttcagcgtggccaagagcgtgaagagcctgtacctgggcagaatgttcagcggcacccccgtgatcagactgagattcaagagactgcagcccaccagactggtggccgagttcgacttcagaaccttcgaccccgagggcatcctgctgttcgccggcggccaccaggacagcacctggatcgtgctggccctgagagccggcagactggagctgcagctgagatacaacggcgtgggcagagtgaccagcagcggccccgtgatcaaccacggcatgtggcagaccatcagcgtggaggagctggccagaaacctggtgatcaaggtgaacagagacgccgtgatgaagatcgccgtggccggcgacctgttccagcccgagagaggcctgtaccacctgaacctgaccgtgggcggcatccccttccacgagaaggacctggtgcagcccatcaaccccagactggacggctgcatgagaagctggaactggctgaacggcgaggacaccaccatccaggagaccgtgaaggtgaacaccagaatgcagtgcttcagcgtgaccgagagaggcagcttctaccccggcagcggcttcgccttctacagcctggactacatgagaacccccctggacgtgggcaccgagagcacctgggaggtggaggtggtggcccacatcagacccgccgccgacaccggcgtgctgttcgccctgtgggcccccgacctgagagccgtgcccctgagcgtggccctggtggactaccacagcaccaagaagctgaagaagcagctggtggtgctggccgtggagcacaccgccctggccctgatggagatcaaggtgtgcgacggccaggagcacgtggtgaccgtgagcctgagagacggcgaggccaccctggaggtggacggcaccagaggccagagcgaggtgagcgccgcccagctgcaggagagactggccgtgctggagagacacctgagaagccccgtgctgaccttcgccggcggcctgcccgacgtgcccgtgaccagcgcccccgtgaccgccttctacagaggctgcatgaccctggaggtgaacagaagactgctggacctggacgaggccgcctacaagcacagcgacatcaccgcccacagctgcccccccgtggagcccgccgccgcctag

SEQ ID NO: 83693 - DNA, 2166 bp, Artificial Sequence
  Description of Artificial Sequence: Synthetic coding sequence
atggcccccagcctgagccccggccccgccgccctgagaagagccccccagctgctgctgctgctgctggccgccgagtgcgccctggccgccctgctgcccgccagagaggccacccagttcctgagacccagacagagaagagccttccaggtgttcgaggaggccaagcagggccacctggagagagagtgcgtggaggagctgtgcagcagagaggaggccagagaggtgttcgagaacgaccccgagaccgactacttctaccccagatacctggactgcatcaacaagtacggcagcccctacaccaagaacagcggcttcgccacctgcgtgcagaacctgcccgaccagtgcacccccaacccctgcgacagaaagggcacccaggcctgccaggacctgatgggcaacttcttctgcctgtgcaaggccggctggggcggcagactgtgcgacaaggacgtgaacgagtgcagccaggagaacggcggctgcctgcagatctgccacaacaagcccggcagcttccactgcagctgccacagcggcttcgagctgagcagcgacggcagaacctgccaggacatcgacgagtgcgccgacagcgaggcctgcggcgaggccagatgcaagaacctgcccggcagctacagctgcctgtgcgacgagggcttcgcctacagcagccaggagaaggcctgcagagacgtggacgagtgcctgcagggcagatgcgagcaggtgtgcgtgaacagccccggcagctacacctgccactgcgacggcagaggcggcctgaagctgagccaggacatggacacctgcgagctggaggccggctggcccctgcccagacacagaagagacagcggccccgccgccagacccggcagaggcgcccagggcagcagaagcgagggccacatccccgacagaagaggccccagaccctggcaggacatcctgccctgcgtgcccttcagcgtggccaagagcgtgaagagcctgtacctgggcagaatgttcagcggcacccccgtgatcagactgagattcaagagactgcagcccaccagactggtggccgagttcgacttcagaaccttcgaccccgagggcatcctgctgttcgccggcggccaccaggacagcacctggatcgtgctggccctgagagccggcagactggagctgcagctgagatacaacggcgtgggcagagtgaccagcagcggccccgtgatcaaccacggcatgtggcagaccatcagcgtggaggagctggccagaaacctggtgatcaaggtgaacagagacgccgtgatgaagatcgccgtggccggcgacctgttccagcccgagagaggcctgtaccacctgaacctgaccgtgggcggcatccccttccacgagaaggacctggtgcagcccatcaaccccagactggacggctgcatgagaagctggaactggctgaacggcgaggacaccaccatccaggagaccgtgaaggtgaacaccagaatgcagtgcttcagcgtgaccgagagaggcagcttctaccccggcagcggcttcgccttctacagcctggactacatgagaacccccctggacgtgggcaccgagagcacctgggaggtggaggtggtggcccacatcagacccgccgccgacaccggcgtgctgttcgccctgtgggcccccgacctgagagccgtgcccctgagcgtggccctggtggactaccacagcaccaagaagctgaagaagcagctggtggtgctggccgtggagcacaccgccctggccctgatggagatcaaggtgtgcgacggccaggagcacgtggtgaccgtgagcctgagagacggcgaggccaccctggaggtggacggcaccagaggccagagcgaggtgagcgccgcccagctgcaggagagactggccgtgctggagagacacctgagaagccccgtgctgaccttcgccggcggcctgcccgacgtgcccgtgaccagcgcccccgtgaccgccttctacagaggctgcatgaccctggaggtgaacagaagactgctggacctggacgaggccgcctacaagcacagcgacatcaccgcccacagctgcccccccgtggagcccgccgccgcctag

SEQ ID NO: 83694 - DNA, 1140 bp, Artificial Sequence
  Description of Artificial Sequence: Synthetic coding sequence
atgttcagcggcacccccgtgatcagactgagattcaagagactgcagcccaccagactggtggccgagttcgacttcagaaccttcgaccccgagggcatcctgctgttcgccggcggccaccaggacagcacctggatcgtgctggccctgagagccggcagactggagctgcagctgagatacaacggcgtgggcagagtgaccagcagcggccccgtgatcaaccacggcatgtggcagaccatcagcgtggaggagctggccagaaacctggtgatcaaggtgaacagagacgccgtgatgaagatcgccgtggccggcgacctgttccagcccgagagaggcctgtaccacctgaacctgaccgtgggcggcatccccttccacgagaaggacctggtgcagcccatcaaccccagactggacggctgcatgagaagctggaactggctgaacggcgaggacaccaccatccaggagaccgtgaaggtgaacaccagaatgcagtgcttcagcgtgaccgagagaggcagcttctaccccggcagcggcttcgccttctacagcctggactacatgagaacccccctggacgtgggcaccgagagcacctgggaggtggaggtggtggcccacatcagacccgccgccgacaccggcgtgctgttcgccctgtgggcccccgacctgagagccgtgcccctgagcgtggccctggtggactaccacagcaccaagaagctgaagaagcagctggtggtgctggccgtggagcacaccgccctggccctgatggagatcaaggtgtgcgacggccaggagcacgtggtgaccgtgagcctgagagacggcgaggccaccctggaggtggacggcaccagaggccagagcgaggtgagcgccgcccagctgcaggagagactggccgtgctggagagacacctgagaagccccgtgctgaccttcgccggcggcctgcccgacgtgcccgtgaccagcgcccccgtgaccgccttctacagaggctgcatgaccctggaggtgaacagaagactgctggacctggacgaggccgcctacaagcacagcgacatcaccgcccacagctgcccccccgtggagcccgccgccgcctag

SEQ ID NO: 83695 - DNA, 1218 bp, Artificial Sequence
  Description of Artificial Sequence: Synthetic coding sequence
atggacacctgcgaggacatcctgccctgcgtgcccttcagcgtggccaagagcgtgaagagcctgtacctgggcagaatgttcagcggcacccccgtgatcagactgagattcaagagactgcagcccaccagactggtggccgagttcgacttcagaaccttcgaccccgagggcatcctgctgttcgccggcggccaccaggacagcacctggatcgtgctggccctgagagccggcagactggagctgcagctgagatacaacggcgtgggcagagtgaccagcagcggccccgtgatcaaccacggcatgtggcagaccatcagcgtggaggagctggccagaaacctggtgatcaaggtgaacagagacgccgtgatgaagatcgccgtggccggcgacctgttccagcccgagagaggcctgtaccacctgaacctgaccgtgggcggcatccccttccacgagaaggacctggtgcagcccatcaaccccagactggacggctgcatgagaagctggaactggctgaacggcgaggacaccaccatccaggagaccgtgaaggtgaacaccagaatgcagtgcttcagcgtgaccgagagaggcagcttctaccccggcagcggcttcgccttctacagcctggactacatgagaacccccctggacgtgggcaccgagagcacctgggaggtggaggtggtggcccacatcagacccgccgccgacaccggcgtgctgttcgccctgtgggcccccgacctgagagccgtgcccctgagcgtggccctggtggactaccacagcaccaagaagctgaagaagcagctggtggtgctggccgtggagcacaccgccctggccctgatggagatcaaggtgtgcgacggccaggagcacgtggtgaccgtgagcctgagagacggcgaggccaccctggaggtggacggcaccagaggccagagcgaggtgagcgccgcccagctgcaggagagactggccgtgctggagagacacctgagaagccccgtgctgaccttcgccggcggcctgcccgacgtgcccgtgaccagcgcccccgtgaccgccttctacagaggctgcatgaccctggaggtgaacagaagactgctggacctggacgaggccgcctacaagcacagcgacatcaccgcccacagctgcccccccgtggagcccgccgccgcctag

SEQ ID NO: 83696 - DNA, 1431 bp, Artificial Sequence
  Description of Artificial Sequence: Synthetic coding sequence
atgagcggcgccagatgcagaaccctgtaccccttcagcggcgagagacacggccagggcctgagattcgccgccggcgagctgatcaccctgctgcaggtgcccgacggcggctggtgggagggcgagaaggaggacggcctgagaggctggttccccgccagctacgtgcagctgctggagaagcccggcatggtgccccccccccccggcgaggagagccagaccgtgatcctgccccccggctggcagagctacctgagcccccagggcagaagatactacgtgaacaccaccaccaacgagaccacctgggagagacccagcagcagccccggcatccccgccagccccggcagccacagaagcagcctgccccccaccgtgaacggctaccacgccagcggcacccccgcccacccccccgagaccgcccacatgagcgtgagaaagagcaccggcgacagccagaacctgggcagcagcagccccagcaagaagcagagcaaggagaacaccatcaccatcaactgcgtgaccttcccccaccccgacaccatgcccgagcagcagctgctgaagcccaccgagtggagctactgcgactacttctgggccgacaagaaggacccccagggcaacggcaccgtggccggcttcgagctgctgctgcagaagcagctgaagggcaagcagatgcagaaggagatgagcgagttcatcagagagagaatcaagatcgaggaggactacgccaagaacctggccaagctgagccagaacagcctggccagccaggaggagggcagcctgggcgaggcctgggcccaggtgaagaagagcctggccgacgaggccgaggtgcacctgaagttcagcgccaagctgcacagcgaggtggagaagcccctgatgaacttcagagagaacttcaagaaggacatgaagaagtgcgaccaccacatcgccgacctgagaaagcagctggccagcagatacgccagcgtggagaaggccagaaaggccctgaccgagagacagagagacctggagatgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83697 - DNA, 1251 bp, Artificial Sequence
  Description of Artificial Sequence: Synthetic coding sequence
atgaagcccggcatggtgccccccccccccggcgaggagagccagaccgtgatcctgccccccggctggcagagctacctgagcccccagggcagaagatactacgtgaacaccaccaccaacgagaccacctgggagagacccagcagcagccccggcatccccgccagccccggcagccacagaagcagcctgccccccaccgtgaacggctaccacgccagcggcacccccgcccacccccccgagaccgcccacatgagcgtgagaaagagcaccggcgacagccagaacctgggcagcagcagccccagcaagaagcagagcaaggagaacaccatcaccatcaactgcgtgaccttcccccaccccgacaccatgcccgagcagcagctgctgaagcccaccgagtggagctactgcgactacttctgggccgacaagaaggacccccagggcaacggcaccgtggccggcttcgagctgctgctgcagaagcagctgaagggcaagcagatgcagaaggagatgagcgagttcatcagagagagaatcaagatcgaggaggactacgccaagaacctggccaagctgagccagaacagcctggccagccaggaggagggcagcctgggcgaggcctgggcccaggtgaagaagagcctggccgacgaggccgaggtgcacctgaagttcagcgccaagctgcacagcgaggtggagaagcccctgatgaacttcagagagaacttcaagaaggacatgaagaagtgcgaccaccacatcgccgacctgagaaagcagctggccagcagatacgccagcgtggagaaggccagaaaggccctgaccgagagacagagagacctggagatgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83698 - DNA, 1011 bp, Artificial Sequence
  Description of Artificial Sequence: Synthetic coding sequence
atgagcaacatggagaacagcttcgacgacgtgagctgcctgagcccccagaacctgggcagcagcagccccagcaagaagcagagcaaggagaacaccatcaccatcaactgcgtgaccttcccccaccccgacaccatgcccgagcagcagctgctgaagcccaccgagtggagctactgcgactacttctgggccgacaagaaggacccccagggcaacggcaccgtggccggcttcgagctgctgctgcagaagcagctgaagggcaagcagatgcagaaggagatgagcgagttcatcagagagagaatcaagatcgaggaggactacgccaagaacctggccaagctgagccagaacagcctggccagccaggaggagggcagcctgggcgaggcctgggcccaggtgaagaagagcctggccgacgaggccgaggtgcacctgaagttcagcgccaagctgcacagcgaggtggagaagcccctgatgaacttcagagagaacttcaagaaggacatgaagaagtgcgaccaccacatcgccgacctgagaaagcagctggccagcagatacgccagcgtggagaaggccagaaaggccctgaccgagagacagagagacctggagatgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83699 - DNA, 1248 bp, Artificial Sequence
  Description of Artificial Sequence: Synthetic coding sequence
aagcccggcatggtgccccccccccccggcgaggagagccagaccgtgatcctgccccccggctggcagagctacctgagcccccagggcagaagatactacgtgaacaccaccaccaacgagaccacctgggagagacccagcagcagccccggcatccccgccagccccggcagccacagaagcagcctgccccccaccgtgaacggctaccacgccagcggcacccccgcccacccccccgagaccgcccacatgagcgtgagaaagagcaccggcgacagccagaacctgggcagcagcagccccagcaagaagcagagcaaggagaacaccatcaccatcaactgcgtgaccttcccccaccccgacaccatgcccgagcagcagctgctgaagcccaccgagtggagctactgcgactacttctgggccgacaagaaggacccccagggcaacggcaccgtggccggcttcgagctgctgctgcagaagcagctgaagggcaagcagatgcagaaggagatgagcgagttcatcagagagagaatcaagatcgaggaggactacgccaagaacctggccaagctgagccagaacagcctggccagccaggaggagggcagcctgggcgaggcctgggcccaggtgaagaagagcctggccgacgaggccgaggtgcacctgaagttcagcgccaagctgcacagcgaggtggagaagcccctgatgaacttcagagagaacttcaagaaggacatgaagaagtgcgaccaccacatcgccgacctgagaaagcagctggccagcagatacgccagcgtggagaaggccagaaaggccctgaccgagagacagagagacctggagatgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83700 - DNA, 1251 bp, Artificial Sequence; identical to SEQ ID NO: 83697
  Description of Artificial Sequence: Synthetic coding sequence

SEQ ID NO: 83701 - DNA, 546 bp, Artificial Sequence
  Description of Artificial Sequence: Synthetic coding sequence
atggtgccccccccccccggcgaggagagccagaccgtgatcctgccccccggctggcagagctacctgagcccccagggcagaagatactacgtgaacaccaccaccaacgagaccacctgggagagacccagcagcagccccggcatccccgccagccccggcagccacagaagcagcctgccccccaccgtgaacggctaccacgccagcggcacccccgcccacccccccgagaccgcccacatgagcgtgagaaagagcaccggcgacagccagaacctgggcagcagcagccccagcaagaagcagagcaaggagaacaccatcaccgagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83702 - DNA, 873 bp, Artificial Sequence
  Description of Artificial Sequence: Synthetic coding sequence
atgcccgagcagcagctgctgaagcccaccgagtggagctactgcgactacttctgggccgacaagaaggacccccagggcaacggcaccgtggccggcttcgagctgctgctgcagaagcagctgaagggcaagcagatgcagaaggagatgagcgagttcatcagagagagaatcaagatcgaggaggactacgccaagaacctggccaagctgagccagaacagcctggccagccaggaggagggcagcctgggcgaggcctgggcccaggtgaagaagagcctggccgacgaggccgaggtgcacctgaagttcagcgccaagctgcacagcgaggtggagaagcccctgatgaacttcagagagaacttcaagaaggacatgaagaagtgcgaccaccacatcgccgacctgagaaagcagctggccagcagatacgccagcgtggagaaggccagaaaggccctgaccgagagacagagagacctggagatgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83703 - DNA, 378 bp, Artificial Sequence
  Description of Artificial Sequence: Synthetic coding sequence
atgaagacccagcagctggagatcaagctgagcaacaagaccgaggaggacatcaagaaggccagaagaaagagcacccaggccggcgacgacctgatgagatgcgtggacctgtacaaccaggcccagagcaagtggttcgaggagatggtgaccaccaccctggagctggagagactggaggtggagagagtggagatgatcagacagcacctgtgccagtacacccagctgagacacgagaccgacatgttcaaccagagcaccgtggagcccgtggaccagctgctgagaaaggtggaccccgccaaggacagagagctgtgggtgagagagcacaagaccggcaacatcagacccgtggacatggagatctag

SEQ ID NO: 83704 - DNA, 1011 bp, Artificial Sequence; identical to SEQ ID NO: 83698
  Description of Artificial Sequence: Synthetic coding sequence

SEQ ID NO: 83705 - DNA, 1437 bp, Artificial Sequence
  Description of Artificial Sequence: Synthetic coding sequence
atggcccccaagaagaagggcaagaagggcaaggccaagggcacccccatcgtggacggcctggcccccgaggacatgagcaaggagcaggtggaggagcacgtgagcagaatcagagaggagctggacagagagagagaggagagaaactacttccagctggagagagacaagatccacaccttctgggagatcaccagaagacagctggaggagaagaaggccgagctgagaaacaaggacagagagatggaggaggccgaggagagacaccaggtggagatcaaggtgtacaagcagaaggtgaagcacctgctgtacgagcaccagaacaacctgaccgagatgaaggccgagggcaccgtggtgatgaagctggcccagaaggagcacagaatccaggagagcgtgctgagaaaggacatgagagccctgaaggtggagctgaaggagcaggagctggccagcgaggtggtggtgaagaacctgagactgaagcacaccgaggagatcaccagaatgagaaacgacttcgagagacaggtgagagagatcgaggccaagtacgacaagaagatgaagatgctgagagacgagctggacctgagaagaaagaccgagctgcacgaggtggaggagagaaagaacggccagatccacaccctgatgcagagacacgaggaggccttcaccgacatcaagaactactacaacgacatcaccctgaacaacctggccctgatcaacagcctgaaggagcagatggaggacatgagaaagaaggaggaccacctggagagagagatggccgaggtgagcggccagaacaagagactggccgaccccctgcagaaggccagagaggagatgagcgagatgcagaagcagctggccaactacgagagagacaagcagatcctgctgtgcaccaaggccagactgaaggtgagagagaaggagctgaaggacctgcagtgggagcacgaggtgctggagcagagattcaccaaggtgcagcaggagagagacgagctgtacagaaagttcaccgccgccatccaggaggtgcagcagaagaccggcttcaagaacctggtgctggagagaaagctgcaggccctgagcgccgccgtggagaagaaggaggtgcagttcaacgaggtgctggccgccagcaacctggaccccgccgccctgaccctggtgagcagaaagctggaggacgtgctggagagcaagaacagcaccatcaaggacctgcagtacgagctggcccaggtgtgcaaggcccacaacgacctgctgagaacctacgaggccaagctgctggccttcggcatccccctggacaacgtgggcttcaagcccctggagaccgccgtgatcggccagaccctgggccagggccccgccggcctggtgggcacccccacctag

SEQ ID NO: 83706 - DNA, 1362 bp, Artificial Sequence
  Description of Artificial Sequence: Synthetic coding sequence
atgagcaaggagcaggtggaggagcacgtgagcagaatcagagaggagctggacagagagagagaggagagaaactacttccagctggagagagacaagatccacaccttctgggagatcaccagaagacagctggaggagaagaaggccgagctgagaaacaaggacagagagatggaggaggccgaggagagacaccaggtggagatcaaggtgtacaagcagaaggtgaagcacctgctgtacgagcaccagaacaacctgaccgagatgaaggccgagggcaccgtggtgatgaagctggcccagaaggagcacagaatccaggagagcgtgctgagaaaggacatgagagccctgaaggtggagctgaaggagcaggagctggccagcgaggtggtggtgaagaacctgagactgaagcacaccgaggagatcaccagaatgagaaacgacttcgagagacaggtgagagagatcgaggccaagtacgacaagaagatgaagatgctgagagacgagctggacctgagaagaaagaccgagctgcacgaggtggaggagagaaagaacggccagatccacaccctgatgcagagacacgaggaggccttcaccgacatcaagaactactacaacgacatcaccctgaacaacctggccctgatcaacagcctgaaggagcagatggaggacatgagaaagaaggaggaccacctggagagagagatggccgaggtgagcggccagaacaagagactggccgaccccctgcagaaggccagagaggagatgagcgagatgcagaagcagctggccaactacgagagagacaagcagatcctgctgtgcaccaaggccagactgaaggtgagagagaaggagctgaaggacctgcagtgggagcacgaggtgctggagcagagattcaccaaggtgcagcaggagagagacgagctgtacagaaagttcaccgccgccatccaggaggtgcagcagaagaccggcttcaagaacctggtgctggagagaaagctgcaggccctgagcgccgccgtggagaagaaggaggtgcagttcaacgaggtgctggccgccagcaacctggaccccgccgccctgaccctggtgagcagaaagctggaggacgtgctggagagcaagaacagcaccatcaaggacctgcagtacgagctggcccaggtgtgcaaggcccacaacgacctgctgagaacctacgaggccaagctgctggccttcggcatccccctggacaacgtgggcttcaagcccctggagaccgccgtgatcggccagaccctgggccagggccccgccggcctggtgggcacccccacctag

SEQ ID NO: 83707 - DNA, 525 bp, Artificial Sequence
  Description of Artificial Sequence: Synthetic coding sequence
atggcccccaagaagaagggcaagaagggcaaggccaagggcacccccatcgtggacggcctggcccccgaggacatgagcaaggagcaggtggaggagcacgtgagcagaatcagagaggagctggacagagagagagaggagagaaactacttccagctggagagagacaagatccacaccttctgggagatcaccagaagacagctggaggagaagaaggccgagctgagaaacaaggacagagagatggaggaggccgaggagagacaccaggtggagatcaaggtgtacaagcagaaggtgaagcacctgctgtacgagcaccagaacaacctgaccgagatgaaggccgagggcaccgtggtgatgaagctggcccagaaggagcacagaatccaggagagcgtgctgagaaaggacatgagagccctgaaggtggagctgaaggagcaggagctggccagcgaggtggtggtgaagaacctgagactgaagctgagacccagcatgatcagaagatag

SEQ ID NO: 83708 - DNA, 1149 bp, Artificial Sequence
  Description of Artificial Sequence: Synthetic coding sequence
atggtggaggagcacgtgagcagaatcagagaggagctggacagagagagagaggagagaaactacttccagctggagagagacaagatccacaccttctgggagatcaccagaagacagctggaggagaagaaggccgagctgagaaacaaggacagagagatggaggaggccgaggagagacaccaggtggagatcaaggtgtacaagcagaaggtgaagcacctgctgtacgagcaccagaacaacctgaccgagatgaaggccgagggcaccgtggtgatgaagctggcccagaaggagcacagaatccaggagagcgtgctgagaaaggacatgagagccctgaaggtggagctgaaggagcaggagctggccagcgaggtggtggtgaagaacctgagactgaagcacaccgaggagatcaccagaatgagaaacgacttcgagagacaggtgagagagatcgaggccaagtacgacaagaagatgaagatgctgagagacgagctggacctgagaagaaagaccgagctgcacgaggtggaggagagaaagaacggccagatccacaccctgatgcagagacacgaggaggccttcaccgacatcaagaactactacaacgacatcaccctgaacaacctggccctgatcaacagcctgaaggagcagatggaggacatgagaaagaaggaggaccacctggagagagagatggccgaggtgagcggccagaacaagagactggccgaccccctgcagaaggccagagaggagatgagcgagatgcagaagcagctggccaactacgagagagacaagcagatcctgctgtgcaccaaggccagactgaaggtgagagagaaggagctgaaggacctgcagtgggagcacgaggtgctggagcagagattcaccaaggtgcagcaggagagagacgagctgtacagaaagttcaccgccgccatccaggaggtgcagcagaagaccggcttcaagaacctggtgctggagagaaagctgcaggccctgagcgccgccgtggagaagaaggaggtgcagttcaacgaggtgctggccgccagcaacctggaccccgccgccctgaccctggtgagcagaaagctggagaccttcttctgctag

SEQ ID NO: 83709 - DNA, 717 bp, Artificial Sequence
  Description of Artificial Sequence: Synthetic coding sequence
atgctgtgctgcatgagaagaaccaagcaggtggagaagaacgacgacgaccagaagatcgagcaggacggcatcaagcccgaggacaaggcccacaaggccgccaccaagatccaggccagcttcagaggccacatcaccagaaagaagctgaagggcgagaagaaggacgacgtgcaggccgccgaggccgaggccaacaagaaggacgaggcccccgtggccgacggcgtggagaagaagggcgagggcaccaccaccgccgaggccgcccccgccaccggcagcaagcccgacgagcccggcaaggccggcgagacccccagcgaggagaagaagggcgagggcgacgccgccaccgagcaggccgccccccaggcccccgccagcagcgaggagaaggccggcagcgccgagaccgagagcgccaccaaggccagcaccgacaacagccccagcagcaaggccgaggacgcccccgccaaggaggagcccaagcaggccgacgtgcccgccgccgtgaccgccgccgccgccaccacccccgccgccgaggacgccgccgccaaggccaccgcccagccccccaccgagaccggcgagagcagccaggccgaggagaacatcgaggccgtggacgagaccaagcccaaggagagcgccagacaggacgagggcaaggaggaggagcccgaggccgaccaggagcacgcctag

SEQ ID NO: 83710 - DNA, 825 bp, Artificial Sequence
  Description of Artificial Sequence: Synthetic coding sequence
atgaccaagagctgcagcgagctgtgccaccccgccctgcacttcctgccctgcctgggcggcctgagaaagaacctgcagagagccgtgagacccagcccctacagcctgggcttcctgaccttctggatcagcagagtggagaagaacgacgacgaccagaagatcgagcaggacggcatcaagcccgaggacaaggcccacaaggccgccaccaagatccaggccagcttcagaggccacatcaccagaaagaagctgaagggcgagaagaaggacgacgtgcaggccgccgaggccgaggccaacaagaaggacgaggcccccgtggccgacggcgtggagaagaagggcgagggcaccaccaccgccgaggccgcccccgccaccggcagcaagcccgacgagcccggcaaggccggcgagacccccagcgaggagaagaagggcgagggcgacgccgccaccgagcaggccgccccccaggcccccgccagcagcgaggagaaggccggcagcgccgagaccgagagcgccaccaaggccagcaccgacaacagccccagcagcaaggccgaggacgcccccgccaaggaggagcccaagcaggccgacgtgcccgccgccgtgaccgccgccgccgccaccacccccgccgccgaggacgccgccgccaaggccaccgcccagccccccaccgagaccggcgagagcagccaggccgaggagaacatcgaggccgtggacgagaccaagcccaaggagagcgccagacaggacgagggcaaggaggaggagcccgaggccgaccaggagcacgcctag

SEQ ID NO: 83711 - DNA, 1119 bp, Artificial Sequence
  Description of Artificial Sequence: Synthetic coding sequence
atgccccccccccagcagggcccctgcggccaccacctgctgctgctgctggccctgctgctgcccagcctgcccctgaccagagcccccgtgccccccggccccgccgccgccctgctgcaggccctgggcctgagagacgagccccagggcgcccccagactgagacccgtgccccccgtgatgtggagactgttcagaagaagagacccccaggagaccagaagcggcagcagaagaaccagccccggcgtgaccctgcagccctgccacgtggaggagctgggcgtggccggcaacatcgtgagacacatccccgacagaggcgcccccaccagagccagcgagcccgccagcgccgccggccactgccccgagtggaccgtggtgttcgacctgagcgccgtggagcccgccgagagacccagcagagccagactggagctgagattcgccgccgccgccgccgccgcccccgagggcggctgggagctgagcgtggcccaggccggccagggcgccggcgccgaccccggccccgtgctgctgagacagctggtgcccgccctgggcccccccgtgagagccgagctgctgggcgccgcctgggccagaaacgccagctggcccagaagcctgagactggccctggccctgagacccagagcccccgccgcctgcgccagactggccgaggccagcctgctgctggtgaccctggaccccagactgtgccaccccctggccagacccagaagagacgccgagcccgtgctgggcggcggccccggcggcgcctgcagagccagaagactgtacgtgagcttcagagaggtgggctggcacagatgggtgatcgcccccagaggcttcctggccaactactgccagggccagtgcgccctgcccgtggccctgagcggcagcggcggcccccccgccctgaaccacgccgtgctgagagccctgatgcacgccgccgcccccggcgccgccgacctgccctgctgcgtgcccgccagactgagccccatcagcgtgctgttcttcgacaacagcgacaacgtggtgctgagacagtacgaggacatggtggtggacgagtgcggctgcagatag

SEQ ID NO: 83712 - DNA, 1224 bp, Artificial Sequence
  Description of Artificial Sequence: Synthetic coding sequence
atggtgctggccgcccccctgctgctgggcttcctgctgctggccctggagctgagacccagaggcgaggccgccgagggccccgccgccgccgccgccgccgccgccgccgccgccgccgccggcgtgggcggcgagagaagcagcagacccgcccccagcgtggcccccgagcccgacggctgccccgtgtgcgtgtggagacagcacagcagagagctgagactggagagcatcaagagccagatcctgagcaagctgagactgaaggaggcccccaacatcagcagagaggtggtgaagcagctgctgcccaaggccccccccctgcagcagatcctggacctgcacgacttccagggcgacgccctgcagcccgaggacttcctggaggaggacgagtaccacgccaccaccgagaccgtgatcagcatggcccaggagaccgaccccgccgtgcagaccgacggcagccccctgtgctgccacttccacttcagccccaaggtgatgttcaccaaggtgctgaaggcccagctgtgggtgtacctgagacccgtgcccagacccgccaccgtgtacctgcagatcctgagactgaagcccctgaccggcgagggcaccgccggcggcggcggcggcggcagaagacacatcagaatcagaagcctgaagatcgagctgcacagcagaagcggccactggcagagcatcgacttcaagcaggtgctgcacagctggttcagacagccccagagcaactggggcatcgagatcaacgccttcgaccccagcggcaccgacctggccgtgaccagcctgggccccggcgccgagggcctgcaccccttcatggagctgagagtgctggagaacaccaagagaagcagaagaaacctgggcctggactgcgacgagcacagcagcgagagcagatgctgcagataccccctgaccgtggacttcgaggccttcggctgggactggatcatcgcccccaagagatacaaggccaactactgcagcggccagtgcgagtacatgttcatgcagaagtacccccacacccacctggtgcagcaggccaaccccagaggcagcgccggcccctgctgcacccccaccaagatgagccccatcaacatgctgtacttcaacgacaagcagcagatcatctacggcaagatccccggcatggtggtggacagatgcggctgcagctag

SEQ ID NO: 83713 - DNA, 1143 bp, Artificial Sequence
  Description of Artificial Sequence: Synthetic coding sequence
tgagccgccgccgccgccgccgccgccgccgccgccgccgccggcgtgggcggcgagagaagcagcagacccgcccccagcgtggcccccgagcccgacggctgccccgtgtgcgtgtggagacagcacagcagagagctgagactggagagcatcaagagccagatcctgagcaagctgagactgaaggaggcccccaacatcagcagagaggtggtgaagcagctgctgcccaaggccccccccctgcagcagatcctggacctgcacgacttccagggcgacgccctgcagcccgaggacttcctggaggaggacgagtaccacgccaccaccgagaccgtgatcagcatggcccaggagaccgaccccgccgtgcagaccgacggcagccccctgtgctgccacttccacttcagccccaaggtgatgttcaccaaggtgctgaaggcccagctgtgggtgtacctgagacccgtgcccagacccgccaccgtgtacctgcagatcctgagactgaagcccctgaccggcgagggcaccgccggcggcggcggcggcggcagaagacacatcagaatcagaagcctgaagatcgagctgcacagcagaagcggccactggcagagcatcgacttcaagcaggtgctgcacagctggttcagacagccccagagcaactggggcatcgagatcaacgccttcgaccccagcggcaccgacctggccgtgaccagcctgggccccggcgccgagggcctgcaccccttcatggagctgagagtgctggagaacaccaagagaagcagaagaaacctgggcctggactgcgacgagcacagcagcgagagcagatgctgcagataccccctgaccgtggacttcgaggccttcggctgggactggatcatcgcccccaagagatacaaggccaactactgcagcggccagtgcgagtacatgttcatgcagaagtacccccacacccacctggtgcagcaggccaaccccagaggcagcgccggcccctgctgcacccccaccaagatgagccccatcaacatgctgtacttcaacgacaagcagcagatcatctacggcaagatccccggcatggtggtggacagatgcggctgcagctag

SEQ ID NO: 83714 - DNA, 927 bp, Artificial Sequence
  Description of Artificial Sequence: Synthetic coding sequence
atgcccggccaggagctgagaaccgtgaacggcagccagatgctgctggtgctgctggtgctgagctggctgccccacggcggcgccctgagcctggccgaggccagcagagccagcttccccggccccagcgagctgcacagcgaggacagcagattcagagagctgagaaagagatacgaggacctgctgaccagactgagagccaaccagagctgggaggacagcaacaccgacctggtgcccgcccccgccgtgagaatcctgacccccgaggtgagactgggcagcggcggccacctgcacctgagaatcagcagagccgccctgcccgagggcctgcccgaggccagcagactgcacagagccctgttcagactgagccccaccgccagcagaagctgggacgtgaccagacccctgagaagacagctgagcctggccagaccccaggcccccgccctgcacctgagactgagccccccccccagccagagcgaccagctgctggccgagagcagcagcgccagaccccagctggagctgcacctgagaccccaggccgccagaggcagaagaagagccagagccagaaacggcgaccactgccccctgggccccggcagatgctgcagactgcacaccgtgagagccagcctggaggacctgggctgggccgactgggtgctgagccccagagaggtgcaggtgaccatgtgcatcggcgcctgccccagccagttcagagccgccaacatgcacgcccagatcaagaccagcctgcacagactgaagcccgacaccgtgcccgccccctgctgcgtgcccgccagctacaaccccatggtgctgatccagaagaccgacaccggcgtgagcctgcagacctacgacgacctgctggccaaggactgccactgcatctag

SEQ ID NO: 83715 - DNA, 927 bp, Artificial Sequence; identical to SEQ ID NO: 83714
  Description of Artificial Sequence: Synthetic coding sequence

SEQ ID NO: 83716 - DNA, 1290 bp, Artificial Sequence
  Description of Artificial Sequence: Synthetic coding sequence
atgtgccccggcgccctgtgggtggccctgcccctgctgagcctgctggccggcagcctgcagggcaagcccctgcagagctggggcagaggcagcgccggcggcaacgcccacagccccctgggcgtgcccggcggcggcctgcccgagcacaccttcaacctgaagatgttcctggagaacgtgaaggtggacttcctgagaagcctgaacctgagcggcgtgcccagccaggacaagaccagagtggagcccccccagtacatgatcgacctgtacaacagatacaccagcgacaagagcaccacccccgccagcaacatcgtgagaagcttcagcatggaggacgccatcagcatcaccgccaccgaggacttccccttccagaagcacatcctgctgttcaacatcagcatccccagacacgagcagatcaccagagccgagctgagactgtacgtgagctgccagaaccacgtggaccccagccacgacctgaagggcagcgtggtgatctacgacgtgctggacggcaccgacgcctgggacagcgccaccgagaccaagaccttcctggtgagccaggacatccaggacgagggctgggagaccctggaggtgagcagcgccgtgaagagatgggtgagaagcgacagcaccaagagcaagaacaagctggaggtgaccgtggagagccacagaaagggctgcgacaccctggacatcagcgtgccccccggcagcagaaacctgcccttcttcgtggtgttcagcaacgaccacagcagcggcaccaaggagaccagactggagctgagagagatgatcagccacgagcaggagagcgtgctgaagaagctgagcaaggacggcagcaccgaggccggcgagagcagccacgaggaggacaccgacggccacgtggccgccggcagcaccctggccagaagaaagagaagcgccggcgccggcagccactgccagaagaccagcctgagagtgaacttcgaggacatcggctgggacagctggatcatcgcccccaaggagtacgaggcctacgagtgcaagggcggctgcttcttccccctggccgacgacgtgacccccaccaagcacgccatcgtgcagaccctggtgcacctgaagttccccaccaaggtgggcaaggcctgctgcgtgcccaccaagctgagccccatcagcgtgctgtacaaggacgacatgggcgtgcccaccctgaagtaccactacgagggcatgagcgtggccgagtgcggctgcagatag

SEQ ID NO: 83717 - DNA, 1095 bp, Artificial Sequence
  Description of Artificial Sequence: Synthetic coding sequence
atgctgagattcctgcccgacctggccttcagcttcctgctgatcctggccctgggccaggccgtgcagttccaggagtacgtgttcctgcagttcctgggcctggacaaggcccccagcccccagaagttccagcccgtgccctacatcctgaagaagatcttccaggacagagaggccgccgccaccaccggcgtgagcagagacctgtgctacgtgaaggagctgggcgtgagaggcaacgtgctgagattcctgcccgaccagggcttcttcctgtaccccaagaagatcagccaggccagcagctgcctgcagaagctgctgtacttcaacctgagcgccatcaaggagagagagcagctgaccctggcccagctgggcctggacctgggccccaacagctactacaacctgggccccgagctggagctggccctgttcctggtgcaggagccccacgtgtggggccagaccacccccaagcccggcaagatgttcgtgctgagaagcgtgccctggccccagggcgccgtgcacttcaacctgctggacgtggccaaggactggaacgacaaccccagaaagaacttcggcctgttcctggagatcctggtgaaggaggacagagacagcggcgtgaacttccagcccgaggacacctgcgccagactgagatgcagcctgcacgccagcctgctggtggtgaccctgaaccccgaccagtgccaccccagcagaaagagaagagccgccatccccgtgcccaagctgagctgcaagaacctgtgccacagacaccagctgttcatcaacttcagagacctgggctggcacaagtggatcatcgcccccaagggcttcatggccaactactgccacggcgagtgccccttcagcctgaccatcagcctgaacagcagcaactacgccttcatgcaggccctgatgcacgccgtggaccccgagatcccccaggccgtgtgcatccccaccaagctgagccccatcagcatgctgtaccaggacaacaacgacaacgtgatcctgagacactacgaggacatggtggtggacgagtgcggctgcggctag

SEQ ID NO: 83718 - DNA, 1506 bp, Artificial Sequence
  Description of Artificial Sequence: Synthetic coding sequence
atgagactgcccaagctgctgaccttcctgctgtggtacctggcctggctggacctggagttcatctgcaccgtgctgggcgcccccgacctgggccagagaccccagggcaccagacccggcctggccaaggccgaggccaaggagagaccccccctggccagaaacgtgttcagacccggcggccacagctacggcggcggcgccaccaacgccaacgccagagccaagggcggcaccggccagaccggcggcctgacccagcccaagaaggacgagcccaagaagctgccccccagacccggcggccccgagcccaagcccggccaccccccccagaccagacaggccaccgccagaaccgtgacccccaagggccagctgcccggcggcaaggccccccccaaggccggcagcgtgcccagcagcttcctgctgaagaaggccagagagcccggcccccccagagagcccaaggagcccttcagacccccccccatcaccccccacgagtacatgctgagcctgtacagaaccctgagcgacgccgacagaaagggcggcaacagcagcgtgaagctggaggccggcctggccaacaccatcaccagcttcatcgacaagggccaggacgacagaggccccgtggtgagaaagcagagatacgtgttcgacatcagcgccctggagaaggacggcctgctgggcgccgagctgagaatcctgagaaagaagcccagcgacaccgccaagcccgccgcccccggcggcggcagagccgcccagctgaagctgagcagctgccccagcggcagacagcccgccagcctgctggacgtgagaagcgtgcccggcctggacggcagcggctgggaggtgttcgacatctggaagctgttcagaaacttcaagaacagcgcccagctgtgcctggagctggaggcctgggagagaggcagagccgtggacctgagaggcctgggcttcgacagagccgccagacaggtgcacgagaaggccctgttcctggtgttcggcagaaccaagaagagagacctgttcttcaacgagatcaaggccagaagcggccaggacgacaagaccgtgtacgagtacctgttcagccagagaagaaagagaagagcccccctggccaccagacagggcaagagacccagcaagaacctgaaggccagatgcagcagaaaggccctgcacgtgaacttcaaggacatgggctgggacgactggatcatcgcccccctggagtacgaggccttccactgcgagggcctgtgcgagttccccctgagaagccacctggagcccaccaaccacgccgtgatccagaccctgatgaacagcatggaccccgagagcaccccccccacctgctgcgtgcccaccagactgagccccatcagcatcctgttcatcgacagcgccaacaacgtggtgtacaagcagtacgaggacatggtggtggagagctgcggctgcagatag

SEQ ID NO: 83719 - DNA, 1506 bp, Artificial Sequence; identical to SEQ ID NO: 83718
  Description of Artificial Sequence: Synthetic coding sequence

SEQ ID NO: 83720 - DNA, 1368 bp, Artificial Sequence
  Description of Artificial Sequence: Synthetic coding sequence
atggacacccccagagtgctgctgagcgccgtgttcctgatcagcttcctgtgggacctgcccggcttccagcaggccagcatcagcagcagcagcagcagcgccgagctgggcagcaccaagggcatgagaagcagaaaggagggcaagatgcagagagcccccagagacagcgacgccggcagagagggccaggagccccagcccagaccccaggacgagcccagagcccagcagcccagagcccaggagccccccggcagaggccccagagtggtgccccacgagtacatgctgagcatctacagaacctacagcatcgccgagaagctgggcatcaacgccagcttcttccagagcagcaagagcgccaacaccatcaccagcttcgtggacagaggcctggacgacctgagccacacccccctgagaagacagaagtacctgttcgacgtgagcatgctgagcgacaaggaggagctggtgggcgccgagctgagactgttcagacaggcccccagcgccccctggggcccccccgccggccccctgcacgtgcagctgttcccctgcctgagccccctgctgctggacgccagaaccctggacccccagggcgccccccccgccggctgggaggtgttcgacgtgtggcagggcctgagacaccagccctggaagcagctgtgcctggagctgagagccgcctggggcgagctggacgccggcgaggccgaggccagagccagaggcccccagcagccccccccccccgacctgagaagcctgggcttcggcagaagagtgagacccccccaggagagagccctgctggtggtgttcaccagaagccagagaaagaacctgttcgccgagatgagagagcagctgggcagcgccgaggccgccggccccggcgccggcgccgagggcagctggcccccccccagcggcgcccccgacgccagaccctggctgcccagccccggcagaagaagaagaagaaccgccttcgccagcagacacggcaagagacacggcaagaagagcagactgagatgcagcaagaagcccctgcacgtgaacttcaaggagctgggctgggacgactggatcatcgcccccctggagtacgaggcctaccactgcgagggcgtgtgcgacttccccctgagaagccacctggagcccaccaaccacgccatcatccagaccctgatgaacagcatggaccccggcagcaccccccccagctgctgcgtgcccaccaagctgacccccatcagcatcctgtacatcgacgccggcaacaacgtggtgtacaagcagtacgaggacatggtggtggagagctgcggctgcagatag

SEQ ID NO: 83721 - DNA, 1062 bp, Artificial Sequence
  Description of Artificial Sequence: Synthetic coding sequence
atggacacccccagagtgctgctgagcgccgtgttcctgatcagcttcctgtgggacctgcccggcttccagcaggccagcatcagcagcagcagcagcagcgccgagctgggcagcaccaagggcatgagaagcagaaaggagggcaagatgcagagagcccccagagacagcgacgccggcagagagggccaggagccccagcccagaccccaggacgagcccagagcccagcagcccagagcccaggagccccccggcagaggccccagagtggtgccccacgagtacatgctgagcatctacagaacctacagcatcgccgagaagctgggcatcaacgccagcttcttccagagcagcaagagcgccaacaccatcaccagcttcgtggacagaggcctggacgacctgagccacacccccctgagaagacagaagtacctgttcgacgtgagcatgctgagcgacaaggaggagctggtgggcgccgagctgagactgttcagacaggcccccagcgccccctggggcccccccgccggccccctgcacgtgcagctgttcccctgcctgagccccctgctgctggacgccagaaccctggacccccagggcgccccccccgccggctgggaggtgttcgacgtgtggcagggcctgagacaccagccctggaagcagctgtgcctggagctgagagccgcctggggcgagctggacgccggcgaggccgaggccagagccagaggcccccagcagccccccccccccgacctgagaagcctgggcttcggcagaagagtgagacccccccaggagagagccctgctggtggtgttcaccagaagccagagaaagaacctgttcgcccccggcgtgagaggcctgagcctgagaggctgcatgagactgcccgccgccctggcccccggcgcccaccagcccagacaccaccccgacgccgacgagctgcacggccccagactgcaccccgcccagctgctgagagcccaccagatcgacagccaccagcacagcatccacagaagaggccagtag

SEQ ID NO: 83722 - DNA, 816 bp, Artificial Sequence
  Description of Artificial Sequence: Synthetic coding sequence
atggacacccccagagtgctgctgagcgccgtgttcctgatcagcttcctgtgggacctgcccggcttccagcaggccagcatcagcagcagcagcagcagcgccgagctgggcagcaccaagggcatgagaagcagaaaggagggcaagatgcagagagcccccagagacagcgacgccggcagagagggccaggagccccagcccagaccccaggacgagcccagagcccagcagcccagagcccaggagccccccggcagaggccccagagtggtgccccacgagtacatgctgagcatctacagaacctacagcatcgccgagaagctgggcatcaacgccagcttcttccagagcagcaagagcgccaacaccatcaccagcttcgtggacagaggcctggacgacctgagccacacccccctgagaagacagaagtacctgttcgacgtgagcatgctgagcgacaaggaggagctggtgggcgccgagctgagactgttcagacaggcccccagcgccccctggggcccccccgccggccccctgcacgtgcagctgttcccctgcctgagccccctgctgctggacgccagaaccctggacccccagggcgccccccccgccggctgggaggtgttcgacgtgtggcagggcctgagacaccagccctggaagcagctgtgcctggagctgagagccgcccccggccccgccgagagcggcctgagacccgagggcgccgccagccccggcgccggccccgccggcggcatccaccagatccccgccgccgcctgcccccccaactag

SEQ ID NO: 83723 - DNA, 1353 bp, Artificial Sequence
  Description of Artificial Sequence: Synthetic coding sequence
atggacctgagcgccgccgccgccctgtgcctgtggctgctgagcgcctgcagacccagagacggcctggaggccgccgccgtgctgagagccgccggcgccggccccgtgagaagccccggcggcggcggcggcggcggcggcggcggcagaaccctggcccaggccgccggcgccgccgccgtgcccgccgccgccgtgcccagagccagagccgccagaagagccgccggcagcggcttcagaaacggcagcgtggtgccccaccacttcatgatgagcctgtacagaagcctggccggcagagcccccgccggcgccgccgccgtgagcgccagcggccacggcagagccgacaccatcaccggcttcaccgaccaggccacccaggacgagagcgccgccgagaccggccagagcttcctgttcgacgtgagcagcctgaacgacgccgacgaggtggtgggcgccgagctgagagtgctgagaagaggcagccccgagagcggccccggcagctggaccagcccccccctgctgctgctgagcacctgccccggcgccgccagagcccccagactgctgtacagcagagccgccgagcccctggtgggccagagatgggaggccttcgacgtggccgacgccatgagaagacacagaagagagcccagaccccccagagccttctgcctgctgctgagagccgtggccggccccgtgcccagccccctggccctgagaagactgggcttcggctggcccggcggcggcggcagcgccgccgaggagagagccgtgctggtggtgagcagcagaacccagagaaaggagagcctgttcagagagatcagagcccaggccagagccctgggcgccgccctggccagcgagcccctgcccgaccccggcaccggcaccgccagccccagagccgtgatcggcggcagaagaagaagaagaaccgccctggccggcaccagaaccgcccagggcagcggcggcggcgccggcagaggccacggcagaagaggcagaagcagatgcagcagaaagcccctgcacgtggacttcaaggagctgggctgggacgactggatcatcgcccccctggactacgaggcctaccactgcgagggcctgtgcgacttccccctgagaagccacctggagcccaccaaccacgccatcatccagaccctgctgaacagcatggcccccgacgccgcccccgccagctgctgcgtgcccgccagactgagccccatcagcatcctgtacatcgacgccgccaacaacgtggtgtacaagcagtacgaggacatggtggtggaggcctgcggctgcagatag

SEQ ID NO: 83724 - DNA, 1269 bp, Artificial Sequence
  Description of Artificial Sequence: Synthetic coding sequence
atgcccagaagcttcctggtgaagagcaagaaggcccacagctaccaccagcccagaagccccggccccgactacagcctgagactggagaacgtgcccgcccccagcagagccgacagcaccagcaacgccggcggcgccaaggccgagcccagagacagactgagccccgagagccagctgaccgaggcccccgacagagccagcgccagccccgacagctgcgagggcagcgtgtgcgagagaagcagcgagttcgaggacttctggagaccccccagccccagcgccagccccgccagcgagaagagcatgtgccccagcctggacgaggcccagcccttccccctgcccttcaagccctacagctggagcggcctggccggcagcgacctgagacacctggtgcagagctacagaccctgcggcgccctggagagaggcgccggcctgggcctgttctgcgagcccgcccccgagcccggccaccccgccgccctgtacggccccaagagagccgccggcggcgccggcgccggcgcccccggcagctgcagcgccggcgccggcgccaccgccggccccggcctgggcctgtacggcgacttcggcagcgccgccgccggcctgtacgagagacccaccgccgccgccggcctgctgtaccccgagagaggccacggcctgcacgccgacaagggcgccggcgtgaaggtggagagcgagctgctgtgcaccagactgctgctgggcggcggcagctacaagtgcatcaagtgcagcaaggtgttcagcaccccccacggcctggaggtgcacgtgagaagaagccacagcggcaccagacccttcgcctgcgagatgtgcggcaagaccttcggccacgccgtgagcctggagcagcacaaggccgtgcacagccaggagagaagcttcgactgcaagatctgcggcaagagcttcaagagaagcagcaccctgagcacccacctgctgatccacagcgacaccagaccctacccctgccagtactgcggcaagagattccaccagaagagcgacatgaagaagcacaccttcatccacaccggcgagaagccccacaagtgccaggtgtgcggcaaggccttcagccagagcagcaacctgatcacccacagcagaaagcacaccggcttcaagcccttcggctgcgacctgtgcggcaagggcttccagagaaaggtggacctgagaagacacagagagacccagcacggcctgaagtag

SEQ ID NO: 83725 - DNA, 1269 bp, Artificial Sequence; identical to SEQ ID NO: 83724
  Description of Artificial Sequence: Synthetic coding sequence

SEQ ID NO: 83726 - DNA, 1269 bp, Artificial Sequence; identical to SEQ ID NO: 83724
  Description of Artificial Sequence: Synthetic coding sequence

SEQ ID NO: 83727 - DNA, 993 bp, Artificial Sequence
  Description of Artificial Sequence: Synthetic coding sequence
atgcccagaagcttcctggtgaagagcaagaaggcccacacctaccaccagcccagagtgcaggaggacgagcccctgtggccccccgccctgacccccgtgcccagagaccaggcccccagcaacagccccgtgctgagcaccctgttccccaaccagtgcctggactggaccaacctgaagagagagcccgagctggagcaggaccagaacctggccagaatggcccccgcccccgagggccccatcgtgctgagcagaccccaggacggcgacagccccctgagcgacagcccccccttctacaagcccagcttcagctgggacaccctggccaccacctacggccacagctacagacaggcccccagcaccatgcagagcgccttcctggagcacagcgtgagcctgtacggcagccccctggtgcccagcaccgagcccgccctggacttcagcctgagatacagccccggcatggacgcctaccactgcgtgaagtgcaacaaggtgttcagcaccccccacggcctggaggtgcacgtgagaagaagccacagcggcaccagacccttcgcctgcgacatctgcggcaagaccttcggccacgccgtgagcctggagcagcacacccacgtgcacagccaggagagaagcttcgagtgcagaatgtgcggcaaggccttcaagagaagcagcaccctgagcacccacctgctgatccacagcgacaccagaccctacccctgccagttctgcggcaagagattccaccagaagagcgacatgaagaagcacacctacatccacaccggcgagaagccccacaagtgccaggtgtgcggcaaggccttcagccagagcagcaacctgatcacccacagcagaaagcacaccggcttcaagcccttcagctgcgagctgtgcaccaagggcttccagagaaaggtggacctgagaagacacagagagagccagcacaacctgaagtag

SEQ ID NO: 83728 - DNA, 993 bp, Artificial Sequence; identical to SEQ ID NO: 83727
  Description of Artificial Sequence: Synthetic coding sequence

SEQ ID NO: 83729 - DNA, 855 bp, Artificial Sequence
  Description of Artificial Sequence: Synthetic coding sequence
atgcccagaagcttcctggtgaagagcaagaaggcccacacctaccaccagcccagagtgcaggaggacgagcccctgtggccccccgccctgacccccgtgcccagagaccaggcccccagcaacagccccgtgctgagcaccctgttccccaaccagtgcctggactggaccaacctgaagagagagcccgagctggagcaggaccagaacctggccagaatggcccccgcccccgagggccccatcgtgctgagcagaccccaggacggcgacagccccctgagcgacagcccccccttctacaagcccagcttcagctgggacaccctggccaccacctacggccacagctacagacaggcccccagcaccatgcagagcgccttcctggagcacagcgtgagcctgtacggcagccccctggtgcccagcaccgagcccgccctggacttcagcctgagatacagccccggcatggacgcctaccactgcgtgaagtgcaacaaggagagaagcttcgagtgcagaatgtgcggcaaggccttcaagagaagcagcaccctgagcacccacctgctgatccacagcgacaccagaccctacccctgccagttctgcggcaagagattccaccagaagagcgacatgaagaagcacacctacatccacaccggcgagaagccccacaagtgccaggtgtgcggcaaggccttcagccagagcagcaacctgatcacccacagcagaaagcacaccggcttcaagcccttcagctgcgagctgtgcaccaagggcttccagagaaaggtggacctgagaagacacagagagagccagcacaacctgaagtag

SEQ ID NO: 83730 - DNA, 855 bp, Artificial Sequence; identical to SEQ ID NO: 83729
  Description of Artificial Sequence: Synthetic coding sequence

SEQ ID NO: 83731 - DNA, 993 bp, Artificial Sequence; identical to SEQ ID NO: 83727
  Description of Artificial Sequence: Synthetic coding sequence

SEQ ID NO: 83732 - DNA, 855 bp, Artificial Sequence; identical to SEQ ID NO: 83729
  Description of Artificial Sequence: Synthetic coding sequence

SEQ ID NO: 83733 - DNA, 1623 bp, Artificial Sequence
  Description of Artificial Sequence: Synthetic coding sequence
atgaccaccagcctgcaggacggccagagcgccgccagcagagccgccgccagagacagccccctggccgcccaggtgtgcggcgccgcccagggcagaggcgacgcccacgacctggcccccgccccctggctgcacgccagagccctgctgcccctgcccgacggcaccagaggctgcgccgccgacagaagaaagaagaaggacctggacgtgcccgagatgcccagcatccccaaccccttccccgagctgtgctgcagccccttcaccagcgtgctgagcgccgacctgttccccaaggccaacagcagaaagaagcaggtgatcaaggtgtacagcgaggacgagaccagcagagccctggacgtgcccagcgacatcaccgccagagacgtgtgccagctgctgatcctgaagaaccactacatcgacgaccacagctggaccctgttcgagcacctgccccacatcggcgtggagagaaccatcgaggaccacgagctggtgatcgaggtgctgagcaactggggcatcgaggaggagaacaagctgtacttcagaaagaactacgccaagtacgagttcttcaagaaccccatgtacttcttccccgagcacatggtgagcttcgccaccgagaccaacggcgagatcagccccacccagatcctgcagatgttcctgagcagcagcacctaccccgagatccacggcttcctgcacgccaaggagcagggcaagaagagctggaagaagatctacttcttcctgagaagaagcggcctgtacttcagcaccaagggcaccagcaaggagcccagacacctgcagttcttcagcgagttcggcaacagcgacatctacgtgagcctggccggcaagaagaagcacggcgcccccaccaactacggcttctgcttcaagcccaacaaggccggcggccccagagacctgaagatgctgtgcgccgaggaggagcagagcagaacctgctgggtgaccgccatcagactgctgaagtacggcatgcagctgtaccagaactacatgcacccctaccagggcagaagcggctgcagcagccagagcatcagccccatgagaagcatcagcgagaacagcctggtggccatggacttcagcggccagaagagcagagtgatcgagaaccccaccgaggccctgagcgtggccgtggaggagggcctggcctggagaaagaagggctgcctgagactgggcacccacggcagccccaccgccagcagccagagcagcgccaccaacatggccatccacagaagccagccctggttccaccacaagatcagcagagacgaggcccagagactgatcatccagcagggcctggtggacggcgtgttcctggtgagagacagccagagcaaccccaagaccttcgtgctgagcatgagccacggccagaagatcaagcacttccagatcatccccgtggaggacgacggcgagatgttccacaccctggacgacggccacaccagattcaccgacctgatccagctggtggagttctaccagctgaacaagggcgtgctgccctgcaagctgaagcactactgcgccagaatcgccctgtag

SEQ ID NO: 83734 - DNA, 1362 bp, Artificial Sequence
  Description of Artificial Sequence: Synthetic coding sequence
atgagcctgagcgccagaagagtgaccctgcccgccatcacccccatcatcctgcagaagagagtgatcaaggtgtacagcgaggacgagaccagcagagccctggacgtgcccagcgacatcaccgccagagacgtgtgccagctgctgatcctgaagaaccactacatcgacgaccacagctggaccctgttcgagcacctgccccacatcggcgtggagagaaccatcgaggaccacgagctggtgatcgaggtgctgagcaactggggcatcgaggaggagaacaagctgtacttcagaaagaactacgccaagtacgagttcttcaagaaccccatgtacttcttccccgagcacatggtgagcttcgccaccgagaccaacggcgagatcagccccacccagatcctgcagatgttcctgagcagcagcacctaccccgagatccacggcttcctgcacgccaaggagcagggcaagaagagctggaagaagatctacttcttcctgagaagaagcggcctgtacttcagcaccaagggcaccagcaaggagcccagacacctgcagttcttcagcgagttcggcaacagcgacatctacgtgagcctggccggcaagaagaagcacggcgcccccaccaactacggcttctgcttcaagcccaacaaggccggcggccccagagacctgaagatgctgtgcgccgaggaggagcagagcagaacctgctgggtgaccgccatcagactgctgaagtacggcatgcagctgtaccagaactacatgcacccctaccagggcagaagcggctgcagcagccagagcatcagccccatgagaagcatcagcgagaacagcctggtggccatggacttcagcggccagaagagcagagtgatcgagaaccccaccgaggccctgagcgtggccgtggaggagggcctggcctggagaaagaagggctgcctgagactgggcacccacggcagccccaccgccagcagccagagcagcgccaccaacatggccatccacagaagccagccctggttccaccacaagatcagcagagacgaggcccagagactgatcatccagcagggcctggtggacggcgtgttcctggtgagagacagccagagcaaccccaagaccttcgtgctgagcatgagccacggccagaagatcaagcacttccagatcatccccgtggaggacgacggcgagatgttccacaccctggacgacggccacaccagattcaccgacctgatccagctggtggagttctaccagctgaacaagggcgtgctgccctgcaagctgaagcactactgcgccagaatcgccctgtag

SEQ ID NO: 83735 - DNA, 1599 bp, Artificial Sequence
  Description of Artificial Sequence: Synthetic coding sequence
atggagctggacctgagccccccccacctgagcagcagccccgaggacctgtgccccgcccccggcaccccccccggcacccccagaccccccgacacccccctgcccgaggaggtgaagagaagccagcccctgctgatccccaccaccggcagaaagctgagagaggaggagagaagagccaccagcctgcccagcatccccaaccccttccccgagctgtgcagcccccccagccagagccccatcctgggcggccccagcagcgccagaggcctgctgcccagagacgccagcagaccccacgtggtgaaggtgtacagcgaggacggcgcctgcagaagcgtggaggtggccgccggcgccaccgccagacacgtgtgcgagatgctggtgcagagagcccacgccctgagcgacgagacctggggcctggtggagtgccacccccacctggccctggagagaggcctggaggaccacgagagcgtggtggaggtgcaggccgcctggcccgtgggcggcgacagcagattcgtgttcagaaagaacttcgccaagtacgagctgttcaagagcagcccccacagcctgttccccgagaagatggtgagcagctgcctggacgcccacaccggcatcagccacgaggacctgatccagaacttcctgaacgccggcagcttccccgagatccagggcttcctgcagctgagaggcagcggcagaaagctgtggaagagattcttctgcttcctgagaagaagcggcctgtactacagcaccaagggcaccagcaaggaccccagacacctgcagtacgtggccgacgtgaacgagagcaacgtgtacgtggtgacccagggcagaaagctgtacggcatgcccaccgacttcggcttctgcgtgaagcccaacaagctgagaaacggccacaagggcctgagaatcttctgcagcgaggacgagcagagcagaacctgctggctggccgccttcagactgttcaagtacggcgtgcagctgtacaagaactaccagcaggcccagagcagacacctgcaccccagctgcctgggcagcccccccctgagaagcgccagcgacaacaccctggtggccatggacttcagcggccacgccggcagagtgatcgagaaccccagagaggccctgagcgtggccctggaggaggcccaggcctggagaaagaagaccaaccacagactgagcctgcccatgcccgccagcggcaccagcctgagcgccgccatccacagaacccagctgtggttccacggcagaatcagcagagaggagagccagagactgatcggccagcagggcctggtggacggcctgttcctggtgagagagagccagagaaacccccagggcttcgtgctgagcctgtgccacctgcagaaggtgaagcactacctgatcctgcccagcgaggaggagggcagactgtacttcagcatggacgacggccagaccagattcaccgacctgctgcagctggtggagttccaccagctgaacagaggcatcctgccctgcctgctgagacactgctgcaccagagtggccctgtag

SEQ ID NO: 83736 - DNA, 1344 bp, Artificial Sequence
  Description of Artificial Sequence: Synthetic coding sequence
atggagctggacctgagccccccccacctgagcagcagccccgaggacctgtgccccgcccccggcaccccccccggcacccccagaccccccgacacccccctgcccgaggaggtgaagagaagccagcccctgctgatccccaccaccggcagaaagctgagagaggaggagagaagagccaccagcctgcccagcatccccaaccccttccccgagctgtgcagcccccccagccagagccccatcctgggcggccccagcagcgccagaggcctgctgcccagagacgccagcagaccccacgtggtgaaggtgtacagcgaggacggcgcctgcagaagcgtggaggtggccgccggcgccaccgccagacacgtgtgcgagatgctggtgcagagagcccacgccctgagcgacgagacctggggcctggtggagtgccacccccacctggccctggagagaggcctggaggaccacgagagcgtggtggaggtgcaggccgcctggcccgtgggcggcgacagcagattcgtgttcagaaagaacttcgccaagtacgagctgttcaagagcagcccccacagcctgttccccgagaagatggtgagcagctgcctggacgcccacaccggcatcagccacgaggacctgatccagaacttcctgaacgccggcagcttccccgagatccagggcttcctgcagctgagaggcagcggcagaaagctgtggaagagattcttctgcttcctgagaagaagcggcctgtactacagcaccaagggcaccagcaaggaccccagacacctgcagtacgtggccgacgtgaacgagagcaacgtgtacgtggtgacccagggcagaaagctgtacggcatgcccaccgacttcggcttctgcgtgaagcccaacaagctgagaaacggccacaagggcctgagaatcttctgcagcgaggacgagcagagcagaacctgctggctggccgccttcagactgttcaagtacggcgtgcagctgtacaagaactaccagcaggcccagagcagacacctgcaccccagctgcctgggcagcccccccctgagaagcgccagcgacaacaccctggtggccatggacttcagcggccacgccggcagagtgatcgagaaccccagagaggccctgagcgtggccctggaggaggcccaggcctggagaaagaagaccaaccacagactgagcctgcccatgcccgccagcggcaccagcctgagcgccgcctgcagctggagcggcagagtgagcggcacccccagagccctgagcagcctgtgcgccacctgcagaaagtag

SEQ ID NO: 83737 - DNA, 1344 bp, Artificial Sequence; identical to SEQ ID NO: 83736
  Description of Artificial Sequence: Synthetic coding sequence

SEQ ID NO: 83738 - DNA, 1599 bp, Artificial Sequence; identical to SEQ ID NO: 83735
  Description of Artificial Sequence: Synthetic coding sequence

SEQ ID NO: 83739 - DNA, 1599 bp, Artificial Sequence; identical to SEQ ID NO: 83735
  Description of Artificial Sequence: Synthetic coding sequence

SEQ ID NO: 83740 - DNA, 1668 bp, Artificial Sequence
  Description of Artificial Sequence: Synthetic coding sequence
atgggcaagtggagacccggccagggccacaccaccggcagcgtgaagcccctgagctgcagcgacgccatggagctggacctgagccccccccacctgagcagcagccccgaggacctgtgccccgcccccggcaccccccccggcacccccagaccccccgacacccccctgcccgaggaggtgaagagaagccagcccctgctgatccccaccaccggcagaaagctgagagaggaggagagaagagccaccagcctgcccagcatccccaaccccttccccgagctgtgcagcccccccagccagagccccatcctgggcggccccagcagcgccagaggcctgctgcccagagacgccagcagaccccacgtggtgaaggtgtacagcgaggacggcgcctgcagaagcgtggaggtggccgccggcgccaccgccagacacgtgtgcgagatgctggtgcagagagcccacgccctgagcgacgagacctggggcctggtggagtgccacccccacctggccctggagagaggcctggaggaccacgagagcgtggtggaggtgcaggccgcctggcccgtgggcggcgacagcagattcgtgttcagaaagaacttcgccaagtacgagctgttcaagagcagcccccacagcctgttccccgagaagatggtgagcagctgcctggacgcccacaccggcatcagccacgaggacctgatccagaacttcctgaacgccggcagcttccccgagatccagggcttcctgcagctgagaggcagcggcagaaagctgtggaagagattcttctgcttcctgagaagaagcggcctgtactacagcaccaagggcaccagcaaggaccccagacacctgcagtacgtggccgacgtgaacgagagcaacgtgtacgtggtgacccagggcagaaagctgtacggcatgcccaccgacttcggcttctgcgtgaagcccaacaagctgagaaacggccacaagggcctgagaatcttctgcagcgaggacgagcagagcagaacctgctggctggccgccttcagactgttcaagtacggcgtgcagctgtacaagaactaccagcaggcccagagcagacacctgcaccccagctgcctgggcagcccccccctgagaagcgccagcgacaacaccctggtggccatggacttcagcggccacgccggcagagtgatcgagaaccccagagaggccctgagcgtggccctggaggaggcccaggcctggagaaagaagaccaaccacagactgagcctgcccatgcccgccagcggcaccagcctgagcgccgccatccacagaacccagctgtggttccacggcagaatcagcagagaggagagccagagactgatcggccagcagggcctggtggacggcctgttcctggtgagagagagccagagaaacccccagggcttcgtgctgagcctgtgccacctgcagaaggtgaagcactacctgatcctgcccagcgaggaggagggcagactgtacttcagcatggacgacggccagaccagattcaccgacctgctgcagctggtggagttccaccagctgaacagaggcatcctgccctgcctgctgagacactgctgcaccagagtggccctgtag

SEQ ID NO: 83741 - DNA, 618 bp, Artificial Sequence
  Description of Artificial Sequence: Synthetic coding sequence
atggccgcccccggcgagagaggcagattccacggcggcaacctgttcttcctgcccggcggcgccagaagcgagatgatggacgacctggccaccgacgccagaggcagaggcgccggcagaagagacgccgccgccagcgccagcacccccgcccaggcccccaccagcgacagccccgtggccgaggacgccagcagaagaagaccctgcagagcctgcgtggacttcaagacctggatgagaacccagcagaagagagacaccaagttcagagaggactgcccccccgacagagaggagctgggcagacacagctgggccgtgctgcacaccctggccgcctactaccccgacctgcccacccccgagcagcagcaggacatggcccagttcatccacctgttcagcaagttctacccctgcgaggagtgcgccgaggacctgagaaagagactgtgcagaaaccaccccgacaccagaaccagagcctgcttcacccagtggctgtgccacctgcacaacgaggtgaacagaaagctgggcaagcccgacttcgactgcagcaaggtggacgagagatggagagacggctggaaggacggcagctgcgactag

SEQ ID NO: 83742 - DNA, 285 bp, Artificial Sequence
  Description of Artificial Sequence: Synthetic coding sequence
atgagaacccagcagaagagagacaccaagttcagagaggactgcccccccgacagagaggagctgggcagacacagctgggccgtgctgcacaccctggccgcctactaccccgacctgcccacccccgagcagcagcaggacatggcccagttcatccacctgttcagcaagttctacccctgcgaggagtgcgccgaggacctgagaaagagactgtgcagaaaccaccccgacaccagaaccagagcctgcttcaccgtggccgtgccccccgcccagtag

SEQ ID NO: 83743 - DNA, 1629 bp, Artificial Sequence
  Description of Artificial Sequence: Synthetic coding sequence
atgagcccctgccccgaggaggccgccatgagaagagaggtggtgaagagaatcgagaccgtggtgaaggacctgtggcccaccgccgacgtgcagatcttcggcagcttcagcaccggcctgtacctgcccaccagcgacatcgacctggtggtgttcggcaagtgggagagaccccccctgcagctgctggagcaggccctgagaaagcacaacgtggccgagccctgcagcatcaaggtgctggacaaggccaccgtgcccatcatcaagctgaccgaccaggagaccgaggtgaaggtggacatcagcttcaacatggagaccggcgtgagagccgccgagttcatcaagaactacatgaagaagtacagcctgctgccctacctgatcctggtgctgaagcagttcctgctgcagagagacctgaacgaggtgttcaccggcggcatcagcagctacagcctgatcctgatggccatcagcttcctgcagctgcaccccagaatcgacgccagaagagccgacgagaacctgggcatgctgctggtggagttcttcgagctgtacggcagaaacttcaactacctgaagaccggcatcagaatcaaggagggcggcgcctacatcgccaaggaggagatcatgaaggccatgaccagcggctacagacccagcatgctgtgcatcgaggaccccctgctgcccggcaacgacgtgggcagaagcagctacggcgccatgcaggtgaagcaggtgttcgactacgcctacatcgtgctgagccacgccgtgagccccctggccagaagctaccccaacagagacgccgagagcaccctgggcagaatcatcaaggtgacccaggaggtgatcgactacagaagatggatcaaggagaagtggggcagcaaggcccaccccagccccggcatggacagcagaatcaagatcaaggagagaatcgccacctgcaacggcgagcagacccagaacagagagcccgagagcccctacggccagagactgaccctgagcctgagcagcccccagctgctgagcagcggcagcagcgccagcagcgtgagcagcctgagcggcagcgacgtggacagcgacacccccccctgcaccacccccagcgtgtaccagttcagcctgcaggcccccgcccccctgatggccggcctgcccaccgccctgcccatgcccagcggcaagccccagcccaccaccagcagaaccctgatcatgaccaccaacaaccagaccagattcaccatccccccccccaccctgggcgtggcccccgtgccctgcagacaggccggcgtggagggcaccgccagcctgaaggccgtgcaccacatgagcagccccgccatccccagcgccagccccaaccccctgagcagcccccacctgtaccacaagcagcacaacggcatgaagctgagcatgaagggcagccacggccacacccagggcggcggctacagcagcgtgggcagcggcggcgtgagaccccccgtgggcaacagaggccaccaccagtacaacagaaccggctggagaagaaagaagcacacccacaccagagacagcctgcccgtgagcctgagcagatag

SEQ ID NO: 83744 - DNA, 885 bp, Artificial Sequence
  Description of Artificial Sequence: Synthetic coding sequence
atggacctgtggcagctgctgctgaccctggccctggccggcagcagcgacgccttcagcggcagcgaggccaccgccgccatcctgagcagagccccctggagcctgcagagcgtgaaccccggcctgaagaccaacagcagcaaggagcccaagttcaccaagtgcagaagccccgagagagagaccttcagctgccactggaccgacgaggtgcaccacggcaccaagaacctgggccccatccagctgttctacaccagaagaaacacccaggagtggacccaggagtggaaggagtgccccgactacgtgagcgccggcgagaacagctgctacttcaacagcagcttcaccagcatctggatcccctactgcatcaagctgaccagcaacggcggcaccgtggacgagaagtgcttcagcgtggacgagatcgtgcagcccgacccccccatcgccctgaactggaccctgctgaacgtgagcctgaccggcatccacgccgacatccaggtgagatgggaggcccccagaaacgccgacatccagaagggctggatggtgctggagtacgagctgcagtacaaggaggtgaacgagaccaagtggaagatgatggaccccatcctgaccaccagcgtgcccgtgtacagcctgaaggtggacaaggagtacgaggtgagagtgagaagcaagcagagaaacagcggcaactacggcgagttcagcgaggtgctgtacgtgaccctgccccagatgagccagttcacctgcgaggaggacttctacttcccctggctgctgatcatcatcttcggcatcttcggcctgaccgtgatgctgttcgtgttcctgttcagcaagcagcagagccagaactag

SEQ ID NO: 83745 - DNA, 1851 bp, Artificial Sequence
  Description of Artificial Sequence: Synthetic coding sequence
atggacctgtggcagctgctgctgaccctggccctggccggcagcagcgacgccttcagcggcagcgaggacagcagcaaggagcccaagttcaccaagtgcagaagccccgagagagagaccttcagctgccactggaccgacgaggtgcaccacggcaccaagaacctgggccccatccagctgttctacaccagaagaaacacccaggagtggacccaggagtggaaggagtgccccgactacgtgagcgccggcgagaacagctgctacttcaacagcagcttcaccagcatctggatcccctactgcatcaagctgaccagcaacggcggcaccgtggacgagaagtgcttcagcgtggacgagatcgtgcagcccgacccccccatcgccctgaactggaccctgctgaacgtgagcctgaccggcatccacgccgacatccaggtgagatgggaggcccccagaaacgccgacatccagaagggctggatggtgctggagtacgagctgcagtacaaggaggtgaacgagaccaagtggaagatgatggaccccatcctgaccaccagcgtgcccgtgtacagcctgaaggtggacaaggagtacgaggtgagagtgagaagcaagcagagaaacagcggcaactacggcgagttcagcgaggtgctgtacgtgaccctgccccagatgagccagttcacctgcgaggaggacttctacttcccctggctgctgatcatcatcttcggcatcttcggcctgaccgtgatgctgttcgtgttcctgttcagcaagcagcagagaatcaagatgctgatcctgccccccgtgcccgtgcccaagatcaagggcatcgaccccgacctgctgaaggagggcaagctggaggaggtgaacaccatcctggccatccacgacagctacaagcccgagttccacagcgacgacagctgggtggagttcatcgagctggacatcgacgagcccgacgagaagaccgaggagagcgacaccgacagactgctgagcagcgaccacgagaagagccacagcaacctgggcgtgaaggacggcgacagcggcagaaccagctgctgcgagcccgacatcctggagaccgacttcaacgccaacgacatccacgagggcaccagcgaggtggcccagccccagagactgaagggcgaggccgacctgctgtgcctggaccagaagaaccagaacaacagcccctaccacgacgcctgccccgccacccagcagcccagcgtgatccaggccgagaagaacaagccccagcccctgcccaccgagggcgccgagagcacccaccaggccgcccacatccagctgagcaaccccagcagcctgagcaacatcgacttctacgcccaggtgagcgacatcacccccgccggcagcgtggtgctgagccccggccagaagaacaaggccggcatgagccagtgcgacatgcaccccgagatggtgagcctgtgccaggagaacttcctgatggacaacgcctacttctgcgaggccgacgccaagaagtgcatccccgtggccccccacatcaaggtggagagccacatccagcccagcctgaaccaggaggacatctacatcaccaccgagagcctgaccaccgccgccggcagacccggcaccggcgagcacgtgcccggcagcgagatgcccgtgcccgactacaccagcatccacatcgtgcagagcccccagggcctgatcctgaacgccaccgccctgcccctgcccgacaaggagttcctgagcagctgcggctacgtgagcaccgaccagctgaacaagatcatgccctag

SEQ ID NO: 83746 - DNA, 1356 bp, Artificial Sequence
  Description of Artificial Sequence: Synthetic coding sequence
atggtgctggagtacgagctgcagtacaaggaggtgaacgagaccaagtggaagatgatggaccccatcctgaccaccagcgtgcccgtgtacagcctgaaggtggacaaggagtacgaggtgagagtgagaagcaagcagagaaacagcggcaactacggcgagttcagcgaggtgctgtacgtgaccctgccccagatgagccagttcacctgcgaggaggacttctacttcccctggctgctgatcatcatcttcggcatcttcggcctgaccgtgatgctgttcgtgttcctgttcagcaagcagcagagaatcaagatgctgatcctgccccccgtgcccgtgcccaagatcaagggcatcgaccccgacctgctgaaggagggcaagctggaggaggtgaacaccatcctggccatccacgacagctacaagcccgagttccacagcgacgacagctgggtggagttcatcgagctggacatcgacgagcccgacgagaagaccgaggagagcgacaccgacagactgctgagcagcgaccacgagaagagccacagcaacctgggcgtgaaggacggcgacagcggcagaaccagctgctgcgagcccgacatcctggagaccgacttcaacgccaacgacatccacgagggcaccagcgaggtggcccagccccagagactgaagggcgaggccgacctgctgtgcctggaccagaagaaccagaacaacagcccctaccacgacgcctgccccgccacccagcagcccagcgtgatccaggccgagaagaacaagccccagcccctgcccaccgagggcgccgagagcacccaccaggccgcccacatccagctgagcaaccccagcagcctgagcaacatcgacttctacgcccaggtgagcgacatcacccccgccggcagcgtggtgctgagccccggccagaagaacaaggccggcatgagccagtgcgacatgcaccccgagatggtgagcctgtgccaggagaacttcctgatggacaacgcctacttctgcgaggccgacgccaagaagtgcatccccgtggccccccacatcaaggtggagagccacatccagcccagcctgaaccaggaggacatctacatcaccaccgagagcctgaccaccgccgccggcagacccggcaccggcgagcacgtgcccggcagcgagatgcccgtgcccgactacaccagcatccacatcgtgcagagcccccagggcctgatcctgaacgccaccgccctgcccctgcccgacaaggagttcctgagcagctgcggctacgtgagcaccgaccagctgaacaagatcatgccctag

SEQ ID NO: 83747 - DNA, 327 bp, Artificial Sequence
  Description of Artificial Sequence: Synthetic coding sequence
atgcccctgtgggtgttcttcttcgtgatcctgaccctgagcaacagcagccactgcagcccccccccccccctgaccctgagaatgagaagatacgccgacgccatcttcaccaacagctacagaaaggtgctgggccagctgagcgccagaaagctgctgcaggacatcatgagcagacagcagggcgagagcaaccaggagagaggcgccagagccagactgggcagacaggtggacagcatgtgggccgagcagaagcagatggagctggagagcatcctggtggccctgctgcagaagcacagcagaaacagccagggctag

SEQ ID NO: 83748 - DNA, 324 bp, Artificial Sequence
  Description of Artificial Sequence: Synthetic coding sequence
atgcccctgtgggtgttcttcttcgtgatcctgaccctgagcaacagcagccactgcagcccccccccccccctgaccctgagaatgagaagatacgccgacgccatcttcaccaacagctacagaaaggtgctgggccagctgagcgccagaaagctgctgcaggacatcatgagcagacagcagggcgagagcaaccaggagagaggcgccagagccagactgggcagacaggtggacagcatgtgggccgagcagaagcagatggagctggagagcatcctggtggccctgctgcagaagcacagaaacagccagggctag

SEQ ID NO: 83749 - DNA, 327 bp, Artificial Sequence; identical to SEQ ID NO: 83747
  Description of Artificial Sequence: Synthetic coding sequence

SEQ ID NO: 83750 - DNA, 1272 bp, Artificial Sequence
  Description of Artificial Sequence: Synthetic coding sequence
atggacagaagaatgtggggcgcccacgtgttctgcgtgctgagccccctgcccaccgtgctgggccacatgcaccccgagtgcgacttcatcacccagctgagagaggacgagagcgcctgcctgcaggccgccgaggagatgcccaacaccaccctgggctgccccgccacctgggacggcctgctgtgctggcccaccgccggcagcggcgagtgggtgaccctgccctgccccgacttcttcagccacttcagcagcgagagcggcgccgtgaagagagactgcaccatcaccggctggagcgagcccttccccccctaccccgtggcctgccccgtgcccctggagctgctggccgaggaggagagctacttcagcaccgtgaagatcatctacaccgtgggccacagcatcagcatcgtggccctgttcgtggccatcaccatcctggtggccctgagaagactgcactgccccagaaactacgtgcacacccagctgttcaccaccttcatcctgaaggccggcgccgtgttcctgaaggacgccgccctgttccacagcgacgacaccgaccactgcagcttcagcaccgtgctgtgcaaggtgagcgtggccgccagccacttcgccaccatgaccaacttcagctggctgctggccgaggccgtgtacctgaactgcctgctggccagcaccagccccagcagcagaagagccttctggtggctggtgctggccggctggggcctgcccgtgctgttcaccggcacctgggtgagctgcaagctggccttcgaggacatcgcctgctgggacctggacgacaccagcccctactggtggatcatcaagggccccatcgtgctgagcgtgggcgtgaacttcggcctgttcctgaacatcatcagaatcctggtgagaaagctggagcccgcccagggcagcctgcacacccagagccagtactggagactgagcaagagcaccctgttcctgatccccctgttcggcatccactacatcatcttcaacttcctgcccgacaacgccggcctgggcatcagactgcccctggagctgggcctgggcagcttccagggcttcatcgtggccatcctgtactgcttcctgaaccaggaggtgagaaccgagatcagcagaaagtggcacggccacgaccccgagctgctgcccgcctggagaaccagagccaagtggaccacccccagcagaagcgccgccaaggtgctgaccagcatgtgctag

SEQ ID NO: 83751 - DNA, 207 bp, Artificial Sequence
  Description of Artificial Sequence: Synthetic coding sequence
atggtgcccggcacccccagccccctgctgggcagaggcaaggagctgtggctggagagcctggcctgcctgcccggcgccgtgaagagagactgcaccatcaccggctggagcgagcccttccccccctaccccgtggcctgccccgtgcccctggagctgctggccgaggagggctgcccctgcagcagcctggccagaggctag

SEQ ID NO: 83752 - DNA, 438 bp, Artificial Sequence
  Description of Artificial Sequence: Synthetic coding sequence
atggtgcccggcacccccagccccctgctgggcagaggcaaggagctgtggctggagagcctggcctgcctgcccggcgccgtgaagagagactgcaccatcaccggctggagcgagcccttccccccctaccccgtggcctgccccgtgcccctggagctgctggccgaggaggagagctacttcagcaccgtgaagatcatctacaccgtgggccacagcatcagcatcgtggccctgttcgtggccatcaccatcctggtggccctgagaagactgcactgccccagaaactacgtgcacacccagctgttcaccaccttcatcctgaaggccggcgccgtgttcctgaaggacgccgccctgttccacagcgacgacaccgaccactgcagcttcagcaccggctgcccctgcagcagcctggccagaggctag

SEQ ID NO: 83753 - DNA, 456 bp, Artificial Sequence
  Description of Artificial Sequence: Synthetic coding sequence
atgctgcccttcagcaccgccaccaccctgaccaccgccgccagccccctggccgccagagccctgcactggcacgtgggcgagctgcagaccggcctgagaggccacagagtgctgggccccggcagacacctgcccctgctggtggaccaccagagagcccactgccccctgggcagaggcgagctgtgggccttcagccagtactacccccaccccggcgaggagaccggcgccagcagcggccagcccccctaccccgtgagcgtgctggccagcctgcaggtggacaccttccccgaccccaccctgtggaacagcctgcaccacctgcagctgcccgccagacagtgctggcccggccacccccccccccccggcgccggcaccggcttcctgcccggcctgcactgctgccaccccctgctgctgccccagcccagaggcgaggactag

SEQ ID NO: 83754 - DNA, 1080 bp, Artificial Sequence
  Description of Artificial Sequence: Synthetic coding sequence
atggtgcccggcacccccagccccctgctgggcagaggcaaggagctgtggctggagagcctggcctgcctgcccggcgccgtgaagagagactgcaccatcaccggctggagcgagcccttccccccctaccccgtggcctgccccgtgcccctggagctgctggccgaggaggagagctacttcagcaccgtgaagatcatctacaccgtgggccacagcatcagcatcgtggccctgttcgtggccatcaccatcctggtggccctgagaagactgcactgccccagaaactacgtgcacacccagctgttcaccaccttcatcctgaaggccggcgccgtgttcctgaaggacgccgccctgttccacagcgacgacaccgaccactgcagcttcagcaccgtgctgtgcaaggtgagcgtggccgccagccacttcgccaccatgaccaacttcagctggctgctggccgaggccgtgtacctgaactgcctgctggccagcaccagccccagcagcagaagagccttctggtggctggtgctggccggctggggcctgcccgtgctgttcaccggcacctgggtgagctgcaagctggccttcgaggacatcgcctgctgggacctggacgacaccagcccctactggtggatcatcaagggccccatcgtgctgagcgtgggcgtgaacttcggcctgttcctgaacatcatcagaatcctggtgagaaagctggagcccgcccagggcagcctgcacacccagagccagtactggagactgagcaagagcaccctgttcctgatccccctgttcggcatccactacatcatcttcaacttcctgcccgacaacgccggcctgggcatcagactgcccctggagctgggcctgggcagcttccagggcttcatcgtggccatcctgtactgcttcctgaaccaggaggtgagaaccgagatcagcagaaagtggcacggccacgaccccgagctgctgcccgcctggagaaccagagccaagtggaccacccccagcagaagcgccgccaaggtgctgaccagcatgtgctag

SEQ ID NO: 83755 - DNA, 1101 bp, Artificial Sequence
  Description of Artificial Sequence: Synthetic coding sequence
atgtggaacgccacccccagcgaggagcccggcttcaacctgaccctggccgacctggactgggacgccagccccggcaacgacagcctgggcgacgagctgctgcagctgttccccgcccccctgctggccggcgtgaccgccacctgcgtggccctgttcgtggtgggcatcgccggcaacctgctgaccatgctggtggtgagcagattcagagagctgagaaccaccaccaacctgtacctgagcagcatggccttcagcgacctgctgatcttcctgtgcatgcccctggacctggtgagactgtggcagtacagaccctggaacttcggcgacctgctgtgcaagctgttccagttcgtgagcgagagctgcacctacgccaccgtgctgaccatcaccgccctgagcgtggagagatacttcgccatctgcttccccctgagagccaaggtggtggtgaccaagggcagagtgaagctggtgatcttcgtgatctgggccgtggccttctgcagcgccggccccatcttcgtgctggtgggcgtggagcacgagaacggcaccgacccctgggacaccaacgagtgcagacccaccgagttcgccgtgagaagcggcctgctgaccgtgatggtgtgggtgagcagcatcttcttcttcctgcccgtgttctgcctgaccgtgctgtacagcctgatcggcagaaagctgtggagaagaagaagaggcgacgccgtggtgggcgccagcctgagagaccagaaccacaagcagaccgtgaagatgctggccgtggtggtgttcgccttcatcctgtgctggctgcccttccacgtgggcagatacctgttcagcaagagcttcgagcccggcagcctggagatcgcccagatcagccagtactgcaacctggtgagcttcgtgctgttctacctgagcgccgccatcaaccccatcctgtacaacatcatgagcaagaagtacagagtggccgtgttcagactgctgggcttcgagcccttcagccagagaaagctgagcaccctgaaggacgagagcagcagagcctggaccgagagcagcatcaacacctag

SEQ ID NO: 83756 - DNA, 870 bp, Artificial Sequence
  Description of Artificial Sequence: Synthetic coding sequence
atgtggaacgccacccccagcgaggagcccggcttcaacctgaccctggccgacctggactgggacgccagccccggcaacgacagcctgggcgacgagctgctgcagctgttccccgcccccctgctggccggcgtgaccgccacctgcgtggccctgttcgtggtgggcatcgccggcaacctgctgaccatgctggtggtgagcagattcagagagctgagaaccaccaccaacctgtacctgagcagcatggccttcagcgacctgctgatcttcctgtgcatgcccctggacctggtgagactgtggcagtacagaccctggaacttcggcgacctgctgtgcaagctgttccagttcgtgagcgagagctgcacctacgccaccgtgctgaccatcaccgccctgagcgtggagagatacttcgccatctgcttccccctgagagccaaggtggtggtgaccaagggcagagtgaagctggtgatcttcgtgatctgggccgtggccttctgcagcgccggccccatcttcgtgctggtgggcgtggagcacgagaacggcaccgacccctgggacaccaacgagtgcagacccaccgagttcgccgtgagaagcggcctgctgaccgtgatggtgtgggtgagcagcatcttcttcttcctgcccgtgttctgcctgaccgtgctgtacagcctgatcggcagaaagctgtggagaagaagaagaggcgacgccgtggtgggcgccagcctgagagaccagaaccacaagcagaccgtgaagatgctgggcggcagccagagagccctgagactgagcctggccggccccatcctgagcctgtgcctgctgcccagcctgtag

SEQ ID NO: 83757 - DNA, 666 bp, Artificial Sequence
  Description of Artificial Sequence: Synthetic coding sequence
atggccttcgtgaagagcggctggctgctgagacagagcaccatcctgaagagatggaagaagaactggttcgacctgtggagcgacggccacctgatctactacgacgaccagaccagacagaacatcgaggacaaggtgcacatgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctggcctggaagttcaccctgcaggacagcagaaccaacaccgcctacgtgggcagcgccgtgatgaccgacgagaccagcgtggtgagcagcccccccccctacaccgcctacgccgcccccgcccccgaggcctacggctacggcccctacggcggcgcctacccccccggcacccaggtggtgtacgccgccaacggccaggcctacgccgtgccctaccagtacccctacgccggcctgtacggccagcagcccgccaaccaggtgatcatcagagagagatacagagacaacgacagcgacctggccctgggcatgctggccggcgccgccaccggcatggccctgggcagcctgttctgggtgttctag

SEQ ID NO: 83758 - DNA, 1230 bp, Artificial Sequence
  Description of Artificial Sequence: Synthetic coding sequence
atgggcaacagctacgccggccagctgaagaccaccagattcgaggaggtgctgcacaacagcatcgaggccagcctgagaagcaacaacctggtgcccagacccatcttcagccagctgtacctggaggccgagcagcagctggccgccctggagggcggcagcagagtggacaacgaggaggaggaggaggagggcgagggcggcctggagaccaacggcccccccaaccccttccagctgcaccccctgcccgagggctgctgcaccaccgacggcttctgccaggccggcaaggacctgagactggtgagcatcagcaacgagcccatggacgtgcccgccggcttcctgctggtgggcgtgaagagccccagcctgcccgaccacctgctggtgtgcgccgtggacaagagattcctgcccgacgacaacggccacaacgccctgctgggcttcagcggcaactgcgtgggctgcggcaagaagggcttctgctacttcaccgagttcagcaaccacatcaacctgaagctgaccacccagcccaagaagcagaagcacctgaagtactacctggtgagaaacgcccagggcaccctgaccaagggccccctgatctgctggaagggcagcgagttcagaagcagacagatccccgccagcacctgcagcagcagcctgttccccgccctggagagcaccgccgccttccccagcgagcccgtgcccggcaccaaccccagcatcctgatgggcgcccagcaggccggccccgccagcgaccaccccagcctgaacgccgccatgggccccgccgtgttcaacggcaaggacagccccaagtgccagcagctggccaagaacaacctgctggccctgcccagacccagcgccctgggcatcctgagcaacagcggcccccccaagaagagacacaagggctggagccccgagagccccagcgcccccgacggcggctgcccccagggcggcggcaacagagccaagtacgagagcgccggcatgagctgcgtgccccaggtgggcctggtgggccccgccagcgtgaccttccccgtggtggccagcggcgagcccgtgagcgtgcccgacaacctgctgaagatctgcaaggccaagcccgtgatcttcaaggtgttcgtgaacggcgccacccagatggtggccctgggccccgccgagcccgccagccccagaagcctgtag

SEQ ID NO: 83759 - DNA, 1374 bp, Artificial Sequence
  Description of Artificial Sequence: Synthetic coding sequence
atgggcaacagctacgccggccagctgaagaccaccagattcgaggaggtgctgcacaacagcatcgaggccagcctgagaagcaacaacctggtgcccagacccatcttcagccagctgtacctggaggccgagcagcagctggccgccctggagggcggcagcagagtggacaacgaggaggaggaggaggagggcgagggcggcctggagaccaacggcccccccaaccccttccagctgcaccccctgcccgagggctgctgcaccaccgacggcttctgccaggccggcaaggacctgagactggtgagcatcagcaacgagcccatggacgtgcccgccggcttcctgctggtgggcgtgaagagccccagcctgcccgaccacctgctggtgtgcgccgtggacaagagattcctgcccgacgacaacggccacaacgccctgctgggcttcagcggcaactgcgtgggctgcggcaagaagggcttctgctacttcaccgagttcagcaaccacatcaacctgaagctgaccacccagcccaagaagcagaagcacctgaagtactacctggtgagaaacgcccagggcaccctgaccaagggccccctgatctgctggaagggcagcgagttcagaagcagacagatccccgccagcacctgcagcagcagcctgttccccgccctggagagcaccgccgccttccccagcgagcccgtgcccggcaccaaccccagcatcctgatgggcgcccagcaggccggccccgccagcgaccaccccagcctgaacgccgccatgggccccgccgtgttcaacggcaaggacagccccaagtgccagcagctggccaagaacaacctgctggccctgcccagacccagcgccctgggcatcctgagcaacagcggcccccccaagaagagacacaagggctggagccccgagagccccagcgcccccgacggcggctgcccccagggcggcggcaacagagccaagtacgagagcgccggcatgagctgcgtgccccaggtgggcctggtgggccccgccagcgtgaccttccccgtggtggccagcggcgagcccgtgagcgtgcccgacaacctgctgaagatctgcaaggccaagcccgtgatcttcaagggccacggcaacttcccctacctgtgcggcaacctgaacgacgtggtggtgagccccctgctgtacacctgctaccagaacagccagagcgtgagcagagcctacgagcagtacggcgccagcgccatccagcccatcagcgaggagatgcagctgctgctgaccgtgtactacctggtgcagctggcccaccagatcagaaaccccgacgtgtag

SEQ ID NO: 83760 - DNA, 5850 bp, Artificial Sequence
  Description of Artificial Sequence: Synthetic coding sequence
atgggcaacagctacgccggccagctgaagaccaccagattcgaggaggtgctgcacaacagcatcgaggccagcctgagaagcaacaacctggtgcccagacccatcttcagccagctgtacctggaggccgagcagcagctggccgccctggagggcggcagcagagtggacaacgaggaggaggaggaggagggcgagggcggcctggagaccaacggcccccccaaccccttccagctgcaccccctgcccgagggctgctgcaccaccgacggcttctgccaggccggcaaggacctgagactggtgagcatcagcaacgagcccatggacgtgcccgccggcttcctgctggtgggcgtgaagagccccagcctgcccgaccacctgctggtgtgcgccgtggacaagagattcctgcccgacgacaacggccacaacgccctgctgggcttcagcggcaactgcgtgggctgcggcaagaagggcttctgctacttcaccgagttcagcaaccacatcaacctgaagctgaccacccagcccaagaagcagaagcacctgaagtactacctggtgagaaacgcccagggcaccctgaccaagggccccctgatctgctggaagggcagcgagttcagaagcagacagatccccgccagcacctgcagcagcagcctgttccccgccctggagagcaccgccgccttccccagcgagcccgtgcccggcaccaaccccagcatcctgatgggcgcccagcaggccggccccgccagcgaccaccccagcctgaacgccgccatgggccccgccgtgttcaacggcaaggacagccccaagtgccagcagctggccaagaacaacctgctggccctgcccagacccagcgccctgggcatcctgagcaacagcggcccccccaagaagagacacaagggctggagccccgagagccccagcgcccccgacggcggctgcccccagggcggcggcaacagagccaagtacgagagcgccggcatgagctgcgtgccccaggtgggcctggtgggccccgccagcgtgaccttccccgtggtggccagcggcgagcccgtgagcgtgcccgacaacctgctgaagatctgcaaggccaagcccgtgatcttcaagggccacggcaacttcccctacctgtgcggcaacctgaacgacgtggtggtgagccccctgctgtacacctgctaccagaacagccagagcgtgagcagagcctacgagcagtacggcgccagcgccatccagcccatcagcgaggagatgcagctgctgctgaccgtgtactacctggtgcagctggccgccgaccaggtgcccctgatggaggacctggagcagatcttcctgagaagctggagagagagccacctgaccgagatcagacagtaccagcaggcccccccccagcccttcccccccgcccccagcgccgccgcccccgtgaccagcgcccagctgccctggctggccagcctggccgccagcagctgcaacgacagcgtgcacgtgatcgagtgcgcctacagcctggccgagggcctgagcgagatgttcagactgctggtggagggcaagctggccaagaccaactacgtggtgatcatctgcgcctgcagaagcgccgccatcgacagctgcatcgccgtgaccggcaagtaccaggccagaatcctgagcgagagcctgctgacccccgccgagtaccagaaggaggtgaactacgagctggtgaccggcaaggtggacagcctgggcgccttcttcagcaccctgtgccccgagggcgacatcgacatcctgctggacaagttccaccaggagaaccagggccacatcagcagcagcctggccgccagcagcgtgaccaaggccgccagcctggacgtgagcggcacccccgtgtgcaccagctacaacctggagccccacagcatcagacccttccagctggccgtggcccagaagctgctgagccacgtgtgcagcatcgccgacagcagcacccagaacctggacctgggcagcttcgagaaggtggacttcctgatctgcatcccccccagcgaggtgacctaccagcagaccctgctgcacgtgtggcacagcggcgtgctgctggagctgggcctgaagaaggagcacatgaccaagcagagagtggagcagtacgtgctgaagctggacaccgaggcccagaccaagttcaaggccttcctgcagaacagcttccagaacccccacaccctgttcgtgctgatccacgaccacgcccactgggacctggtgagcagcaccgtgcacaacctgtacagccagagcgaccccagcgtgggcctggtggacagactgctgaactgcagagaggtgaaggaggcccccaacatcgtgaccctgcacgtgaccagcttcccctacgccctgcagacccagcacaccctgatcagcccctacaacgagatccactggcccgccagctgcagcaacggcgtggacctgtaccacgagaacaagaagtacttcggcctgagcgagttcatcgagagcaccctgagcggccacagcctgcccctgctgagatacgacagcagcttcgaggccatggtgaccgccctgggcaagagattccccagactgcacagcgccgtgatcagaaccttcgtgctggtgcagcactacgccgccgccctgatggccgtgagcggcctgccccagatgaagaactacaccagcgtggagaccctggagatcacccagaacctgctgaacagccccaagcagtgcccctgcggccacggcctgatggtgctgctgagagtgccctgcagccccctggccgtggtggcctacgagagactggcccacgtgagagccagactggccctggaggagcacttcgagatcatcctgggcagccccagcagcggcgtgaccgtgggcaagcacttcgtgaagcagctgagaatgtggcagaagatcgaggacgtggagtggagaccccagacctacctggagctggagggcctgccctgcatcctgatcttcagcggcatggacccccacggcgagagcctgcccagaagcctgagatactgcgacctgagactgatcaacagcagctgcctggtgagaaccgccctggagcaggagctgggcctggccgcctacttcgtgagcaacgaggtgcccctggagaagggcgccagaaacgaggccctggagagcgacgccgagaagctgagcagcaccgacaacgaggacgaggagctgggcaccgagggcagcaccagcgagaagagaagccccatgaagagagagagaagcagaagccacgacagcgccagcagcagcctgagcagcaaggccagcggcagcgccctgggcggcgagagcagcgcccagcccaccgccctgccccagggcgagcacgccagaagcccccagcccagaggccccgccgaggagggcagagcccccggcgagaagcagagacccagagccagccagggcccccccagcgccatcagcagacacagccccggccccaccccccagcccgactgcagcctgagaaccggccagagaagcgtgcaggtgagcgtgaccagcagctgcagccagctgagcagcagcagcggcagcagcagcagcagcgtggcccccgccgccggcacctgggtgctgcaggccagccagtgcagcctgaccaaggcctgcagacagccccccatcgtgttcctgcccaagctggtgtacgacatggtggtgagcaccgacagcagcggcctgcccaaggccgccagcctgctgcccagccccagcgtgatgtgggccagcagcttcagacccctgctgagcaagaccatgaccagcaccgagcagagcctgtactacagacagtggaccgtgcccagacccagccacatggactacggcaacagagccgagggcagagtggacggcttccaccccagaagactgctgctgagcggccccccccagatcggcaagaccggcgcctacctgcagttcctgagcgtgctgagcagaatgctggtgagactgaccgaggtggacgtgtacgacgaggaggagatcaacatcaacctgagagaggagagcgactggcactacctgcagctgagcgacccctggcccgacctggagctgttcaagaagctgcccttcgactacatcatccacgaccccaagtacgaggacgccagcctgatctgcagccactaccagggcatcaagagcgaggacagaggcatgagcagaaagcccgaggacctgtacgtgagaagacagaccgccagaatgagactgagcaagtacgccgcctacaacacctaccaccactgcgagcagtgccaccagtacatgggcttccaccccagataccagctgtacgagagcaccctgcacgccttcgccttcagctacagcatgctgggcgaggagatccagctgcacttcatcatccccaagagcaaggagcaccacttcgtgttcagccagcccggcggccagctggagagcatgagactgcccctggtgaccgacaagagccacgagtacatcaagagccccaccttcacccccaccaccggcagacacgagcacggcctgttcaacctgtaccacgccatggacggcgccagccacctgcacgtgctggtggtgaaggagtacgagatggccatctacaagaagtactggcccaaccacatcatgctggtgctgcccagcatcttcaacagcgccggcgtgggcgccgcccacttcctgatcaaggagctgagctaccacaacctggagctggagagaaacagacaggaggagctgggcatcaagccccaggacatctggcccttcatcgtgatcagcgacgacagctgcgtgatgtggaacgtggtggacgtgaacagcgccggcgagagaagcagagagttcagctggagcgagagaaacgtgagcctgaagcacatcatgcagcacatcgaggccgcccccgacatcatgcactacgccctgctgggcctgagaaagtggagcagcaagaccagagccagcgaggtgcaggagcccttcagcagatgccacgtgcacaacttcatcatcctgaacgtggacctgacccagaacgtgcagtacaaccagaacagattcctgtgcgacgacgtggacttcaacctgagagtgcacagcgccggcctgctgctgtgcagattcaacagattcagcgtgatgaagaagcagatcgtggtgggcggccacagaagcttccacatcaccagcaaggtgagcgacaacagcgccgccgtggtgcccgcccagtacatctgcgcccccgacagcaagcacaccttcctggccgcccccgcccagctgctgctggagaagttcctgcagcaccacagccacctgttcttccccctgagcctgaagaaccacgaccaccccgtgctgagcgtggactgctacctgaacctgggcagccagatcagcgtgtgctacgtgagcagcagaccccacagcctgaacatcagctgcagcgacctgctgttcagcggcctgctgctgtacctgtgcgacagcttcgtgggcgccagcttcctgaagaagttccacttcctgaagggcgccaccctgtgcgtgatctgccaggacagaagcagcctgagacagaccgtggtgagactggagctggaggacgagtggcagttcagactgagagacgagttccagaccgccaacgccagagaggacagacccctgttcttcctgaccggcagacacatctag

SEQ ID NO: 83761 - DNA, 1188 bp, Artificial Sequence
  Description of Artificial Sequence: Synthetic coding sequence
atgaccctgagaagactgagaaagctgcagcagaaggaggaggccgccgccacccccgaccccgccgccagaacccccgacagcgaggtggcccccgccgcccccgtgcccacccccggcccccccgccgccgccgccacccccggcccccccgccgacgagctgtacgccgccctggaggactaccaccccgccgagctgtacagagccctggccgtgagcggcggcaccctgcccagaagaaagggcagcggcttcagatggaagaacctgagccagagccccgagcagcagagaaaggtgctgaccctggagaaggaggacaaccagaccttcggcttcgagatccagacctacggcctgcaccacagagaggagcagagagtggagatggtgaccttcgtgtgcagagtgcacgagagcagccccgcccagctggccggcctgacccccggcgacaccatcgccagcgtgaacggcctgaacgtggagggcatcagacacagagagatcgtggacatcatcaaggccagcggcaacgtgctgagactggagaccctgtacggcaccagcatcagaaaggccgagctggaggccagactgcagtacctgaagcagaccctgtacgagaagtggggcgagtacagaagcctgatggtgcaggagcagagactggtgcacggcctggtggtgaaggaccccagcatctacgacaccctggagagcgtgagaagctgcctgtacggcgccggcctgctgcccggcagcctgcccttcggccccctgctggccgtgcccggcagacccagaggcggcgccagaagagccagaggcgacgccgacgacgccgtgtaccacacctgcttcttcggcgacagcgagccccccgccctgccccccccccccccccccgccagagccttcggccccggccccgccgagacccccgccgtgggccccggccccggccccagagccgccctgagcagaagcgccagcgtgagatgcgccggccccggcggcggcggcggcggcggcgcccccggcgccctgtggaccgaggccagagagcaggccctgtgcggccccggcctgagaaagaccaagtacagaagcttcagaagaagactgctgaagttcatccccggcctgaacagaagcctggaggaggaggagagccagctgtag

SEQ ID NO: 83762 - DNA, 759 bp, Artificial Sequence
  Description of Artificial Sequence: Synthetic coding sequence
atgaccctgctgcccagcaagggcggcgacaccatcgccagcgtgaacggcctgaacgtggagggcatcagacacagagagatcgtggacatcatcaaggccagcggcaacgtgctgagactggagaccctgtacggcaccagcatcagaaaggccgagctggaggccagactgcagtacctgaagcagaccctgtacgagaagtggggcgagtacagaagcctgatggtgcaggagcagagactggtgcacggcctggtggtgaaggaccccagcatctacgacaccctggagagcgtgagaagctgcctgtacggcgccggcctgctgcccggcagcctgcccttcggccccctgctggccgtgcccggcagacccagaggcggcgccagaagagccagaggcgacgccgacgacgccgtgtaccacacctgcttcttcggcgacagcgagccccccgccctgccccccccccccccccccgccagagccttcggccccggccccgccgagacccccgccgtgggccccggccccggccccagagccgccctgagcagaagcgccagcgtgagatgcgccggccccggcggcggcggcggcggcggcgcccccggcgccctgtggaccgaggccagagagcaggccctgtgcggccccggcctgagaaagaccaagtacagaagcttcagaagaagactgctgaagttcatccccggcctgaacagaagcctggaggaggaggagagccagctgtag

SEQ ID NO: 83763 - DNA, 759 bp, Artificial Sequence; identical to SEQ ID NO: 83762
  Description of Artificial Sequence: Synthetic coding sequence

SEQ ID NO: 83764 - DNA, 654 bp, Artificial Sequence
  Description of Artificial Sequence: Synthetic coding sequence
atggccgcccagtgcgtgagactggccagaagaagcctgcccgccctggccctgagcctgagacccagccccagactgctgtgcaccgccaccaagcagaagaacagcggccagaacctggaggaggacatgggccagagcgagcagaaggccgacccccccgccaccgagaagaccctgctggaggagaaggtgaagctggaggagcagctgaaggagaccgtggagaagtacaagagagccctggccgacaccgagaacctgagacagagaagccagaagctggtggaggaggccaagctgtacggcatccaggccttctgcaaggacctgctggaggtggccgacgtgctggagaaggccacccagtgcgtgcccaaggaggagatcaaggacgacaacccccacctgaagaacctgtacgagggcctggtgatgaccgaggtgcagatccagaaggtgttcaccaagcacggcctgctgaagctgaaccccgtgggcgccaagttcgacccctacgagcacgaggccctgttccacacccccgtggagggcaaggagcccggcaccgtggccctggtgagcaaggtgggctacaagctgcacggcagaaccctgagacccgccctggtgggcgtggtgaaggaggcctag

SEQ ID NO: 83765 - DNA, 591 bp, Artificial Sequence
  Description of Artificial Sequence: Synthetic coding sequence
atggccgcccagtgcgtgagactggccagaagaagcctgcccgccctggccctgagcctgagacccagccccagactgctgtgcaccgccaccaagcagaagaacagcggccagaacctggaggaggacatgggccagagcgagcagctgaaggagaccgtggagaagtacaagagagccctggccgacaccgagaacctgagacagagaagccagaagctggtggaggaggccaagctgtacggcatccaggccttctgcaaggacctgctggaggtggccgacgtgctggagaaggccacccagtgcgtgcccaaggaggagatcaaggacgacaacccccacctgaagaacctgtacgagggcctggtgatgaccgaggtgcagatccagaaggtgttcaccaagcacggcctgctgaagctgaaccccgtgggcgccaagttcgacccctacgagcacgaggccctgttccacacccccgtggagggcaaggagcccggcaccgtggccctggtgagcaaggtgggctacaagctgcacggcagaaccctgagacccgccctggtgggcgtggtgaaggaggcctag

SEQ ID NO: 83766 - DNA, 2880 bp, Artificial Sequence
  Description of Artificial Sequence: Synthetic coding sequence
atggccctgctgggcaagagatgcgacgtgcccaccaacggctgcggccccgacagatggaacagcgccttcaccagaaaggacgagatcatcaccagcctggtgagcgccctggacagcatgtgcagcgccctgagcaagctgaacgccgaggtggcctgcgtggccgtgcacgacgagagcgccttcgtggtgggcaccgagaagggcagaatgttcctgaacgccagaaaggagctgcagagcgacttcctgagattctgcagaggccccccctggaaggaccccgaggccgagcaccccaagaaggtgcagagaggcgagggcggcggcagaagcctgcccagaagcagcctggagcacggcagcgacgtgtacctgctgagaaagatggtggaggaggtgttcgacgtgctgtacagcgaggccctgggcagagccagcgtggtgcccctgccctacgagagactgctgagagagcccggcctgctggccgtgcagggcctgcccgagggcctggccttcagaagacccgccgagtacgaccccaaggccctgatggccatcctggagcacagccacagaatcagattcaagctgaagagacccctggaggacggcggcagagacagcaaggccctggtggagctgaacggcgtgagcctgatccccaagggcagcagagactgcggcctgcacggccaggcccccaaggtgcccccccaggacctgccccccaccgccaccagcagcagcatggccagcttcctgtacagcaccgccctgcccaaccacgccatcagagagctgaagcaggaggcccccagctgccccctggcccccagcgacctgggcctgagcagacccatgcccgagcccaaggccaccggcgcccaggacttcagcgactgctgcggccagaagcccaccggccccggcggccccctgatccagaacgtgcacgccagcaagagaatcctgttcagcatcgtgcacgacaagagcgagaagtgggacgccttcatcaaggagaccgaggacatcaacaccctgagagagtgcgtgcagatcctgttcaacagcagatacgccgaggccctgggcctggaccacatggtgcccgtgccctacagaaagatcgcctgcgaccccgaggccgtggagatcgtgggcatccccgacaagatccccttcaagagaccctgcacctacggcgtgcccaagctgaagagaatcctggaggagagacacagcatccacttcatcatcaagagaatgttcgacgagagaatcttcaccggcaacaagttcaccaaggacaccaccaagctggagcccgccagcccccccgaggacaccagcgccgaggtgagcagagccaccgtgctggacctggccggcaacgccagaagcgacaagggcagcatgagcgaggactgcggccccggcaccagcggcgagctgggcggcctgagacccatcaagatcgagcccgaggacctggacatcatccaggtgaccgtgcccgaccccagccccaccagcgaggagatgaccgacagcatgcccggccacctgcccagcgaggacagcggctacggcatggagatgctgaccgacaagggcctgagcgaggacgccagacccgaggagagacccgtggaggacagccacggcgacgtgatcagacccctgagaaagcaggtggagctgctgttcaacaccagatacgccaaggccatcggcatcagcgagcccgtgaaggtgccctacagcaagttcctgatgcaccccgaggagctgttcgtggtgggcctgcccgagggcatcagcctgagaagacccaactgcttcggcatcgccaagctgagaaagatcctggaggccagcaacagcatccagttcgtgatcaagagacccgagctgctgaccgagggcgtgaaggagcccatcatggacagccagggcaccgccagcagcctgggcttcagcccccccgccctgccccccgagagagacagcggcgaccccctggtggacgagagcctgaagagacagggcttccaggagaactacgacgccagactgagcagaatcgacatcgccaacaccctgagagagcaggtgcaggacctgttcaacaagaagtacggcgaggccctgggcatcaagtaccccgtgcaggtgccctacaagagaatcaagagcaaccccggcagcgtgatcatcgagggcctgccccccggcatccccttcagaaagccctgcaccttcggcagccagaacctggagagaatcctggccgtggccgacaagatcaagttcaccgtgaccagacccttccagggcctgatccccaagcccgacgaggacgacgccaacagactgggcgagaaggtgatcctgagagagcaggtgaaggagctgttcaacgagaagtacggcgaggccctgggcctgaacagacccgtgctggtgccctacaagctgatcagagacagccccgacgccgtggaggtgaccggcctgcccgacgacatccccttcagaaaccccaacacctacgacatccacagactggagaagatcctgaaggccagagagcacgtgagaatggtgatcatcaaccagctgcagcccttcgccgagatctgcaacgacgccaaggtgcccgccaaggacagcagcatccccaagagaaagagaaagagagtgagcgagggcaacagcgtgagcagcagcagcagcagcagcagcagcagcagcagcaaccccgacagcgtggccagcgccaaccagatcagcctggtgcagtggcccatgtacatggtggactacgccggcctgaacgtgcagctgcccggccccctgaactactag

SEQ ID NO: 83767 - DNA, 2835 bp, Artificial Sequence
  Description of Artificial Sequence: Synthetic coding sequence
atggccctgctgggcaagagatgcgacgtgcccaccaacggctgcggccccgacagatggaacagcgccttcaccagaaaggacgagatcatcaccagcctggtgagcgccctggacagcatgtgcagcgccctgagcaagctgaacgccgaggtggcctgcgtggccgtgcacgacgagagcgccttcgtggtgggcaccgagaagggcagaatgttcctgaacgccagaaaggagctgcagagcgacttcctgagattctgcagaggccccccctggaaggaccccgaggccgagcaccccaagaaggtgcagagaggcgagggcggcggcagaagcctgcccagaagcagcctggagcacggcagcgacgtgtacctgctgagaaagatggtggaggaggtgttcgacgtgctgtacagcgaggccctgggcagagccagcgtggtgcccctgccctacgagagactgctgagagagcccggcctgctggccgtgcagggcctgcccgagggcctggccttcagaagacccgccgagtacgaccccaaggccctgatggccatcctggagcacagccacagaatcagattcaagctgaagagacccctggaggacggcggcagagacagcaaggccctggtggagctgaacggcgtgagcctgatccccaagggcagcagagactgcggcctgcacggccaggcccccaaggtgcccccccaggacctgccccccaccgccaccagcagcagcatggccagcttcctgtacagcaccgccctgcccaaccacgccatcagagagctgaagcaggaggcccccagctgccccctggcccccagcgacctgggcctgagcagacccatgcccgagcccaaggccaccggcgcccaggacttcagcgactgctgcggccagaagcccaccggccccggcggccccctgatccagaacgtgcacgccagcaagagaatcctgttcagcatcgtgcacgacaagagcgagaagtgggacgccttcatcaaggagaccgaggacatcaacaccctgagagagtgcgtgcagatcctgttcaacagcagatacgccgaggccctgggcctggaccacatggtgcccgtgccctacagaaagatcgcctgcgaccccgaggccgtggagatcgtgggcatccccgacaagatccccttcaagagaccctgcacctacggcgtgcccaagctgaagagaatcctggaggagagacacagcatccacttcatcatcaagagaatgttcgacgagagaatcttcaccggcaacaagttcaccaaggacaccaccaagctggagcccgccagcccccccgaggacaccagcgccgaggtgagcagagccaccgtgctggacctggccggcaacgccagaagcgacaagggcagcatgagcgaggactgcggccccggcaccagcggcgagctgggcggcctgagacccatcaagatcgagcccgaggacctggacatcatccaggtgaccgtgcccgaccccagccccaccagcgaggagatgaccgacagcatgcccggccacctgcccagcgaggacagcggctacggcatggagatgctgaccgacaagggcctgagcgaggacgccagacccgaggagagacccgtggaggacagccacggcgacgtgatcagacccctgagaaagcaggtggagctgctgttcaacaccagatacgccaaggccatcggcatcagcgagcccgtgaaggtgccctacagcaagttcctgatgcaccccgaggagctgttcgtggtgggcctgcccgagggcatcagcctgagaagacccaactgcttcggcatcgccaagctgagaaagatcctggaggccagcaacagcatccagttcgtgatcaagagacccgagctgctgaccgagggcgtgaaggagcccatcatggacagccaggagagagacagcggcgaccccctggtggacgagagcctgaagagacagggcttccaggagaactacgacgccagactgagcagaatcgacatcgccaacaccctgagagagcaggtgcaggacctgttcaacaagaagtacggcgaggccctgggcatcaagtaccccgtgcaggtgccctacaagagaatcaagagcaaccccggcagcgtgatcatcgagggcctgccccccggcatccccttcagaaagccctgcaccttcggcagccagaacctggagagaatcctggccgtggccgacaagatcaagttcaccgtgaccagacccttccagggcctgatccccaagcccgacgaggacgacgccaacagactgggcgagaaggtgatcctgagagagcaggtgaaggagctgttcaacgagaagtacggcgaggccctgggcctgaacagacccgtgctggtgccctacaagctgatcagagacagccccgacgccgtggaggtgaccggcctgcccgacgacatccccttcagaaaccccaacacctacgacatccacagactggagaagatcctgaaggccagagagcacgtgagaatggtgatcatcaaccagctgcagcccttcgccgagatctgcaacgacgccaaggtgcccgccaaggacagcagcatccccaagagaaagagaaagagagtgagcgagggcaacagcgtgagcagcagcagcagcagcagcagcagcagcagcagcaaccccgacagcgtggccagcgccaaccagatcagcctggtgcagtggcccatgtacatggtggactacgccggcctgaacgtgcagctgcccggccccctgaactactag

SEQ ID NO: 83768 - DNA, 2931 bp, Artificial Sequence
  Description of Artificial Sequence: Synthetic coding sequence
atggccctgctgggcaagagatgcgacgtgcccaccaacggctgcggccccgacagatggaacagcgccttcaccagaaaggacgagatcatcaccagcctggtgagcgccctggacagcatgtgcagcgccctgagcaagctgaacgccgaggtggcctgcgtggccgtgcacgacgagagcgccttcgtggtgggcaccgagaagggcagaatgttcctgaacgccagaaaggagctgcagagcgacttcctgagattctgcctgagcgccgcccagcacagagccgccaccagccagctggagggcagagtggtgagaagagtgctgaccgtggccagcagagccctgtgccccaccggcggccccccctggaaggaccccgaggccgagcaccccaagaaggtgcagagaggcgagggcggcggcagaagcctgcccagaagcagcctggagcacggcagcgacgtgtacctgctgagaaagatggtggaggaggtgttcgacgtgctgtacagcgaggccctgggcagagccagcgtggtgcccctgccctacgagagactgctgagagagcccggcctgctggccgtgcagggcctgcccgagggcctggccttcagaagacccgccgagtacgaccccaaggccctgatggccatcctggagcacagccacagaatcagattcaagctgaagagacccctggaggacggcggcagagacagcaaggccctggtggagctgaacggcgtgagcctgatccccaagggcagcagagactgcggcctgcacggccaggcccccaaggtgcccccccaggacctgccccccaccgccaccagcagcagcatggccagcttcctgtacagcaccgccctgcccaaccacgccatcagagagctgaagcaggaggcccccagctgccccctggcccccagcgacctgggcctgagcagacccatgcccgagcccaaggccaccggcgcccaggacttcagcgactgctgcggccagaagcccaccggccccggcggccccctgatccagaacgtgcacgccagcaagagaatcctgttcagcatcgtgcacgacaagagcgagaagtgggacgccttcatcaaggagaccgaggacatcaacaccctgagagagtgcgtgcagatcctgttcaacagcagatacgccgaggccctgggcctggaccacatggtgcccgtgccctacagaaagatcgcctgcgaccccgaggccgtggagatcgtgggcatccccgacaagatccccttcaagagaccctgcacctacggcgtgcccaagctgaagagaatcctggaggagagacacagcatccacttcatcatcaagagaatgttcgacgagagaatcttcaccggcaacaagttcaccaaggacaccaccaagctggagcccgccagcccccccgaggacaccagcgccgaggtgagcagagccaccgtgctggacctggccggcaacgccagaagcgacaagggcagcatgagcgaggactgcggccccggcaccagcggcgagctgggcggcctgagacccatcaagatcgagcccgaggacctggacatcatccaggtgaccgtgcccgaccccagccccaccagcgaggagatgaccgacagcatgcccggccacctgcccagcgaggacagcggctacggcatggagatgctgaccgacaagggcctgagcgaggacgccagacccgaggagagacccgtggaggacagccacggcgacgtgatcagacccctgagaaagcaggtggagctgctgttcaacaccagatacgccaaggccatcggcatcagcgagcccgtgaaggtgccctacagcaagttcctgatgcaccccgaggagctgttcgtggtgggcctgcccgagggcatcagcctgagaagacccaactgcttcggcatcgccaagctgagaaagatcctggaggccagcaacagcatccagttcgtgatcaagagacccgagctgctgaccgagggcgtgaaggagcccatcatggacagccaggagagagacagcggcgaccccctggtggacgagagcctgaagagacagggcttccaggagaactacgacgccagactgagcagaatcgacatcgccaacaccctgagagagcaggtgcaggacctgttcaacaagaagtacggcgaggccctgggcatcaagtaccccgtgcaggtgccctacaagagaatcaagagcaaccccggcagcgtgatcatcgagggcctgccccccggcatccccttcagaaagccctgcaccttcggcagccagaacctggagagaatcctggccgtggccgacaagatcaagttcaccgtgaccagacccttccagggcctgatccccaagcccgacgaggacgacgccaacagactgggcgagaaggtgatcctgagagagcaggtgaaggagctgttcaacgagaagtacggcgaggccctgggcctgaacagacccgtgctggtgccctacaagctgatcagagacagccccgacgccgtggaggtgaccggcctgcccgacgacatccccttcagaaaccccaacacctacgacatccacagactggagaagatcctgaaggccagagagcacgtgagaatggtgatcatcaaccagctgcagcccttcgccgagatctgcaacgacgccaaggtgcccgccaaggacagcagcatccccaagagaaagagaaagagagtgagcgagggcaacagcgtgagcagcagcagcagcagcagcagcagcagcagcagcaaccccgacagcgtggccagcgccaaccagatcagcctggtgcagtggcccatgtacatggtggactacgccggcctgaacgtgcagctgcccggccccctgaactactag

SEQ ID NO: 83769 - DNA, 609 bp, Artificial Sequence
  Description of Artificial Sequence: Synthetic coding sequence
atgagctgcgtgccctggaagggcgacaaggccaagagcgagagcctggagctgccccaggccgcccccccccagatctaccacgagaagcagagaagagagctgtgcgccctgcacgccctgaacaacgtgttccaggacagcaacgccttcaccagagacaccctgcaggagatcttccagagactgagccccaacaccatggtgaccccccacaagaagagcatgctgggcaacggcaactacgacgtgaacgtgatcatggccgccctgcagaccaagggctacgaggccgtgtggtgggacaagagaagagacgtgggcgtgatcgccctgaccaacgtgatgggcttcatcatgaacctgcccagcagcctgtgctggggccccctgaagctgcccctgaagagacagcactggatctgcgtgagagaggtgggcggcgcctactacaacctggacagcaagctgaagatgcccgagtggatcggcggcgagagcgagctgagaaagttcctgaagcaccacctgagaggcaagaactgcgagctgctgctggtggtgcccgaggaggtggaggcccaccagagctggagaaccgacgtgtag

SEQ ID NO: 83770 - DNA, 1545 bp, Artificial Sequence
  Description of Artificial Sequence: Synthetic coding sequence
atgaagtggagactgcaggagggcagaggcgaggccgtgtaccagatcggcgtggaggacaacggcctgctggtgggcctggccgaggaggagatgagagccagcctgaagaccctgcacagaatggccgagaaggtgggcgccgacatcaccgtgctgagagagagagaggtggactacgacagcgacatgcccagaaagatcaccgaggtgctggtgagaaaggtgcccgacaaccagcagttcctggacctgagagtggccgtgctgggcaacgtggacagcggcaagagcaccctgctgggcgtgctgacccagggcgagctggacaacggcagaggcagagccagactgaacctgttcagacacctgcacgagatccagagcggcagaaccagcagcatcagcttcgagatcctgggcttcaacagcaagggcgaggtggtgaactacagcgacagcagaaccgccgaggagatctgcgagagcagcagcaagatgatcaccttcatcgacctggccggccaccacaagtacctgcacaccaccatcttcggcctgaccagctactgccccgactgcgccctgctgctggtgagcgccaacaccggcatcgccggcaccaccagagagcacctgggcctggccctggccctgaaggtgcccttcttcatcgtggtgagcaagatcgacctgtgcgccaagaccaccgtggagagaaccgtgagacagctggagagagtgctgaagcagcccggctgccacaaggtgcccatgctggtgaccagcgaggacgacgccgtgaccgccgcccagcagttcgcccagagccccaacgtgacccccatcttcaccctgagcagcgtgagcggcgagagcctggacctgctgaaggtgttcctgaacatcctgccccccctgaccaacagcaaggagcaggaggagctgatgcagcagctgaccgagttccaggtggacgagatctacaccgtgcccgaggtgggcaccgtggtgggcggcaccctgagcagcggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggacaagctgagaaccggcgagaaggccgtggtgagattcagattcctgaagcaccccgagtacctgaaggtgggcgccaagctgctgttcagagagggcgtgaccaagggcatcggccacgtgaccgacgtgcaggccatcaccgccggcgaggcccaggccaacatgggcttctag

SEQ ID NO: 83771 - DNA, 1809 bp, Artificial Sequence
  Description of Artificial Sequence: Synthetic coding sequence
atggacagcagagtgagcgagctgttcggcggctgctgcagacccggcggcggccccgccgtgggcggcaccctgaaggccagaggcgccggcagcagcagcggctgcggcggccccaagggcaagaagaagaacggcagaaacagaggcggcaaggccaacaaccccccctacctgccccccgaggccgaggacggcaacatcgagtacaagctgaagctggtgaaccccagccagtacagattcgagcacctggtgacccagatgaagtggagactgcaggagggcagaggcgaggccgtgtaccagatcggcgtggaggacaacggcctgctggtgggcctggccgaggaggagatgagagccagcctgaagaccctgcacagaatggccgagaaggtgggcgccgacatcaccgtgctgagagagagagaggtggactacgacagcgacatgcccagaaagatcaccgaggtgctggtgagaaaggtgcccgacaaccagcagttcctggacctgagagtggccgtgctgggcaacgtggacagcggcaagagcaccctgctgggcgtgctgacccagggcgagctggacaacggcagaggcagagccagactgaacctgttcagacacctgcacgagatccagagcggcagaaccagcagcatcagcttcgagatcctgggcttcaacagcaagggcgaggtggtgaactacagcgacagcagaaccgccgaggagatctgcgagagcagcagcaagatgatcaccttcatcgacctggccggccaccacaagtacctgcacaccaccatcttcggcctgaccagctactgccccgactgcgccctgctgctggtgagcgccaacaccggcatcgccggcaccaccagagagcacctgggcctggccctggccctgaaggtgcccttcttcatcgtggtgagcaagatcgacctgtgcgccaagaccaccgtggagagaaccgtgagacagctggagagagtgctgaagcagcccggctgccacaaggtgcccatgctggtgaccagcgaggacgacgccgtgaccgccgcccagcagttcgcccagagccccaacgtgacccccatcttcaccctgagcagcgtgagcggcgagagcctggacctgctgaaggtgttcctgaacatcctgccccccctgaccaacagcaaggagcaggaggagctgatgcagcagctgaccgagttccaggtggacgagatctacaccgtgcccgaggtgggcaccgtggtgggcggcaccctgagcagcggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggacaagctgagaaccggcgagaaggccgtggtgagattcagattcctgaagcaccccgagtacctgaaggtgggcgccaagctgctgttcagagagggcgtgaccaagggcatcggccacgtgaccgacgtgcaggccatcaccgccggcgaggcccaggccaacatgggcttctag

SEQ ID NO: 83772 - DNA, 735 bp, Artificial Sequence
  Description of Artificial Sequence: Synthetic coding sequence
atgaagtggagactgcaggagggcagaggcgaggccatcttcaccctgagcagcgtgagcggcgagagcctggacctgctgaaggtgttcctgaacatcctgccccccctgaccaacagcaaggagcaggaggagctgatgcagcagctgaccgagttccaggtggacgagatctacaccgtgcccgaggtgggcaccgtggtgggcggcaccctgagcagcggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggacaagctgagaaccggcgagaaggccgtggtgagattcagattcctgaagcaccccgagtacctgaaggtgggcgccaagctgctgttcagagagggcgtgaccaagggcatcggccacgtgaccgacgtgcaggccatcaccgccggcgaggcccaggccaacatgggcttctag

SEQ ID NO: 83773 - DNA, 462 bp, Artificial Sequence
  Description of Artificial Sequence: Synthetic coding sequence
tgaggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggacaagctgagaaccggcgagaaggccgtggccagagagagaggcgtgctgagcgccacctgcagcctgcccaccttctggagaggcgccaagctgggcgtggccagaaagggccagagctag

SEQ ID NO: 83774 - DNA, 465 bp, Artificial Sequence
  Description of Artificial Sequence: Synthetic coding sequence
tgaggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggtgagaggcacctggcccagcatcagccccgaggtgagaaaggagggcggcctgccccagaccggcagagagctgctggaccccaccatgggcatcaagccccacctgggctgggtggccgcctag

SEQ ID NO: 83775 - DNA, 543 bp, Artificial Sequence
  Description of Artificial Sequence: Synthetic coding sequence
atgcagcagctgaccgagttccaggtggacgagatctacaccgtgcccgaggtgggcaccgtggtgggcggcaccctgagcagcggcatctgcagagagggcgaccagctggtggtgggccccaccgacgacggctgcttcctggagctgagagtgtgcagcatccagagaaacagaagcgcctgcagagtgctgagagccggccaggccgccaccctggccctgggcgacttcgacagagccctgctgagaaagggcatggtgatggtgagccccgagatgaaccccaccatctgcagcgtgttcgaggccgagatcgtgctgctgttccacgccaccaccttcagaagaggcttccaggtgaccgtgcacgtgggcaacgtgagacagaccgccgtggtggagaagatccacgccaaggacaagctgagaaccggcgagaaggccgtggccagagagagaggcgtgctgagcgccacctgcagcctgcccaccttctggagaggcgccaagctgggcgtggccagaaagggccagagctag

SEQ ID NO: 83776 - DNA, 951 bp, Artificial Sequence
  Description of Artificial Sequence: Synthetic coding sequence
tgacagggcggcggcgccagagaggagaacaccagcttcagaagcagagaccccagagaggagggccagagactggacagccaggccgaggacggcaacatcgagtacaagctgaagctggtgaaccccagccagtacagattcgagcacctggtgacccagatgaagtggagactgcaggagggcagaggcgaggccgtgtaccagatcggcgtggaggacaacggcctgctggtgggcctggccgaggaggagatgagagccagcctgaagaccctgcacagaatggccgagaaggtgggcgccgacatcaccgtgctgagagagagagaggtggactacgacagcgacatgcccagaaagatcaccgaggtgctggtgagaaaggtgcccgacaaccagcagttcctggacctgagagtggccgtgctgggcaacgtggacagcggcaagagcaccctgctgggcgtgctgacccagggcgagctggacaacggcagaggcagagccagactgaacctgttcagacacctgcacgagatccagagcggcagaaccagcagcatcagcttcgagatcctgggcttcaacagcaagggcgaggtggtgaactacagcgacagcagaaccgccgaggagatctgcgagagcagcagcaagatgatcaccttcatcgacctggccggccaccacaagtacctgcacaccaccatcttcggcctgaccagctactgccccgactgcgccctgctgctggtgagcgccaacaccggcatcgccggcaccaccagagagcacctgggcctggccctggccctgaaggtgcccttcttcatcgtggtgagcaagatcgacctgtgcgccaagaccaccgtggagagaaccgtgagacagctggagagagtgctgaagcagcccggctgccacaaggtgcccatgctggtgacctag

SEQ ID NO: 83777 - DNA, 684 bp, Artificial Sequence
  Description of Artificial Sequence: Synthetic coding sequence
atggacagcagagtgagcgagctgttcggcggctgctgcagacccggcggcggccccgccgtgggcggcaccctgaaggccagaggcgccggcagcagcagcggctgcggcggccccaagggcaagaagaagaacggcagaaacagaggcggcaaggccaacaaccccccctacctgccccccgaggccgaggacggcaacatcgagtacaagtacagattcgagcacctggtgacccagatgaagtggagactgcaggagggcagaggcgaggccgtgtaccagatcggcgtggaggacaacggcctgctggtgggcctggccgaggaggagatgagagccagcctgaagaccctgcacagaatggccgagaaggtgggcgccgacatcaccgtgctgagagagagagaggtggactacgacagcgacatgcccagaaagatcaccgaggtgctggtgagaaaggtgcccgacaaccagcagttcctggacctgagagtggccgtgctgggcaacgtggacagcggcaagagcaccctgctgggcgtgctgacccagggcgagctggacaacggcagaggcagagccagactgaacctgttcagacacctgcacgagatccagagcggcagaaccagcagcatcagcttcgagatcctgggcttcaacagcaagggcgagtag

SEQ ID NO: 83778 - DNA, 1221 bp, Artificial Sequence
  Description of Artificial Sequence: Synthetic coding sequence
atggcccccgccagatgcttcagcgccagactgagaaccgtgttccagggcgtgggccactgggccctgagcacctgggccggcctgaagcccagcagactgctgccccagagagccagccccagactgctgagcgtgggcagagccgacctggccaagcaccaggagctgcccggcaagaagctgctgagcgagaagaagctgaagagatacttcgtggactacagaagagtgctggtgtgcggcggcaacggcggcgccggcgccagctgcttccacagcgagcccagaaaggagttcggcggccccgacggcggcgacggcggcaacggcggccacgtgatcctgagagtggaccagcaggtgaagagcctgagcagcgtgctgagcagataccagggcttcagcggcgaggacggcggcagcaagaactgcttcggcagaagcggcgccgtgctgtacatcagagtgcccgtgggcaccctggtgaaggagggcggcagagtggtggccgacctgagctgcgtgggcgacgagtacatcgccgccctgggcggcgccggcggcaagggcaacagattcttcctggccaacaacaacagagcccccgtgacctgcacccccggccagcccggccagcagagagtgctgcacctggagctgaagaccgtggcccacgccggcatggtgggcttccccaacgccggcaagagcagcctgctgagagccatcagcaacgccagacccgccgtggccagctaccccttcaccaccctgaagccccacgtgggcatcgtgcactacgagggccacctgcagatcgccgtggccgacatccccggcatcatcagaggcgcccaccagaacagaggcctgggcagcgccttcctgagacacatcgagagatgcagattcctgctgttcgtggtggacctgagccagcccgagccctggacccaggtggacgacctgaagtacgagctggagatgtacgagaagggcctgagcgccagaccccacgccatcgtggccaacaagatcgacctgcccgaggcccaggccaacctgagccagctgagagaccacctgggccaggaggtgatcgtgctgagcgccctgaccggcgagaacctggagcagctgctgctgcacctgaaggtgctgtacgacgcctacgccgaggccgagctgggccagggcagacagcccctgagatggtag

SEQ ID NO: 83779 - DNA, 747 bp, Artificial Sequence
  Description of Artificial Sequence: Synthetic coding sequence
atggcccccgccagatgcttcagcgccagactgagaaccgtgttccagggcgtgggccactgggccctgagcacctgggccggcctgaagcccagcagactgctgccccagagagccagccccagactgctgagcgtgggcagagccgacctggccaagcaccaggagctgcccggcaagaagctgctgagcgagaagaagctgaagagatacttcgtggactacagaagagtgctggtgtgcggcggcaacggcggcgccggcgccagctgcttccacagcgagcccagaaaggagttcggcggccccgacggcggcgacggcggcaacggcggccacgtgatcctgagagtggccgacatccccggcatcatcagaggcgcccaccagaacagaggcctgggcagcgccttcctgagacacatcgagagatgcagattcctgctgttcgtggtggacctgagccagcccgagccctggacccaggtggacgacctgaagtacgagctggagatgtacgagaagggcctgagcgccagaccccacgccatcgtggccaacaagatcgacctgcccgaggcccaggccaacctgagccagctgagagaccacctgggccaggaggtgatcgtgctgagcgccctgaccggcgagaacctggagcagctgctgctgcacctgaaggtgctgtacgacgcctacgccgaggccgagctgggccagggcagacagcccctgagatggtag

SEQ ID NO: 83780 - DNA, 702 bp, Artificial Sequence
  Description of Artificial Sequence: Synthetic coding sequence
atggcccccgccagatgcttcagcgccagactgagaaccgtgttccagggcgtgggccactgggccctgagcacctgggccggcctgaagcccagcagactgctgccccagagagccagccccagactgctgagcgtgggcagagccgacctggccaagcaccaggagctgcccggcaagaagctgctgagcgagaagaagctgaagagatacttcgtggactacagaagagtgctggtgtgcggcggcaacggcggcgccggcgccagctgcttccacagcgagcccagaaaggagttcggcggccccgacggcggcgacggcggcaacggcggccacgtgatcctgagagtggaccagcaggtgaagagcctgagcagcgtgctgagcagataccagggcttcagcggcgaggacggcggcagcaagaactgcttcggcagaagcggcgccgtgctgtacatcagagtgcccgtgggcaccctggtgaaggagggcggcagagtggtggccgacctgagctgcgtgggcgacgagtacatcgccgccctgggcggcgccggcggcaagggcaacagattcttcctggccaacaacaacagagcccccgtgacctgcacccccggccagcccggccagcagagagtgctgcacctggagctgaagaccgtggcccacgccggcatggtgggcttcccctag

SEQ ID NO: 83781 - DNA, 537 bp, Artificial Sequence
  Description of Artificial Sequence: Synthetic coding sequence
atggtgggcttccccaacgccggcaagagcagcctgctgagagccatcagcaacgccagacccgccgtggccagctaccccttcaccaccctgaagccccacgtgggcatcgtgcactacgagggccacctgcagatcgccgtggccgacatccccggcatcatcagaggcgcccaccagaacagaggcctgggcagcgccttcctgagacacatcgagagatgcagattcctgctgttcgtggtggacctgagccagcccgagccctggacccaggtggacgacctgaagtacgagctggagatgtacgagaagggcctgagcgccagaccccacgccatcgtggccaacaagatcgacctgcccgaggcccaggccaacctgagccagctgagagaccacctgggccaggaggtgatcgtgctgagcgccctgaccggcgagaacctggagcagctgctgctgcacctgaaggtgctgtacgacgcctacgccgaggccgagctgggccagggcagacagcccctgagatggtag

SEQ ID NO: 83782 - DNA, 864 bp, Artificial Sequence
  Description of Artificial Sequence: Synthetic coding sequence
agaagcaacctgaagagagacgtggcccacctgtacagaggcgtgggcagcagatacatcatgggcagcggcgagagcttcatgcagctgcagcagagactgctgagagagaaggaggccaagatcagaaaggccctggacagactgagaaagaagagacacctgctgagaagacagagaaccagaagagagttccccgtgatcagcgtggtgggctacaccaactgcggcaagaccaccctgatcaaggccctgaccggcgacgccgccatccagcccagagaccagctgttcgccaccctggacgtgaccgcccacgccggcaccctgcccagcagaatgaccgtgctgtacgtggacaccatcggcttcctgagccagctgccccacggcctgatcgagagcttcagcgccaccctggaggacgtggcccacagcgacctgatcctgcacgtgagagacgtgagccaccccgaggccgagctgcagaagtgcagcgtgctgagcaccctgagaggcctgcagctgcccgcccccctgctggacagcatggtggaggtgcacaacaaggtggacctggtgcccggctacagccccaccgagcccaacgtggtgcccgtgagcgccctgagaggccacggcctgcaggagctgaaggccgagctggacgccgccgtgctgaaggccaccggcagacagatcctgaccctgagagtgagactggccggcgcccagctgagctggctgtacaaggaggccaccgtgcaggaggtggacgtgatccccgaggacggcgccgccgacgtgagagtgatcatcagcaacagcgcctacggcaagttcagaaagctgttccccggctag

SEQ ID NO: 83783 - DNA, 864 bp, Artificial Sequence
  Description of Artificial Sequence: Synthetic coding sequence
tgaagcaacctgaagagagacgtggcccacctgtacagaggcgtgggcagcagatacatcatgggcagcggcgagagcttcatgcagctgcagcagagactgctgagagagaaggaggccaagatcagaaaggccctggacagactgagaaagaagagacacctgctgagaagacagagaaccagaagagagttccccgtgatcagcgtggtgggctacaccaactgcggcaagaccaccctgatcaaggccctgaccggcgacgccgccatccagcccagagaccagctgttcgccaccctggacgtgaccgcccacgccggcaccctgcccagcagaatgaccgtgctgtacgtggacaccatcggcttcctgagccagctgccccacggcctgatcgagagcttcagcgccaccctggaggacgtggcccacagcgacctgatcctgcacgtgagagacgtgagccaccccgaggccgagctgcagaagtgcagcgtgctgagcaccctgagaggcctgcagctgcccgcccccctgctggacagcatggtggaggtgcacaacaaggtggacctggtgcccggctacagccccaccgagcccaacgtggtgcccgtgagcgccctgagaggccacggcctgcaggagctgaaggccgagctggacgccgccgtgctgaaggccaccggcagacagatcctgaccctgagagtgagactggccggcgcccagctgagctggctgtacaaggaggccaccgtgcaggaggtggacgtgatccccgaggacggcgccgccgacgtgagagtgatcatcagcaacagcgcctacggcaagttcagaaagctgttccccggctag

SEQ ID NO: 83784 - DNA, 891 bp, Artificial Sequence
  Description of Artificial Sequence: Synthetic coding sequence
atgaccctgaacaacgtgaccatgagacagggcaccgtgggcatgcagccccagcagcagagatggagcatccccgccgacggcagacacctgatggtgcagaaggagccccaccagtacagccacagaaacagacacagcgccacccccgaggaccactgcagaagaagctggagcagcgacagcaccgacagcgtgatcagcagcgagagcggcaacacctactacagagtggtgctgatcggcgagcagggcgtgggcaagagcaccctggccaacatcttcgccggcgtgcacgacagcatggacagcgactgcgaggtgctgggcgaggacacctacgagagaaccctgatggtggacggcgagagcgccaccatcatcctgctggacatgtgggagaacaagggcgagaacgagtggctgcacgaccactgcatgcaggtgggcgacgcctacctgatcgtgtacagcatcaccgacagagccagcttcgagaaggccagcgagctgagaatccagctgagaagagccagacagaccgaggacatccccatcatcctggtgggcaacaagagcgacctggtgagatgcagagaggtgagcgtgagcgagggcagagcctgcgccgtggtgttcgactgcaagttcatcgagaccagcgccgccgtgcagcacaacgtgaaggagctgttcgagggcatcgtgagacaggtgagactgagaagagacagcaaggagaagaacgagagaagactggcctaccagaagagaaaggagagcatgcccagaaaggccagaagattctggggcaagatcgtggccaagaacaacaagaacatggccttcaagctgaagagcaagagctgccacgacctgagcgtgctgtag

SEQ ID NO: 83785 - DNA, 891 bp, Artificial Sequence; identical to SEQ ID NO: 83784
  Description of Artificial Sequence: Synthetic coding sequence

SEQ ID NO: 83786 - DNA, 282 bp, Artificial Sequence
  Description of Artificial Sequence: Synthetic coding sequence
atgaccctgaacaacgtgaccatgagacagggcaccgtgggcatgcagccccagcagcagagatggagcatccccgccgacggcagacacctgatggtgcagaaggagccccaccagtacagccacagaaacagacacagcgccacccccgaggaccactgcagaagaagctggagcagcgacagcaccgacagcgtgatcagcagcgagagcggcaacacctactacagagtggtgctgatcggcgagcagggcgtgggcaagagcaccctggccaactag

SEQ ID NO: 83787 - DNA, 927 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggaggtggaggagcccgaggagagacagcagacccccgaggtggtgcccgacgacagcggcaccttctacgaccaggccgtggtgagcaacgacatggaggagcacctggaggagcccgtggccgagcccgagcccgaccccgagcccgagcccgagcaggagcccgtgagcgagatccaggaggagaagccccccagacccgagagcaagcccgagagccagatccccccccagagaccccagagagaccagagagtgagagagcagagaatcaacatccccccccagagaggccccagacccatcagagaggccggcgagcagggcgacatcgagcccagaagaatggtgagacaccccgacagccaccagctgttcatcggcaacctgccccacgaggtggacaagagcgagctgaaggacttcttccagagctacggcaacgtggtggagctgagaatcaacagcggcggcaagctgcccaacttcggcttcgtggtgttcgacgacagcgagcccgtgcagaaggtgctgagcaacagacccatcatgttcagaggcgaggtgagactgaacgtggaggagaagaagaccagagccgccagagagggcgacagaagagacaacagactgagaggccccggcggccccagaggcggcctgggcggcggcatgagaggcccccccagaggcggcatggtgcagaagcccggcttcggcgtgggcagaggcctggcccccagacagtag

SEQ ID NO: 83788 - DNA, 1401 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggagatccacagaaaggtgatgagccagaacttcaccaactgccacaccaagatcagacacgtggacgcccacgccaccctgaacgacggcgtggtggtgcaggtgatgggcctgctgagcaacaacaaccaggccctgagaagattcatgcagaccttcgtgctggcccccgagggcagcgtggccaacaagttctacgtgcacaacgacatcttcagataccaggacgaggtgttcggcggcttcgtgaccgagccccaggaggagagcgaggaggaggtggaggagcccgaggagagacagcagacccccgaggtggtgcccgacgacagcggcaccttctacgaccaggccgtggtgagcaacgacatggaggagcacctggaggagcccgtggccgagcccgagcccgaccccgagcccgagcccgagcaggagcccgtgagcgagatccaggaggagaagcccgagcccgtgctggaggagaccgcccccgaggacgcccagaagagcagcagccccgcccccgccgacatcgcccagaccgtgcaggaggacctgagaaccttcagctgggccagcgtgaccagcaagaacctgccccccagcggcgccgtgcccgtgaccggcatccccccccacgtggtgaaggtgcccgccagccagcccagacccgagagcaagcccgagagccagatccccccccagagaccccagagagaccagagagtgagagagcagagaatcaacatccccccccagagaggccccagacccatcagagaggccggcgagcagggcgacatcgagcccagaagaatggtgagacaccccgacagccaccagctgttcatcggcaacctgccccacgaggtggacaagagcgagctgaaggacttcttccagagctacggcaacgtggtggagctgagaatcaacagcggcggcaagctgcccaacttcggcttcgtggtgttcgacgacagcgagcccgtgcagaaggtgctgagcaacagacccatcatgttcagaggcgaggtgagactgaacgtggaggagaagaagaccagagccgccagagagggcgacagaagagacaacagactgagaggccccggcggccccagaggcggcctgggcggcggcatgagaggcccccccagaggcggcatggtgcagaagcccggcttcggcgtgggcagaggcctggcccccagacagtag

SEQ ID NO: 83789 - DNA, 1401 bp, Artificial Sequence; identical to SEQ ID NO: 83788
  Description of Artificial Sequence: Synthetic coding sequence

SEQ ID NO: 83790 - DNA, 318 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggagatccacagaaaggtgatgagccagaacttcaccaactgccacaccaagatcagacacgtggacgcccacgccaccctgaacgacggcgtggtggtgcaggtgatgggcctgctgagcaacaacaaccaggccctgtag

SEQ ID NO: 83791 - DNA, 369 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggagatccacagaaaggtgatgagccagaacttcaccaactgccacaccaagatcagacacgtggacgcccacgccaccctgaacgacggcgtggtggtgcaggtgatgggcctgctgagcaacaacaaccaggccctgagaagattcatgcagaccttcgtgctggcccccgagagcctgaagaagaagtag

SEQ ID NO: 83792 - DNA, 354 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggagatccacagaaaggtgatgagccagaacttcaccaactgccacaccaagatcagacacgtggacgcccacgccaccctgaacgacggcgtggtggtgcaggtgatgggcctgctgagcaacaacaaccaggccctgagaagattcatgcagaccttcgtgctggcccccgagtag

SEQ ID NO: 83793 - DNA, 369 bp, Artificial Sequence; identical to SEQ ID NO: 83791
  Description of Artificial Sequence: Synthetic coding sequence

SEQ ID NO: 83794 - DNA, 321 bp, Artificial Sequence
  Description of Artificial Sequence: Synthetic coding sequence
atggtgatggagaagcccagccccctgctggtgggcagagagttcgtgagacagtactacaccctgctgaaccaggcccccgacatgctgcacagattctacggcaagaacagcagctacgtgcacggcggcctggacagcaacggcaagcccgccgacgccgtgtacggccagaaggagatccacagaaaggtgatgagccagaacttcaccaactgccacaccaagatcagacacgtggacgcccacgccaccctgaacgacggcgtggtggtgcaggtgatgggcctgctgagcaacaacaaccaggccctgagatag

SEQ ID NO: 83795 - DNA, 855 bp, Artificial Sequence
  Description of Artificial Sequence: Synthetic coding sequence
atggaggagcacctggaggagcccgtggccgagcccgagcccgaccccgagcccgagcccgagcaggagcccgtgagcgagatccaggaggagaagcccgagcccgtgctggaggagaccgcccccgaggacgcccagaagagcagcagccccgcccccgccgacatcgcccagaccgtgcaggaggacctgagaaccttcagctgggccagcgtgaccagcaagaacctgccccccagcggcgccgtgcccgtgaccggcatccccccccacgtggtgaaggtgcccgccagccagcccagacccgagagcaagcccgagagccagatccccccccagagaccccagagagaccagagagtgagagagcagagaatcaacatccccccccagagaggccccagacccatcagagaggccggcgagcagggcgacatcgagcccagaagaatggtgagacaccccgacagccaccagctgttcatcggcaacctgccccacgaggtggacaagagcgagctgaaggacttcttccagagctacggcaacgtggtggagctgagaatcaacagcggcggcaagctgcccaacttcggcttcgtggtgttcgacgacagcgagcccgtgcagaaggtgctgagcaacagacccatcatgttcagaggcgaggtgagactgaacgtggaggagaagaagaccagagccgccagagagggcgacagaagagacaacagactgagaggccccggcggccccagaggcggcctgggcggcggcatgagaggcccccccagaggcggcatggtgcagaagcccggcttcggcgtgggcagaggcctggcccccagacagtag

SEQ ID NO: 83796 - DNA, 4359 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaaggcccccatccccttcagaaagaaggagaagcaggagaaggacaaggacgacctgggccccgacagattcagcaccctgaccgacgaccccagccccagactgagcgcccaggcccaggtggccgaggacatcctggacaagtacagaaacgccatcaagagaaccagccccagcgacggcgccatggccaactacgagagcaccggcgacaaccacgacagagacctgagcagcaagctgctgtaccacagcgacaaggaggtgatgggcgacggcgagagcgcccacgacagccccagagacgaggccctgcagaacatcagcgccgacgacctgcccgacagcgccagccaggccgcccacccccaggacagcgccttcagctacagagacgccaagaagaagctgagactggccctgtgcagcgccgacagcgtggccttccccgtgctgacccacagcaccagaaacggcctgcccgaccacaccgaccccgaggacaacgagatcgtgtgcttcctgaaggtgcagatcgccgaggccatcaacctgcaggacaagaacctgatggcccagctgcaggagaccatgagatgcgtgtgcagattcgacaacagaacctgcagaaagctgctggccagcatcgccgaggactacagaaagagagccccctacatcgcctacctgaccagatgcagacagggcctgcagaccacccaggcccacctggagagactgctgcagagagtgctgagagacaaggaggtggccaacagatacttcaccaccgtgtgcgtgagactgctgctggagagcaaggagaagaagatcagagagttcatccaggacttccagaagctgaccgccgccgacgacaagaccgcccaggtggaggacttcctgcagttcctgtacggcgccatggcccaggacgtgatctggcagaacgccagcgaggagcagctgcaggacgcccagctggccatcgagagaagcgtgatgaacagaatcttcaagctggccttctaccccaaccaggacggcgacatcctgagagaccaggtgctgcacgagcacatccagagactgagcaaggtggtgaccgccaaccacagagccctgcagatccccgaggtgtacctgagagaggccccctggcccagcgcccagagcgagatcagaaccatcagcgcctacaagacccccagagacaaggtgcagtgcatcctgagaatgtgcagcaccatcatgaacctgctgagcctggccaacgaggacagcgtgcccggcgccgacgacttcgtgcccgtgctggtgttcgtgctgatcaaggccaaccccccctgcctgctgagcaccgtgcagtacatcagcagcttctacgccagctgcctgagcggcgaggagagctactggtggatgcagttcaccgccgccgtggagttcatcaagaccatcgacgacagaaagtag

SEQ ID NO: 83797 - DNA, 1494 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcggcaaggagaacttcagctactggagcttcctgctgaacctgatcttccactag

SEQ ID NO: 83798 - DNA, 4437 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacggcgcccaccagctgaccagcccccccagccagagcgagagcctgctggccatgttcgaccccctgagcagccacgagggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaaggcccccatccccttcagaaagaaggagaagcaggagaaggacaaggacgacctgggccccgacagattcagcaccctgaccgacgaccccagccccagactgagcgcccaggcccaggtggccgaggacatcctggacaagtacagaaacgccatcaagagaaccagccccagcgacggcgccatggccaactacgagagcaccggcgacaaccacgacagagacctgagcagcaagctgctgtaccacagcgacaaggaggtgatgggcgacggcgagagcgcccacgacagccccagagacgaggccctgcagaacatcagcgccgacgacctgcccgacagcgccagccaggccgcccacccccaggacagcgccttcagctacagagacgccaagaagaagctgagactggccctgtgcagcgccgacagcgtggccttccccgtgctgacccacagcaccagaaacggcctgcccgaccacaccgaccccgaggacaacgagatcgtgtgcttcctgaaggtgcagatcgccgaggccatcaacctgcaggacaagaacctgatggcccagctgcaggagaccatgagatgcgtgtgcagattcgacaacagaacctgcagaaagctgctggccagcatcgccgaggactacagaaagagagccccctacatcgcctacctgaccagatgcagacagggcctgcagaccacccaggcccacctggagagactgctgcagagagtgctgagagacaaggaggtggccaacagatacttcaccaccgtgtgcgtgagactgctgctggagagcaaggagaagaagatcagagagttcatccaggacttccagaagctgaccgccgccgacgacaagaccgcccaggtggaggacttcctgcagttcctgtacggcgccatggcccaggacgtgatctggcagaacgccagcgaggagcagctgcaggacgcccagctggccatcgagagaagcgtgatgaacagaatcttcaagctggccttctaccccaaccaggacggcgacatcctgagagaccaggtgctgcacgagcacatccagagactgagcaaggtggtgaccgccaaccacagagccctgcagatccccgaggtgtacctgagagaggccccctggcccagcgcccagagcgagatcagaaccatcagcgcctacaagacccccagagacaaggtgcagtgcatcctgagaatgtgcagcaccatcatgaacctgctgagcctggccaacgaggacagcgtgcccggcgccgacgacttcgtgcccgtgctggtgttcgtgctgatcaaggccaaccccccctgcctgctgagcaccgtgcagtacatcagcagcttctacgccagctgcctgagcggcgaggagagctactggtggatgcagttcaccgccgccgtggagttcatcaagaccatcgacgacagaaagtag

SEQ ID NO: 83799 - DNA, 4464 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacgacttcctgtacatcctgcagcccaagcagcacttccagcacatcgaggccgaggccgacatgagaatccagctgagcagcagcgcccaccagctgaccagcccccccagccagagcgagagcctgctggccatgttcgaccccctgagcagccacgagggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaaggcccccatccccttcagaaagaaggagaagcaggagaaggacaaggacgacctgggccccgacagattcagcaccctgaccgacgaccccagccccagactgagcgcccaggcccaggtggccgaggacatcctggacaagtacagaaacgccatcaagagaaccagccccagcgacggcgccatggccaactacgagagcaccgaggtgatgggcgacggcgagagcgcccacgacagccccagagacgaggccctgcagaacatcagcgccgacgacctgcccgacagcgccagccaggccgcccacccccaggacagcgccttcagctacagagacgccaagaagaagctgagactggccctgtgcagcgccgacagcgtggccttccccgtgctgacccacagcaccagaaacggcctgcccgaccacaccgaccccgaggacaacgagatcgtgtgcttcctgaaggtgcagatcgccgaggccatcaacctgcaggacaagaacctgatggcccagctgcaggagaccatgagatgcgtgtgcagattcgacaacagaacctgcagaaagctgctggccagcatcgccgaggactacagaaagagagccccctacatcgcctacctgaccagatgcagacagggcctgcagaccacccaggcccacctggagagactgctgcagagagtgctgagagacaaggaggtggccaacagatacttcaccaccgtgtgcgtgagactgctgctggagagcaaggagaagaagatcagagagttcatccaggacttccagaagctgaccgccgccgacgacaagaccgcccaggtggaggacttcctgcagttcctgtacggcgccatggcccaggacgtgatctggcagaacgccagcgaggagcagctgcaggacgcccagctggccatcgagagaagcgtgatgaacagaatcttcaagctggccttctaccccaaccaggacggcgacatcctgagagaccaggtgctgcacgagcacatccagagactgagcaaggtggtgaccgccaaccacagagccctgcagatccccgaggtgtacctgagagaggccccctggcccagcgcccagagcgagatcagaaccatcagcgcctacaagacccccagagacaaggtgcagtgcatcctgagaatgtgcagcaccatcatgaacctgctgagcctggccaacgaggacagcgtgcccggcgccgacgacttcgtgcccgtgctggtgttcgtgctgatcaaggccaaccccccctgcctgctgagcaccgtgcagtacatcagcagcttctacgccagctgcctgagcggcgaggagagctactggtggatgcagttcaccgccgccgtggagttcatcaagaccatcgacgacagaaagtag

SEQ ID NO: 83800 - DNA, 2514 bp, Artificial Sequence
  Description of Artificial Sequence: Synthetic coding sequence
tgaaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaaggcccccatccccttcagaaagaaggagaagcaggagtag

SEQ ID NO: 83801 - DNA, 2493 bp, Artificial Sequence
  Description of Artificial Sequence: Synthetic coding sequence
tgactgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcggccagcagctggccgccatcaccgcctgggacagcagcgccaccaacatcaccagccacatcaccgtggtgacccccttcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacggcgcccaccagctgaccagcccccccagccagagcgagagcctgctggccatgttcgaccccctgagcagccacgagggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaaggcccccatccccttctag

SEQ ID NO: 83802 - DNA, 516 bp, Artificial Sequence
  Description of Artificial Sequence: Synthetic coding sequence
atggtgcagtggcccagaatgagctacggcaagaccagagtgatgaacagaatcttcaagctggccttctaccccaaccaggacggcgacatcctgagagaccaggtgctgcacgagcacatccagagactgagcaaggtggtgaccgccaaccacagagccctgcagatccccgaggtgtacctgagagaggccccctggcccagcgcccagagcgagatcagaaccatcagcgcctacaagacccccagagacaaggtgcagtgcatcctgagaatgtgcagcaccatcatgaacctgctgagcctggccaacgaggacagcgtgcccggcgccgacgacttcgtgcccgtgctggtgttcgtgctgatcaaggccaaccccccctgcctgctgagcaccgtgcagtacatcagcagcttctacgccagctgcctgagcggcgaggagagctactggtggatgcagttcaccgccgccgtggagttcatcaagaccatcgacgacagaaagtag

SEQ ID NO: 83803 - DNA, 354 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggctag

SEQ ID NO: 83804 - DNA, 2967 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggtgagcagcagacccagcacccccggcctgagcgtggtgagcggcatcagcgccaccagcgaggacatccccaacaagatcgaggacctgagaagcgagtgcagcagcgacttcggcggcaaggacagcgtgaccagccccgacatggacgagatcacccacggcgcccaccagctgaccagcccccccagccagagcgagagcctgctggccatgttcgaccccctgagcagccacgagggcgccagcgccgtggtgagacccaaggtgcactacgccagacccagccaccccccccccgacccccccatcctggagggcgccgtgggcggcaacgaggccagactgcccaacttcggcagccacgtgctgacccccgccgagatggaggccttcaagcagagacacagctaccccgagagactggtgagaagcagaagcagcgacatcgtgagcagcgtgagaagacccatgagcgaccccagctggaacagaagacccggcaacgaggagagagagctgccccccgccgccgccatcggcgccaccagcctggtggccgccccccacagcagcagcagcagccccagcaaggacagcagcagaggcgagaccgaggagagaaaggacagcgacgacgagaagagcgacagaaacagaccctggtggagaaagagattcgtgagcgccatgcccaagtag

SEQ ID NO: 83805 - DNA, 4437 bp, Artificial Sequence; identical to SEQ ID NO: 83798
  Description of Artificial Sequence: Synthetic coding sequence

SEQ ID NO: 83806 - DNA, 2271 bp, Artificial Sequence
  Description of Artificial Sequence: Synthetic coding sequence
atggtgaagctggacatccacaccctggcccaccacctgaagcaggagagactgtacgtgaacagcgagaagcagctgatccagagactgaacgccgacgtgctgaagaccgccgagaagctgtacagaaccgcctggatcgccaagcagcagagaatcaacctggacagactgatcatcaccagcgccgaggccagccccgccgagtgctgccagcacgccaagatcctggaggacacccagttcgtggacggctacaagcagctgggcttccaggagaccgcctacggcgagttcctgagcagactgagagagaaccccagactgatcgccagcagcctggtggccggcgagaagctgaaccaggagaacacccagagcgtgatctacaccgtgttcaccagcctgtacggcaactgcatcatgcaggaggacgagagctacctgctgcaggtgctgagatacctgatcgagttcgagctgaaggagagcgacaaccccagaagactgctgagaagaggcacctgcgccttcagcatcctgttcaagctgttcagcgagggcctgttcagcgccaagctgttcctgaccgccaccctgcacgagcccatcatgcagctgctggtggaggacgaggaccacctggagaccgaccccaacaagctgatcgagagattcagccccagccagcaggagaagctgttcggcgagaagggcagcgacagattcagacagaaggtgcaggagatggtggagagcaacgaggccaagctggtggccctggtgaacaagttcatcggctacctgaagcagaacacctactgcttcccccacagcctgagatggatcgtgagccagatgtacaagaccctgagctgcgtggacagactggaggtgggcgaggtgagagccatgtgcaccgacctgctgctggcctgcttcatctgccccgccgtggtgaaccccgagcagtacggcatcatcagcgacgcccccatcaacgaggtggccagattcaacctgatgcaggtgggcagactgctgcagcagctggccatgaccggcagcgaggagggcgaccccagaaccaagagcagcctgggcaagttcgacaagagctgcgtggccgccttcctggacgtggtgatcggcggcagagccgtggagaccccccccctgagcagcgtgaacctgctggagggcctgagcagaaccgtggtgtacatcacctacagccagctgatcaccctggtgaacttcatgaagagcgtgatgagcggcgaccagctgagagaggacagaatggccctggacaacctgctggccaacctgccccccgccaagcccggcaagagcagcagcctggagatgaccccctacaacaccccccagctgagccccgccaccacccccgccaacaagaagaacagactgcccatcgccaccagaagcagaagcagaaccaacatgctgatggacctgcacatggaccacgagggcagcagccaggagaccatccaggaggtgcagcccgaggaggtgctggtgatcagcctgggcaccggcccccagctgacccccggcatgatgagcgagaacgaggtgctgaacatgcagctgagcgacggcggccagggcgacgtgcccgtggacgagaacaagctgcacggcaagcccgacaagaccctgagattcagcctgtgcagcgacaacctggagggcatcagcgagggccccagcaacagaagcaacagcgtgagcagcctggacctggagggcgagagcgtgagcgagctgggcgccggccccagcggcagcaacggcgtggaggccctgcagctgctggagcacgagcaggccaccacccaggacaacctggacgacaagctgagaaagttcgagatcagagacatgatgggcctgaccgacgacagagacatcagcgagaccgtgagcgagacctggagcaccgacgtgctgggcagcgacttcgaccccaacatcgacgaggacagactgcaggagatcgccggcgccgccgccgagaacatgctgggcagcctgctgtgcctgcccggcagcggcagcgtgctgctggacccctgcaccggcagcaccatcagcgagaccaccagcgaggcctggagcgtggaggtgctgcccagcgacagcgaggcccccgacctgaagcaggaggagagactgcaggagctggagagctgcagcggcctgggcagcaccagcgacgacaccgacgtgagagaggcctag

SEQ ID NO: 83807 - DNA, 921 bp, Artificial Sequence
  Description of Artificial Sequence: Synthetic coding sequence
atgggcggcagaaagatggccaccgacgaggagaacgtgtacggcctggaggagaacgcccagagcagacaggagagcaccagaagactgatcctggtgggcagaaccggcgccggcaagagcgccaccggcaacagcatcctgggccagagaagattcttcagcagactgggcgccaccagcgtgaccagagcctgcaccaccggcagcagaagatgggacaagtgccacgtggaggtggtggacacccccgacatcttcagcagccaggtgagcaagaccgaccccggctgcgaggagagaggccactgctacctgctgagcgcccccggcccccacgccctgctgctggtgacccagctgggcagattcaccgcccaggaccagcaggccgtgagacaggtgagagacatgttcggcgaggacgtgctgaagtggatggtgatcgtgttcaccagaaaggaggacctggccggcggcagcctgcacgactacgtgagcaacaccgagaacagagccctgagagagctggtggccgagtgcggcggcagagtgtgcgccttcgacaacagagccaccggcagagagcaggaggcccaggtggagcagctgctgggcatggtggagggcctggtgctggagcacaagggcgcccactacagcaacgaggtgtacgagctggcccaggtgctgagatgggccggccccgaggagagactgagaagagtggccgagagagtggccgccagagtgcagagaagaccctggggcgcctggctgagcgccagactgtggaagtggctgaagagccccagaagctggagactgggcctggccctgctgctgggcggcgccctgctgttctgggtgctgctgcacagaagatggagcgaggccgtggccgaggtgggccccgactag

SEQ ID NO: 83808 - DNA, 681 bp, Artificial Sequence
  Description of Artificial Sequence: Synthetic coding sequence
atgagctgggtgcaggccgccagcctgatccagggccccggcgacaagggcgacgtgttcgacgaggaggccgacgagagcctgctggcccagagagagtggcagagcaacatgcagagaagagtgaaggagggctacagagacggcatcgacgccggcaaggccgtgaccctgcagcagggcttcaaccagggctacaagaagggcgccgaggtgatcctgaactacggcagactgagaggcaccctgagcgccctgctgagctggtgccacctgcacaacaacaacagcaccctgatcaacaagatcaacaacctgctggacgccgtgggccagtgcgaggagtacgtgctgaagcacctgaagagcatcaccccccccagccacgtggtggacctgctggacagcatcgaggacatggacctgtgccacgtggtgcccgccgagaagaagatcgacgaggccaaggacgagagactgtgcgagaacaacgccgagttcaacaagaactgcagcaagagccacagcggcatcgactgcagctacgtggagtgctgcagaacccaggagcacgcccacagcgagaaccccagccccacctggatcctggagcagaccgccagcctggtgaagcagctgggcctgagcgtggacgtgctgcagcacctgaagcagctgtag

SEQ ID NO: 83809 - DNA, 990 bp, Artificial Sequence
  Description of Artificial Sequence: Synthetic coding sequence
atggccgcccagtacggcagcatgagcttcaaccccagcacccccggcgccagctacggccccggcagacaggagcccagaaacagccagctgagaatcgtgctggtgggcaagaccggcgccggcaagagcgccaccggcaacagcatcctgggcagaaaggtgttccacagcggcaccgccgccaagagcatcaccaagaagtgcgagaagagaagcagcagctggaaggagaccgagctggtggtggtggacacccccggcatcttcgacaccgaggtgcccaacgccgagaccagcaaggagatcatcagatgcatcctgctgaccagccccggcccccacgccctgctgctggtggtgcccctgggcagatacaccgaggaggagcacaaggccaccgagaagatcctgaagatgttcggcgagagagccagaagcttcatgatcctgatcttcaccagaaaggacgacctgggcgacaccaacctgcacgactacctgagagaggcccccgaggacatccaggacctgatggacatcttcggcgacagatactgcgccctgaacaacaaggccaccggcgccgagcaggaggcccagagagcccagctgctgggcctgatccagagagtggtgagagagaacaaggagggctgctacaccaacagaatgtaccagagagccgaggaggagatccagaagcagacccaggccatgcaggagctgcacagagtggagctggagagagagaaggccagaatcagagaggagtacgaggagaagatcagaaagctggaggacaaggtggagcaggagaagagaaagaagcagatggagaagaagctggccgagcaggaggcccactacgccgtgagacagcagagagccagaaccgaggtggagagcaaggacggcatcctggagctgatcatgaccgccctgcagatcgccagcttcatcctgctgagactgttcgccgaggactag

SEQ ID NO: 83810 - DNA, 786 bp, Artificial Sequence
  Description of Artificial Sequence: Synthetic coding sequence
atggccgcccagtacggcagcatgagcttcaaccccagcacccccggcgccagctacggccccggcagacaggagcccagaaacagccagctgagaatcgtgctggtgggcaagaccggcgccggcaagagcgccaccggcaacagcatcctgggcagaaaggtgttccacagcggcaccgccgccaagagcatcaccaagaagatcctgaagatgttcggcgagagagccagaagcttcatgatcctgatcttcaccagaaaggacgacctgggcgacaccaacctgcacgactacctgagagaggcccccgaggacatccaggacctgatggacatcttcggcgacagatactgcgccctgaacaacaaggccaccggcgccgagcaggaggcccagagagcccagctgctgggcctgatccagagagtggtgagagagaacaaggagggctgctacaccaacagaatgtaccagagagccgaggaggagatccagaagcagacccaggccatgcaggagctgcacagagtggagctggagagagagaaggccagaatcagagaggagtacgaggagaagatcagaaagctggaggacaaggtggagcaggagaagagaaagaagcagatggagaagaagctggccgagcaggaggcccactacgccgtgagacagcagagagccagaaccgaggtggagagcaaggacggcatcctggagctgatcatgaccgccctgcagatcgccagcttcatcctgctgagactgttcgccgaggactag

SEQ ID NO: 83811 - DNA, 456 bp, Artificial Sequence
  Description of Artificial Sequence: Synthetic coding sequence
atggccgcccagtacggcagcatgagcttcaaccccagcacccccggcgccagctacggcgagagagccttcagcgccccccagaccagactgcagggcggccccggcagacaggagcccagaaacagccagctgagaatcgtgctggtgggcaagaccggcgccggcaagagcgccaccggcaacagcatcctgggcagaaaggtgttccacagcggcaccgccgccaagagcatcaccaagaagtgcgagaagagaagcagcagctggaaggagaccgagctggtggtggtggacacccccggcatcttcgacaccgaggtgcccaacgccgagaccagcaaggagatcatcagatgcatcctgctgaccagccccggcccccacgccctgctgctggtggtgcccctgggcagatacaccgaggaggagcacaaggccaccgagaagatctag

SEQ ID NO: 83812 - DNA, 924 bp, Artificial Sequence
  Description of Artificial Sequence: Synthetic coding sequence
atgggcggcttccagagaggcaagtacggcaccatggccgagggcagaagcgaggacaacctgagcgccaccccccccgccctgagaatcatcctggtgggcaagaccggctgcggcaagagcgccaccggcaacagcatcctgggccagcccgtgttcgagagcaagctgagagcccagagcgtgaccagaacctgccaggtgaagaccggcacctggaacggcagaaaggtgctggtggtggacacccccagcatcttcgagagccaggccgacacccaggagctgtacaagaacatcggcgactgctacctgctgagcgcccccggcccccacgtgctgctgctggtgatccagctgggcagattcaccgcccaggacaccgtggccatcagaaaggtgaaggaggtgttcggcaccggcgccatgagacacgtggtgatcctgttcacccacaaggaggacctgggcggccaggccctggacgactacgtggccaacaccgacaactgcagcctgaaggacctggtgagagagtgcgagagaagatactgcgccttcaacaactggggcagcgtggaggagcagagacagcagcaggccgagctgctggccgtgatcgagagactgggcagagagagagagggcagcttccacagcaacgacctgttcctggacgcccagctgctgcagagaaccggcgccggcgcctgccaggaggactacagacagtaccaggccaaggtggagtggcaggtggagaagcacaagcaggagctgagagagaacgagagcaactgggcctacaaggccctgctgagagtgaagcacctgatgctgctgcactacgagatcttcgtgttcctgctgctgtgcagcatcctgttcttcatcatcttcctgttcatcttccactacatctag

SEQ ID NO: 83813 - DNA, 1032 bp, Artificial Sequence
  Description of Artificial Sequence: Synthetic coding sequence
atggagctgagcgcccccgcccacggcagcagcctgaccgccagcgcccagccccccagcgtgaccgccaccctggaggacagagcccagcagcccttcctggagagaatgggcggcttccagagaggcaagtacggcaccatggccgagggcagaagcgaggacaacctgagcgccaccccccccgccctgagaatcatcctggtgggcaagaccggctgcggcaagagcgccaccggcaacagcatcctgggccagcccgtgttcgagagcaagctgagagcccagagcgtgaccagaacctgccaggtgaagaccggcacctggaacggcagaaaggtgctggtggtggacacccccagcatcttcgagagccaggccgacacccaggagctgtacaagaacatcggcgactgctacctgctgagcgcccccggcccccacgtgctgctgctggtgatccagctgggcagattcaccgcccaggacaccgtggccatcagaaaggtgaaggaggtgttcggcaccggcgccatgagacacgtggtgatcctgttcacccacaaggaggacctgggcggccaggccctggacgactacgtggccaacaccgacaactgcagcctgaaggacctggtgagagagtgcgagagaagatactgcgccttcaacaactggggcagcgtggaggagcagagacagcagcaggccgagctgctggccgtgatcgagagactgggcagagagagagagggcagcttccacagcaacgacctgttcctggacgcccagctgctgcagagaaccggcgccggcgcctgccaggaggactacagacagtaccaggccaaggtggagtggcaggtggagaagcacaagcaggagctgagagagaacgagagcaactgggcctacaaggccctgctgagagtgaagcacctgatgctgctgcactacgagatcttcgtgttcctgctgctgtgcagcatcctgttcttcatcatcttcctgttcatcttccactacatctag

SEQ ID NO: 83814 - DNA, 879 bp, Artificial Sequence
  Description of Artificial Sequence: Synthetic coding sequence
atggaggaggaggagtacgagcagatcccccaggagaacccccccgaggagctgagccaggaccccgtgctggagctgagcggcggcctgagagagaaggagcagaagacccccagaagactgagactgatcctgatgggcaagaccggcagcggcaagagcgccaccggcaacagcatcctgggcagagacgtgttcgagagcaagctgagcaccagacccgtgaccaagaccagccagagaagaagcagagagtgggccggcaaggagctggaggtgatcgacacccccaacatcctgagcccccaggtgagccccgaggtggccgacgccatctgccaggccatcgtgctgagcgcccccggcccccacgccgtgctgctggtgacccagctgggcagattcaccgacgaggaccagcaggtggtgagaagactgcaggaggtgttcggcgtgggcgtgctgggccacaccatcctggtgttcaccagaaaggaggacctggccggcggcagcctggaggactacgtgagagagaccaacaaccaggccctggcctggctggacgtgaccctggccagaagacactgcggcttcaacaacagagcccagggcgaggagcaggaggcccagctgagagagctgatggagaaggtggaggccatcatgtgggagaacgagggcgactactacagcaacaaggcctaccagtacacccagcagaacttcagactgaaggagctgcaggagagacaggtgagccagggccagggcagcgaggacgtgcccggcgaggagagctggctggagggcctgagccagatccagaaggagagcgaggaggcccacagatgcctgctgggcaaggccgacctgtag

SEQ ID NO: 83815 - DNA, 1062 bp, Artificial Sequence
  Description of Artificial Sequence: Synthetic coding sequence
aagccctggtactgggtgagctggtgcagcatcggccaggtgagcctgttcttcctgggcagcgccctggccctgggcgagaacgtgcagccccacctgcagggctgcggccccagaatggtggcccagagatggttccagggcagatgctggagcttcaccatctgcccctgcagcctgggcgtgcaccccgaggcccccggcgacgacaagatgggctacatgggcccctaccccagcagcctgtgcttcctgtggatcttcctgggcctgagagagaaggagcagaagacccccagaagactgagactgatcctgatgggcaagaccggcagcggcaagagcgccaccggcaacagcatcctgggcagagacgtgttcgagagcaagctgagcaccagacccgtgaccaagaccagccagagaagaagcagagagtgggccggcaaggagctggaggtgatcgacacccccaacatcctgagcccccaggtgagccccgaggtggccgacgccatctgccaggccatcgtgctgagcgcccccggcccccacgccgtgctgctggtgacccagctgggcagattcaccgacgaggaccagcaggtggtgagaagactgcaggaggtgttcggcgtgggcgtgctgggccacaccatcctggtgttcaccagaaaggaggacctggccggcggcagcctggaggactacgtgagagagaccaacaaccaggccctggcctggctggacgtgaccctggccagaagacactgcggcttcaacaacagagcccagggcgaggagcaggaggcccagctgagagagctgatggagaaggtggaggccatcatgtgggagaacgagggcgactactacagcaacaaggcctaccagtacacccagcagaacttcagactgaaggagctgcaggagagacaggtgagccagggccagggcagcgaggacgtgcccggcgaggagagctggctggagggcctgagccagatccagaaggagagcgaggaggcccacagatgcctgctgggcaaggccgacctgtag

SEQ ID NO: 83816 - DNA, 189 bp, Artificial Sequence
  Description of Artificial Sequence: Synthetic coding sequence
atggaggaggaggagtacgagcagatcccccaggagaacccccccgaggagctgagccaggaccccgtgctggagctgagcggcggcctggccagaggcggcagaagatacctgcccagccacagactgatcagacccagagcccccagaagagcccccggcgacaccaccggccccgtgcacggctag

SEQ ID NO: 83817 - DNA, 1266 bp, Artificial Sequence
  Description of Artificial Sequence: Synthetic coding sequence
atgagatggatcctgttcatcggcgccctgatcggcagcagcatctgcggccaggagaagttcttcggcgaccaggtgctgagaatcaacgtgagaaacggcgacgagatcagcaagctgagccagctggtgaacagcaacaacctgaagctgaacttctggaagagccccagcagcttcaacagacccgtggacgtgctggtgcccagcgtgagcctgcaggccttcaagagcttcctgagaagccagggcctggagtacgccgtgaccatcgaggacctgcaggccctgctggacaacgaggacgacgagatgcagcacaacgagggccaggagagaagcagcaacaacttcaactacggcgcctaccacagcctggaggccatctaccacgagatggacaacatcgccgccgacttccccgacctggccagaagagtgaagatcggccacagcttcgagaacagacccatgtacgtgctgaagttcagcaccggcaagggcgtgagaagacccgccgtgtggctgaacgccggcatccacagcagagagtggatcagccaggccaccgccatctggaccgccagaaagatcgtgagcgactaccagagagaccccgccatcaccagcatcctggagaagatggacatcttcctgctgcccgtggccaaccccgacggctacgtgtacacccagacccagaacagactgtggagaaagaccagaagcagaaaccccggcagcagctgcatcggcgccgaccccaacagaaactggaacgccagcttcgccggcaagggcgccagcgacaacccctgcagcgaggtgtaccacggcccccacgccaacagcgaggtggaggtgaagagcgtggtggacttcatccagaagcacggcaacttcaagggcttcatcgacctgcacagctacagccagctgctgatgtacccctacggctacagcgtgaagaaggcccccgacgccgaggagctggacaaggtggccagactggccgccaaggccctggccagcgtgagcggcaccgagtaccaggtgggccccacctgcaccaccgtgtaccccgccagcggcagcagcatcgactgggcctacgacaacggcatcaagttcgccttcaccttcgagctgagagacaccggcacctacggcttcctgctgcccgccaaccagatcatccccaccgccgaggagacctggctgggcctgaagaccatcatggagcacgtgagagacaacctgtactag

SEQ ID NO: 83818 - DNA, 927 bp, Artificial Sequence
  Description of Artificial Sequence: Synthetic coding sequence
atggtgcactgcagctgcgtgctgttcagaaagtacggcaacttcatcgacaagctgagactgttcaccagaggcggcagcggcggcatgggctaccccagactgggcggcgagggcggcaagggcggcgacgtgtgggtggtggcccagaacagaatgaccctgaagcagctgaaggacagataccccagaaagagattcgtggccggcgtgggcgccaacagcaagttccccaacgccggcaagagcagcctgctgagctgcgtgagccacgccaagcccgccatcgccgactacgccttcaccaccctgaagcccgagctgggcaagatcatgtacagcgacttcaagcagatcagcgtggccgacctgcccggcctgatcgagggcgcccacatgaacaagggcatgggccacaagttcctgaagcacatcgagagaaccagacagctgctgttcgtggtggacatcagcggcttccagctgagcagccacacccagtacagaaccgccttcgagaccatcatcctgctgaccaaggagctggagctgtacaaggaggagctgcagaccaagcccgccctgctggccgtgaacaagatggacctgcccgacgcccaggacaagttccacgagctgatgagccagctgcagaaccccaaggacttcctgcacctgttcgagaagaacatgatccccgagagaaccgtggagttccagcacatcatccccatcagcgccgtgaccggcgagggcatcgaggagctgaagaactgcatcagaaagagcctggacgagcaggccaaccaggagaacgacgccctgcacaagaagcagctgctgaacctgtggatcagcgacaccatgagcagcaccgagccccccagcaagcacgccgtgaccaccagcaagatggacatcatctag

SEQ ID NO: 83819 - DNA, 711 bp, Artificial Sequence
  Description of Artificial Sequence: Synthetic coding sequence
atgagcgcccccagcgccacccccatcttcgcccccggcgagaactgcagccccgcctggggcgccgcccccgccgcctacgacgccgccgacacccacctgagaatcctgggcaagcccgtgatggagagatgggagaccccctacatgcacgccctggccgccgccgccagcagcaagggcggcagagtgctggaggtgggcttcggcatggccatcgccgccagcaaggtgcaggaggcccccatcgacgagcactggatcatcgagtgcaacgacggcgtgttccagagactgagagactgggcccccagacagacccacaaggtgatccccctgaagggcctgtgggaggacgtggcccccaccctgcccgacggccacttcgacggcatcctgtacgacacctaccccctgagcgaggagacctggcacacccaccagttcaacttcatcaagaaccacgccttcagactgctgaagcccggcggcgtgctgacctactgcaacctgaccagctggggcgagctgatgaagagcaagtacagcgacatcaccatcatgttcgaggagacccaggtgcccgccctgctggaggccggcttcagaagagagaacatcagaaccgaggtgatggccctggtgccccccgccgactgcagatactacgccttcccccagatgatcacccccctggtgaccaagggctag

SEQ ID NO: 83820 - DNA, 810 bp, Artificial Sequence
  Description of Artificial Sequence: Synthetic coding sequence
atgagcgcccccagcgccacccccatcttcgcccccggcgagaactgcagccccgcctggggcgccgcccccgccgcctacgacgccgccgacacccacctgagaatcctgggcaagcccgtgatggagagatgggagaccccctacatgcacgccctggccgccgccgccagcagcaagggcggcagagtgctggaggtgggcttcggcatggccatcgccgccagcaaggtgcaggaggcccccatcgacgagcactggatcatcgagtgcaacgacggcgtgttccagagactgagagactgggcccccagacagacccacaaggtgatccccctgaagggcctgtgggaggacgtggcccccaccctgcccgacggccacttcgacggcatcctgtacgacacctaccccctgagcgaggagacctggcacacccaccagttcaacttcatcaagaaccacgccttcagactgctgaagcccggcggcgtgctgacctactgcaacctgaccagctggggcgagctgatgaagagcaagtacagcgacatcaccatcatgttcgaggtgagaccccccgaggtgccccacggcagccccggcagcgacctgggctggggctgggagggcgccgccggcgccaccctgctgcccggcgagggccccttcctgaccccctgggtgggctggaccgtgctggtgcacctggagatcaaggtgctgtgcctggcccagtggctgcccggcgccgtggcccaggtgtacaaccccagcaccgtggagggcagaggcggccagatcgcctag

SEQ ID NO: 83821 - DNA, 1416 bp, Artificial Sequence
  Description of Artificial Sequence: Synthetic coding sequence
atgtgcgccgcccagatgccccccctggcccacatcttcagaggcaccttcgtgcacagcacctggacctgccccatggaggtgctgagagaccacctgctgggcgtgagcgacagcggcaagatcgtgttcctggaggaggccagccagcaggagaagctggccaaggagtggtgcttcaagccctgcgagatcagagagctgagccaccacgagttcttcatgcccggcctggtggacacccacatccacgccagccagtacagcttcgccggcagcagcatcgacctgcccctgctggagtggctgaccaagtacaccttccccgccgagcacagattccagaacatcgacttcgccgaggaggtgtacaccagagtggtgagaagaaccctgaagaacggcaccaccaccgcctgctacttcgccaccatccacaccgacagcagcctgctgctggccgacatcaccgacaagttcggccagagagccttcgtgggcaaggtgtgcatggacctgaacgacaccttccccgagtacaaggagaccaccgaggagagcatcaaggagaccgagagattcgtgagcgagatgctgcagaagaactacagcagagtgaagcccatcgtgacccccagattcagcctgagctgcagcgagaccctgatgggcgagctgggcaacatcgccaagaccagagacctgcacatccagagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgaaggagaccatccacctgcccgccagcagcccccaccccccccccttcccctag

SEQ ID NO: 83822 - DNA, 1365 bp, Artificial Sequence
  Description of Artificial Sequence: Synthetic coding sequence
atgtgcgccgcccagatgccccccctggcccacatcttcagaggcaccttcgtgcacagcacctggacctgccccatggaggtgctgagagaccacctgctgggcgtgagcgacagcggcaagatcgtgttcctggaggaggccagccagcaggagaagctggccaaggagtggtgcttcaagccctgcgagatcagagagctgagccaccacgagttcttcatgcccggcctggtggacacccacatccacgccagccagtacagcttcgccggcagcagcatcgacctgcccctgctggagtggctgaccaagtacaccttccccgccgagcacagattccagaacatcgacttcgccgaggaggtgtacaccagagtggtgagaagaaccctgaagaacggcaccaccaccgcctgctacttcgccaccatccacaccgacagcagcctgctgctggccgacatcaccgacaagttcggccagagagccttcgtgggcaaggtgtgcatggacctgaacgacaccttccccgagtacaaggagaccaccgaggagagcatcaaggagaccgagagattcgtgagcgagatgctgcagaagaactacagcagagtgaagcccatcgtgacccccagattcagcctgagctgcagcgagaccctgatgggcgagctgggcaacatcgccaagaccagagacctgcacatccagagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgtag

SEQ ID NO: 83823 - DNA, 1182 bp, Artificial Sequence
  Description of Artificial Sequence: Synthetic coding sequence
atgttcctggaggaggccagccagcaggagaagctggccaaggagtggtgcttcaagccctgcgagatcagagagctgagccaccacgagttcttcatgcccggcctggtggacacccacatccacgccagccagtacagcttcgccggcagcagcatcgacctgcccctgctggagtggctgaccaagtacaccttccccgccgagcacagattccagaacatcgacttcgccgaggaggtgtacaccagagtggtgagaagaaccctgaagaacggcaccaccaccgcctgctacttcgccaccatccacaccgacagcagcctgctgctggccgacatcaccgacaagttcggccagagagccttcgtgggcaaggtgtgcatggacctgaacgacaccttccccgagtacaaggagaccaccgaggagagcatcaaggagaccgagagattcgtgagcgagatgctgcagaagaacagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgaaggagaccatccacctgcccgccagcagcccccaccccccccccttcccctag

SEQ ID NO: 83824 - DNA, 1233 bp, Artificial Sequence
  Description of Artificial Sequence: Synthetic coding sequence
atggaggtgctgagagaccacctgctgggcgtgagcgacagcggcaagatcgtgttcctggaggaggccagccagcaggagaagctggccaaggagtggtgcttcaagccctgcgagatcagagagctgagccaccacgagttcttcatgcccggcctggtggacacccacatccacgccagccagtacagcttcgccggcagcagcatcgacctgcccctgctggagtggctgaccaagtacaccttccccgccgagcacagattccagaacatcgacttcgccgaggaggtgtacaccagagtggtgagaagaaccctgaagaacggcaccaccaccgcctgctacttcgccaccatccacaccgacagcagcctgctgctggccgacatcaccgacaagttcggccagagagccttcgtgggcaaggtgtgcatggacctgaacgacaccttccccgagtacaaggagaccaccgaggagagcatcaaggagaccgagagattcgtgagcgagatgctgcagaagaacagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgaaggagaccatccacctgcccgccagcagcccccaccccccccccttcccctag

SEQ ID NO: 83825 - DNA, 588 bp, Artificial Sequence
  Description of Artificial Sequence: Synthetic coding sequence
atgaccctgttccagaacaccagaagacccctgagaaacagaagcagaaagctgagagactgccacagcgtgacccaggccggcgtgcagtggagagacctgagcagcctgaagccccccccccccgtgttcaagagattcagctgcctgagcctgcccagcagctgggactacagattcgtgagcgagatgctgcagaagaactacagcagagtgaagcccatcgtgacccccagattcagcctgagctgcagcgagaccctgatgggcgagctgggcaacatcgccaagaccagagacctgcacatccagagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcacctag

SEQ ID NO: 83826 - DNA, 540 bp, Artificial Sequence
  Description of Artificial Sequence: Synthetic coding sequence
gagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgaaggagaccatccacctgcccgccagcagcccccaccccccccccttcccctag

SEQ ID NO: 83827 - DNA, 1365 bp, Artificial Sequence; identical to SEQ ID NO: 83822
  Description of Artificial Sequence: Synthetic coding sequence

SEQ ID NO: 83828 - DNA, 1143 bp, Artificial Sequence
  Description of Artificial Sequence: Synthetic coding sequence
atgcccggcctggtggacacccacatccacgccagccagtacagcttcgccggcagcagcatcgacctgcccctgctggagtggctgaccaagtacaccttccccgccgagcacagattccagaacatcgacttcgccgaggaggtgtacaccagagtggtgagaagaaccctgaagaacggcaccaccaccgcctgctacttcgccaccatccacaccgacagcagcctgctgctggccgacatcaccgacaagttcggccagagagccttcgtgggcaaggtgtgcatggacctgaacgacaccttccccgagtacaaggagaccaccgaggagagcatcaaggagaccgagagattcgtgagcgagatgctgcagaagaactacagcagagtgaagcccatcgtgacccccagattcagcctgagctgcagcgagaccctgatgggcgagctgggcaacatcgccaagaccagagacctgcacatccagagccacatcagcgagaacagagacgaggtggaggccgtgaagaacctgtaccccagctacaagaactacaccagcgtgtacgacaagaacaacctgctgaccaacaagaccgtgatggcccacggctgctacctgagcgccgaggagctgaacgtgttccacgagagaggcgccagcatcgcccactgccccaacagcaacctgagcctgagcagcggcttcctgaacgtgctggaggtgctgaagcacgaggtgaagatcggcctgggcaccgacgtggccggcggctacagctacagcatgctggacgccatcagaagagccgtgatggtgagcaacatcctgctgatcaacaaggtgaacgagaagagcctgaccctgaaggaggtgttcagactggccaccctgggcggcagccaggccctgggcctggacggcgagatcggcaacttcgaggtgggcaaggagttcgacgccatcctgatcaaccccaaggccagcgacagccccatcgacctgttctacggcgacttcttcggcgacatcagcgaggccgtgatccagaagttcctgtacctgggcgacgacagaaacatcgaggaggtgtacgtgggcggcaagcaggtggtgcccttcagcagcagcgtgtag

SEQ ID NO: 83829 - DNA, 2082 bp, Artificial Sequence
  Description of Artificial Sequence: Synthetic coding sequence
atggccctgtgcaacggcgacagcaagctggagaacgccggcggcgacctgaaggacggccaccaccactacgagggcgccgtggtgatcctggacgccggcgcccagtacggcaaggtgatcgacagaagagtgagagagctgttcgtgcagagcgagatcttccccctggagacccccgccttcgccatcaaggagcagggcttcagagccatcatcatcagcggcggccccaacagcgtgtacgccgaggacgccccctggttcgaccccgccatcttcaccatcggcaagcccgtgctgggcatctgctacggcatgcagatgatgaacaaggtgttcggcggcaccgtgcacaagaagagcgtgagagaggacggcgtgttcaacatcagcgtggacaacacctgcagcctgttcagaggcctgcagaaggaggaggtggtgctgctgacccacggcgacagcgtggacaaggtggccgacggcttcaaggtggtggccagaagcggcaacatcgtggccggcatcgccaacgagagcaagaagctgtacggcgcccagttccaccccgaggtgggcctgaccgagaacggcaaggtgatcctgaagaacttcctgtacgacatcgccggctgcagcggcaccttcaccgtgcagaacagagagctggagtgcatcagagagatcaaggagagagtgggcaccagcaaggtgctggtgctgctgagcggcggcgtggacagcaccgtgtgcaccgccctgctgaacagagccctgaaccaggagcaggtgatcgccgtgcacatcgacaacggcttcatgagaaagagagagagccagagcgtggaggaggccctgaagaagctgggcatccaggtgaaggtgatcaacgccgcccacagcttctacaacggcaccaccaccctgcccatcagcgacgaggacagaacccccagaaagagaatcagcaagaccctgaacatgaccaccagccccgaggagaagagaaagatcatcggcgacaccttcgtgaagatcgccaacgaggtgatcggcgagatgaacctgaagcccgaggaggtgttcctggcccagggcaccctgagacccgacctgatcgagagcgccagcctggtggccagcggcaaggccgagctgatcaagacccaccacaacgacaccgagctgatcagaaagctgagagaggagggcaaggtgatcgagcccctgaaggacttccacaaggacgaggtgagaatcctgggcagagagctgggcctgcccgaggagctggtgagcagacaccccttccccggccccggcctggccatcagagtgatctgcgccgaggagccctacatctgcaaggacttccccgagaccaacaacatcctgaagatcgtggccgacttcagcgccagcgtgaagaagccccacaccctgctgcagagagtgaaggcctgcaccaccgaggaggaccaggagaagctgatgcagatcaccagcctgcacagcctgaacgccttcctgctgcccatcaagaccgtgggcgtgcagggcgactgcagaagctacagctacgtgtgcggcatcagcagcaaggacgagcccgactgggagagcctgatcttcctggccagactgatccccagaatgtgccacaacgtgaacagagtggtgtacatcttcggcccccccgtgaaggagccccccaccgacgtgacccccaccttcctgaccaccggcgtgctgagcaccctgagacaggccgacttcgaggcccacaacatcctgagagagagcggctacgccggcaagatcagccagatgcccgtgatcctgacccccctgcacttcgacagagaccccctgcagaagcagcccagctgccagagaagcgtggtgatcagaaccttcatcaccagcgacttcatgaccggcatccccgccacccccggcaacgagatccccgtggaggtggtgctgaagatggtgaccgagatcaagaagatccccggcatcagcagaatcatgtacgacctgaccagcaagccccccggcaccaccgagtgggagtag

SEQ ID NO: 83830 - DNA, 1929 bp, Artificial Sequence
  Description of Artificial Sequence: Synthetic coding sequence
atgctggaggagaccctgagaatggccaccaccaccatcaaggagcagggcttcagagccatcatcatcagcggcggccccaacagcgtgtacgccgaggacgccccctggttcgaccccgccatcttcaccatcggcaagcccgtgctgggcatctgctacggcatgcagatgatgaacaaggtgttcggcggcaccgtgcacaagaagagcgtgagagaggacggcgtgttcaacatcagcgtggacaacacctgcagcctgttcagaggcctgcagaaggaggaggtggtgctgctgacccacggcgacagcgtggacaaggtggccgacggcttcaaggtggtggccagaagcggcaacatcgtggccggcatcgccaacgagagcaagaagctgtacggcgcccagttccaccccgaggtgggcctgaccgagaacggcaaggtgatcctgaagaacttcctgtacgacatcgccggctgcagcggcaccttcaccgtgcagaacagagagctggagtgcatcagagagatcaaggagagagtgggcaccagcaaggtgctggtgctgctgagcggcggcgtggacagcaccgtgtgcaccgccctgctgaacagagccctgaaccaggagcaggtgatcgccgtgcacatcgacaacggcttcatgagaaagagagagagccagagcgtggaggaggccctgaagaagctgggcatccaggtgaaggtgatcaacgccgcccacagcttctacaacggcaccaccaccctgcccatcagcgacgaggacagaacccccagaaagagaatcagcaagaccctgaacatgaccaccagccccgaggagaagagaaagatcatcggcgacaccttcgtgaagatcgccaacgaggtgatcggcgagatgaacctgaagcccgaggaggtgttcctggcccagggcaccctgagacccgacctgatcgagagcgccagcctggtggccagcggcaaggccgagctgatcaagacccaccacaacgacaccgagctgatcagaaagctgagagaggagggcaaggtgatcgagcccctgaaggacttccacaaggacgaggtgagaatcctgggcagagagctgggcctgcccgaggagctggtgagcagacaccccttccccggccccggcctggccatcagagtgatctgcgccgaggagccctacatctgcaaggacttccccgagaccaacaacatcctgaagatcgtggccgacttcagcgccagcgtgaagaagccccacaccctgctgcagagagtgaaggcctgcaccaccgaggaggaccaggagaagctgatgcagatcaccagcctgcacagcctgaacgccttcctgctgcccatcaagaccgtgggcgtgcagggcgactgcagaagctacagctacgtgtgcggcatcagcagcaaggacgagcccgactgggagagcctgatcttcctggccagactgatccccagaatgtgccacaacgtgaacagagtggtgtacatcttcggcccccccgtgaaggagccccccaccgacgtgacccccaccttcctgaccaccggcgtgctgagcaccctgagacaggccgacttcgaggcccacaacatcctgagagagagcggctacgccggcaagatcagccagatgcccgtgatcctgacccccctgcacttcgacagagaccccctgcagaagcagcccagctgccagagaagcgtggtgatcagaaccttcatcaccagcgacttcatgaccggcatccccgccacccccggcaacgagatccccgtggaggtggtgctgaagatggtgaccgagatcaagaagatccccggcatcagcagaatcatgtacgacctgaccagcaagccccccggcaccaccgagtgggagtag

SEQ ID NO: 83831 - DNA, 2082 bp, Artificial Sequence; identical to SEQ ID NO: 83829
  Description of Artificial Sequence: Synthetic coding sequence

SEQ ID NO: 83832 - DNA, 1146 bp, Artificial Sequence
  Description of Artificial Sequence: Synthetic coding sequence
atgagcggcgtggtgagaaccctgagcagatgcctgctgcccgccgaggccggcggcgccagagagagaagagccggcagcggcgccagagacgccgagagagaggccagaagaagaagcagagacatcgacgccctgctggccagagagagaagagccgtgagaagactggtgaagatcctgctgctgggcgccggcgagagcggcaagagcaccttcctgaagcagatgagaatcatccacggcagagagttcgaccagaaggccctgctggagttcagagacaccatcttcgacaacatcctgaagggcagcagagtgctggtggacgccagagacaagctgggcatcccctggcagtacagcgagaacgagaagcacggcatgttcctgatggccttcgagaacaaggccggcctgcccgtggagcccgccaccttccagctgtacgtgcccgccctgagcgccctgtggagagacagcggcatcagagaggccttcagcagaagaagcgagttccagctgggcgagagcgtgaagtacttcctggacaacctggacagaatcggccagctgaactacttccccagcaagcaggacatcctgctggccagaaaggccaccaagggcatcgtggagcacgacttcgtgatcaagaagatccccttcaagatggtggacgtgggcggccagagaagccagagacagaagtggttccagtgcttcgacggcatcaccagcatcctgttcatggtgagcagcagcgagtacgaccaggtgctgatggaggacagaagaaccaacagactggtggagagcatgaacatcttcgagaccatcgtgaacaacaagctgttcttcaacgtgagcatcatcctgttcctgaacaagatggacctgctggtggagaaggtgaagaccgtgagcatcaagaagcacttccccgacttcagaggcgacccccacagactggaggacgtgcagagatacctggtgcagtgcttcgacagaaagagaagaaacagaagcaagcccctgttccaccacttcaccaccgccatcgacaccgagaacgtgagattcgtgttccacgccgtgaaggacaccatcctgcaggagaacctgaaggacatcatgctgcagtag

SEQ ID NO: 83833 - DNA, 702 bp, Artificial Sequence
  Description of Artificial Sequence: Synthetic coding sequence
atgatctaccccctgatcgtgctgcccctgtgcgccagctggcactggggcctgatcagaaagggcatcgtgctgttctggggcgagagcgtgaagtacttcctggacaacctggacagaatcggccagctgaactacttccccagcaagcaggacatcctgctggccagaaaggccaccaagggcatcgtggagcacgacttcgtgatcaagaagatccccttcaagatggtggacgtgggcggccagagaagccagagacagaagtggttccagtgcttcgacggcatcaccagcatcctgttcatggtgagcagcagcgagtacgaccaggtgctgatggaggacagaagaaccaacagactggtggagagcatgaacatcttcgagaccatcgtgaacaacaagctgttcttcaacgtgagcatcatcctgttcctgaacaagatggacctgctggtggagaaggtgaagaccgtgagcatcaagaagcacttccccgacttcagaggcgacccccacagactggaggacgtgcagagatacctggtgcagtgcttcgacagaaagagaagaaacagaagcaagcccctgttccaccacttcaccaccgccatcgacaccgagaacgtgagattcgtgttccacgccgtgaaggacaccatcctgcaggagaacctgaaggacatcatgctgcagtag

SEQ ID NO: 83834 - DNA, 867 bp, Artificial Sequence
  Description of Artificial Sequence: Synthetic coding sequence
atgagaatcatccacggcagagagttcgaccagaaggccctgctggagttcagagacaccatcttcgacaacatcctgaagggcagcagagtgctggtggacgccagagacaagctgggcatcccctggcagtacagcgagaacgagaagcacggcatgttcctgatggccttcgagaacaaggccggcctgcccgtggagcccgccaccttccagctgtacgtgcccgccctgagcgccctgtggagagacagcggcatcagagaggccttcagcagaagaagcgagttccagctgaactacttccccagcaagcaggacatcctgctggccagaaaggccaccaagggcatcgtggagcacgacttcgtgatcaagaagatccccttcaagatggtggacgtgggcggccagagaagccagagacagaagtggttccagtgcttcgacggcatcaccagcatcctgttcatggtgagcagcagcgagtacgaccaggtgctgatggaggacagaagaaccaacagactggtggagagcatgaacatcttcgagaccatcgtgaacaacaagctgttcttcaacgtgagcatcatcctgttcctgaacaagatggacctgctggtggagaaggtgaagaccgtgagcatcaagaagcacttccccgacttcagaggcgacccccacagactggaggacgtgcagagatacctggtgcagtgcttcgacagaaagagaagaaacagaagcaagcccctgttccaccacttcaccaccgccatcgacaccgagaacgtgagattcgtgttccacgccgtgaaggacaccatcctgcaggagaacctgaaggacatcatgctgcagtag

SEQ ID NO: 83835 - DNA, 1080 bp, Artificial Sequence
  Description of Artificial Sequence: Synthetic coding sequence
atgaccctggagagcatgatggcctgctgcctgagcgacgaggtgaaggagagcaagagaatcaacgccgagatcgagaagcagctgagaagagacaagagagacgccagaagagagctgaagctgctgctgctgggcaccggcgagagcggcaagagcaccttcatcaagcagatgagaatcatccacggcgccggctacagcgaggaggacaagagaggcttcaccaagctggtgtaccagaacatcttcaccgccatgcaggccatgatcagagccatggagaccctgaagatcctgtacaagtacgagcagaacaaggccaacgccctgctgatcagagaggtggacgtggagaaggtgaccaccttcgagcaccagtacgtgagcgccatcaagaccctgtgggaggaccccggcatccaggagtgctacgacagaagaagagagtaccagctgagcgacagcgccaagtactacctgaccgacgtggacagaatcgccaccctgggctacctgcccacccagcaggacgtgctgagagtgagagtgcccaccaccggcatcatcgagtaccccttcgacctggagaacatcatcttcagaatggtggacgtgggcggccagagaagcgagagaagaaagtggatccactgcttcgagaacgtgaccagcatcatgttcctggtggccctgagcgagtacgaccaggtgctggtggagagcgacaacgagaacagaatggaggagagcaaggccctgttcagaaccatcatcacctacccctggttccagaacagcagcgtgatcctgttcctgaacaagaaggacctgctggaggacaagatcctgtacagccacctggtggactacttccccgagttcgacggcccccagagagacgcccaggccgccagagagttcatcctgaagatgttcgtggacctgaaccccgacagcgacaagatcatctacagccacttcacctgcgccaccgacaccgagaacatcagattcgtgttcgccgccgtgaaggacaccatcctgcagctgaacctgaaggagtacaacctggtgtag

SEQ ID NO: 83836 - DNA, 1059 bp, Artificial Sequence
  Description of Artificial Sequence: Synthetic coding sequence
atggccgacttcctgcccagcagaagcgtgctgagcgtgtgcttccccggctgcctgctgaccagcggcgaggccgagcagcagagaaagagcaaggagatcgacaagtgcctgagcagagagaagacctacgtgaagagactggtgaagatcctgctgctgggcgccggcgagagcggcaagagcacctacagcaacgtgatcaagggcatgagagtgctggtggacgccagagagaagctgcacatcccctggggcgacaacagcaaccagcagcacggcgacaagatgatgagcttcgacaccagagcccccatggccgcccagggcatggtggagaccagagtgttcctgcagtacctgcccgccatcagagccctgtgggccgacagcggcatccagaacgcctacgacagaagaagagagttccagctgggcgagagcgtgaagtacttcctggacaacctggacaagctgggcgagcccgactacatccccagccagcaggacatcctgctggccagaagacccaccaagggcatccacgagtacgacttcgagatcaagaacgtgcccttcaagatggtggacgtgggcggccagagaagcgagagaaagagatggttcgagtgcttcgacagcgtgaccagcatcctgttcctggtgagcagcagcgagttcgaccaggtgctgatggaggacagactgaccaacagactgaccgagagcctgaacatcttcgagaccatcgtgaacaacagagtgttcagcaacgtgagcatcatcctgttcctgaacaagaccgacctgctggaggagaaggtgcagatcgtgagcatcaaggactacttcctggagttcgagggcgacccccactgcctgagagacgtgcagaagttcctggtggagtgcttcagaaacaagagaagagaccagcagcagaagcccctgtaccaccacttcaccaccgccatcaacaccgagaacatcagactggtgttcagagacgtgaaggacaccatcctgcacgacaacctgaagcagctgatgctgcagtag

SEQ ID NO: 83837 - DNA, 1134 bp, Artificial Sequence
  Description of Artificial Sequence: Synthetic coding sequence
atggccgacttcctgcccagcagaagcgtgctgagcgtgtgcttccccggctgcctgctgaccagcggcgaggccgagcagcagagaaagagcaaggagatcgacaagtgcctgagcagagagaagacctacgtgaagagactggtgaagatcctgctgctgggcgccggcgagagcggcaagagcaccttcctgaagcagatgagaatcatccacggccaggacttcgaccagagagccagagaggagttcagacccaccatctacagcaacgtgatcaagggcatgagagtgctggtggacgccagagagaagctgcacatcccctggggcgacaacagcaaccagcagcacggcgacaagatgatgagcttcgacaccagagcccccatggccgcccagggcatggtggagaccagagtgttcctgcagtacctgcccgccatcagagccctgtgggccgacagcggcatccagaacgcctacgacagaagaagagagttccagctgggcgagagcgtgaagtacttcctggacaacctggacaagctgggcgagcccgactacatccccagccagcaggacatcctgctggccagaagacccaccaagggcatccacgagtacgacttcgagatcaagaacgtgcccttcaagatggtggacgtgggcggccagagaagcgagagaaagagatggttcgagtgcttcgacagcgtgaccagcatcctgttcctggtgagcagcagcgagttcgaccaggtgctgatggaggacagactgaccaacagactgaccgagagcctgaacatcttcgagaccatcgtgaacaacagagtgttcagcaacgtgagcatcatcctgttcctgaacaagaccgacctgctggaggagaaggtgcagatcgtgagcatcaaggactacttcctggagttcgagggcgacccccactgcctgagagacgtgcagaagttcctggtggagtgcttcagaaacaagagaagagaccagcagcagaagcccctgtaccaccacttcaccaccgccatcaacaccgagaacatcagactggtgttcagagacgtgaaggacaccatcctgcacgacaacctgaagcagctgatgctgcagtag

SEQ ID NO: 83838 - DNA, 849 bp, Artificial Sequence
  Description of Artificial Sequence: Synthetic coding sequence
atgagagtgctggtggacgccagagagaagctgcacatcccctggggcgacaacagcaaccagcagcacggcgacaagatgatgagcttcgacaccagagcccccatggccgcccagggcatggtggagaccagagtgttcctgcagtacctgcccgccatcagagccctgtgggccgacagcggcatccagaacgcctacgacagaagaagagagttccagctgggcgagagcgtgaagtacttcctggacaacctggacaagctgggcgagcccgactacatccccagccagcaggacatcctgctggccagaagacccaccaagggcatccacgagtacgacttcgagatcaagaacgtgcccttcaagatggtggacgtgggcggccagagaagcgagagaaagagatggttcgagtgcttcgacagcgtgaccagcatcctgttcctggtgagcagcagcgagttcgaccaggtgctgatggaggacagactgaccaacagactgaccgagagcctgaacatcttcgagaccatcgtgaacaacagagtgttcagcaacgtgagcatcatcctgttcctgaacaagaccgacctgctggaggagaaggtgcagatcgtgagcatcaaggactacttcctggagttcgagggcgacccccactgcctgagagacgtgcagaagttcctggtggagtgcttcagaaacaagagaagagaccagcagcagaagcccctgtaccaccacttcaccaccgccatcaacaccgagaacatcagactggtgttcagagacgtgaaggacaccatcctgcacgacaacctgaagcagctgatgctgcagtag

SEQ ID NO: 83839 - DNA, 1068 bp, Artificial Sequence
  Description of Artificial Sequence: Synthetic coding sequence
atggccggctgctgctgcctgagcgccgaggagaaggagagccagagaatcagcgccgagatcgagagacagctgagaagagacaagaaggacgccagaagagagctgaagctgctgctgctgggcaccggcgagagcggcaagagcaccttcatcaagcagatgagaatcatccacggcagcggctacagcgacgaggacagaaagggcttcaccaagctggtgtaccagaacatcttcaccgccatgcaggccatgatcagagccatggacaccctgagaatccagtacgtgtgcgagcagaacaaggagaacgcccagatcatcagagaggtggaggtggacaaggtgagcatgctgagcagagagcaggtggaggccatcaagcagctgtggcaggaccccggcatccaggagtgctacgacagaagaagagagtaccagctgagcgacagcgccaagtactacctgaccgacatcgacagaatcgccacccccagcttcgtgcccacccagcaggacgtgctgagagtgagagtgcccaccaccggcatcatcgagtaccccttcgacctggagaacatcatcttcagaatggtggacgtgggcggccagagaagcgagagaagaaagtggatccactgcttcgagagcgtgaccagcatcatcttcctggtggccctgagcgagtacgaccaggtgctggccgagtgcgacaacgagaacagaatggaggagagcaaggccctgttcaagaccatcatcacctacccctggttcctgaacagcagcgtgatcctgttcctgaacaagaaggacctgctggaggagaagatcatgtacagccacctgatcagctacttccccgagtacaccggccccaagcaggacgtgagagccgccagagacttcatcctgaagctgtaccaggaccagaaccccgacaaggagaaggtgatctacagccacttcacctgcgccaccgacaccgacaacatcagattcgtgttcgccgccgtgaaggacaccatcctgcagctgaacctgagagagttcaacctggtgtag

SEQ ID NO: 83840 - DNA, 1125 bp, Artificial Sequence
  Description of Artificial Sequence: Synthetic coding sequence
atggccagaagcctgacctggagatgctgcccctggtgcctgaccgaggacgagaaggccgccgccagagtggaccaggagatcaacagaatcctgctggagcagaagaagcaggacagaggcgagctgaagctgctgctgctgggccccggcgagagcggcaagagcaccttcatcaagcagatgagaatcatccacggcgccggctacagcgaggaggagagaaagggcttcagacccctggtgtaccagaacatcttcgtgagcatgagagccatgatcgaggccatggagagactgcagatccccttcagcagacccgagagcaagcaccacgccagcctggtgatgagccaggacccctacaaggtgaccaccttcgagaagagatacgccgccgccatgcagtggctgtggagagacgccggcatcagagcctactacgagagaagaagagagttccacctgctggacagcgccgtgtactacctgagccacctggagagaatcaccgaggagggctacgtgcccaccgcccaggacgtgctgagaagcagaatgcccaccaccggcatcaacgagtactgcttcagcgtgcagaagaccaacctgagaatcgtggacgtgggcggccagaagagcgagagaaagaagtggatccactgcttcgagaacgtgatcgccctgatctacctggccagcctgagcgagtacgaccagtgcctggaggagaacaaccaggagaacagaatgaaggagagcctggccctgttcggcaccatcctggagctgccctggttcaagagcaccagcgtgatcctgttcctgaacaagaccgacatcctggaggagaagatccccaccagccacctggccacctacttccccagcttccagggccccaagcaggacgccgaggccgccaagagattcatcctggacatgtacaccagaatgtacaccggctgcgtggacggccccgagggcagcaagaagggcgccagaagcagaagactgttcagccactacacctgcgccaccgacacccagaacatcagaaaggtgttcaaggacgtgagagacagcgtgctggccagatacctggacgagatcaacctgctgtag

SEQ ID NO: 83841 - DNA, 1065 bp, Artificial Sequence
  Description of Artificial Sequence: Synthetic coding sequence
atgggctgcaccctgagcgccgaggagagagccgccctggagagaagcaaggccatcgagaagaacctgaaggaggacggcatcagcgccgccaaggacgtgaagctgctgctgctgggcgccggcgagagcggcaagagcaccatcgtgaagcagatgaagatcatccacgaggacggcttcagcggcgaggacgtgaagcagtacaagcccgtggtgtacagcaacaccatccagagcctggccgccatcgtgagagccatggacaccctgggcatcgagtacggcgacaaggagagaaaggccgacgccaagatggtgtgcgacgtggtgagcagaatggaggacaccgagcccttcagcgccgagctgctgagcgccatgatgagactgtggggcgacagcggcatccaggagtgcttcaacagaagcagagagtaccagctgaacgacagcgccaagtactacctggacagcctggacagaatcggcgccgccgactaccagcccaccgagcaggacatcctgagaaccagagtgaagaccaccggcatcgtggagacccacttcaccttcaagaacctgcacttcagactgttcgacgtgggcggccagagaagcgagagaaagaagtggatccactgcttcgaggacgtgaccgccatcatcttctgcgtggccctgagcggctacgaccaggtgctgcacgaggacgagaccaccaacagaatgcacgagagcctgatgctgttcgacagcatctgcaacaacaagttcttcatcgacaccagcatcatcctgttcctgaacaagaaggacctgttcggcgagaagatcaagaagagccccctgaccatctgcttccccgagtacaccggccccaacacctacgaggacgccgccgcctacatccaggcccagttcgagagcaagaacagaagccccaacaaggagatctactgccacatgacctgcgccaccgacaccaacaacatccaggtggtgttcgacgccgtgaccgacatcatcatcgccaacaacctgagaggctgcggcctgtactag

SEQ ID NO: 83842 - DNA, 1065 bp, Artificial Sequence
  Description of Artificial Sequence: Synthetic coding sequence
atgggctgcaccctgagcgccgaggagagagccgccctggagagaagcaaggccatcgagaagaacctgaaggaggacggcatcagcgccgccaaggacgtgaagctgctgctgctgggcgccggcgagagcggcaagagcaccatcgtgaagcagatgaagatcatccacgaggacggcttcagcggcgaggacgtgaagcagtacaagcccgtggtgtacagcaacaccatccagagcctggccgccatcgtgagagccatggacaccctgggcatcgagtacggcgacaaggagagaaaggccgacgccaagatggtgtgcgacgtggtgagcagaatggaggacaccgagcccttcagcgccgagctgctgagcgccatgatgagactgtggggcgacagcggcatccaggagtgcttcaacagaagcagagagtaccagctgaacgacagcgccaagtactacctggacagcctggacagaatcggcgccgccgactaccagcccaccgagcaggacatcctgagaaccagagtgaagaccaccggcatcgtggagacccacttcaccttcaagaacctgcacttcagactgttcgacgtgggcggccagagaagcgagagaaagaagtggatccactgcttcgaggacgtgaccgccatcatcttctgcgtggccctgagcggctacgaccaggtgctgcacgaggacgagaccaccaacagaatgcacgagagcctgaagctgttcgacagcatctgcaacaacaagtggttcaccgacaccagcatcatcctgttcctgaacaagaaggacatcttcgaggagaagatcaagaagagccccctgaccatctgcttccccgagtacaccggccccagcgccttcaccgaggccgtggcctacatccaggcccagtacgagagcaagaacaagagcgcccacaaggagatctacacccacgtgacctgcgccaccgacaccaacaacatccagttcgtgttcgacgccgtgaccgacgtgatcatcgccaagaacctgagaggctgcggcctgtactag

SEQ ID NO: 83843 - DNA, 1146 bp, Artificial Sequence
  Description of Artificial Sequence: Synthetic coding sequence
atgggctgcctgggcggcaacagcaagaccaccgaggaccagggcgtggacgagaaggagagaagagaggccaacaagaagatcgagaagcagctgcagaaggagagactggcctacaaggccacccacagactgctgctgctgggcgccggcgagagcggcaagagcaccatcgtgaagcagatgagaatcctgcacgtgaacggcttcaaccccgaggagaagaagcagaagatcctggacatcagaaagaacgtgaaggacgccatcgtgaccatcgtgagcgccatgagcaccatcatcccccccgtgcccctggccaaccccgagaaccagttcagaagcgactacatcaagagcatcgcccccatcaccgacttcgagtacagccaggagttcttcgaccacgtgaagaagctgtgggacgacgagggcgtgaaggcctgcttcgagagaagcaacgagtaccagctgatcgactgcgcccagtacttcctggagagaatcgacagcgtgagcctggtggactacacccccaccgaccaggacctgctgagatgcagagtgctgaccagcggcatcttcgagaccagattccaggtggacaaggtgaacttccacatgttcgacgtgggcggccagagagacgagagaagaaagtggatccagtgcttcaacgacgtgaccgccatcatctacgtggccgcctgcagcagctacaacatggtgatcagagaggacaacaacaccaacagactgagagagagcctggacctgttcgagagcatctggaacaacagatggctgagaaccatcagcatcatcctgttcctgaacaagcaggacatgctggccgagaaggtgctggccggcaagagcaagatcgaggactacttccccgagtacgccaactacaccgtgcccgaggacgccacccccgacgccggcgaggaccccaaggtgaccagagccaagttcttcatcagagacctgttcctgagaatcagcaccgccaccggcgacggcaagcactactgctacccccacttcacctgcgccgtggacaccgagaacatcagaagagtgttcaacgactgcagagacatcatccagagaatgcacctgaagcagtacgagctgctgtag

SEQ ID NO: 83844 - DNA, 1377 bp, Artificial Sequence
  Description of Artificial Sequence: Synthetic coding sequence
atgggcctgtgctacagcctgagacccctgctgttcggcggccccggcgacgacccctgcgccgccagcgagccccccgtggaggacgcccagcccgcccccgcccccgccctggcccccgtgagagccgccgccagagacaccgccagaaccctgctgcccagaggcggcgagggcagccccgcctgcgccagacccaaggccgacaagcccaaggagaagagacagagaaccgagcagctgagcgccgaggagagagaggccgccaaggagagagaggccgtgaaggaggccagaaaggtgagcagaggcatcgacagaatgctgagagaccagaagagagacctgcagcagacccacagactgctgctgctgggcgccggcgagagcggcaagagcaccatcgtgaagcagatgagaatcctgcacgtgaacggcttcaaccccgaggagaagaagcagaagatcctggacatcagaaagaacgtgaaggacgccatcgtgaccatcgtgagcgccatgagcaccatcatcccccccgtgcccctggccaaccccgagaaccagttcagaagcgactacatcaagagcatcgcccccatcaccgacttcgagtacagccaggagttcttcgaccacgtgaagaagctgtgggacgacgagggcgtgaaggcctgcttcgagagaagcaacgagtaccagctgatcgactgcgcccagtacttcctggagagaatcgacagcgtgagcctggtggactacacccccaccgaccaggacctgctgagatgcagagtgctgaccagcggcatcttcgagaccagattccaggtggacaaggtgaacttccacatgttcgacgtgggcggccagagagacgagagaagaaagtggatccagtgcttcaacgacgtgaccgccatcatctacgtggccgcctgcagcagctacaacatggtgatcagagaggacaacaacaccaacagactgagagagagcctggacctgttcgagagcatctggaacaacagatggctgagaaccatcagcatcatcctgttcctgaacaagcaggacatgctggccgagaaggtgctggccggcaagagcaagatcgaggactacttccccgagtacgccaactacaccgtgcccgaggacgccacccccgacgccggcgaggaccccaaggtgaccagagccaagttcttcatcagagacctgttcctgagaatcagcaccgccaccggcgacggcaagcactactgctacccccacttcacctgcgccgtggacaccgagaacatcagaagagtgttcaacgactgcagagacatcatccagagaatgcacctgaagcagtacgagctgctgtag

SEQ ID NO: 83845 - DNA, 1146 bp, Artificial Sequence; identical to SEQ ID NO: 83843
  Description of Artificial Sequence: Synthetic coding sequence

SEQ ID NO: 83846 - DNA, 1146 bp, Artificial Sequence; identical to SEQ ID NO: 83843
  Description of Artificial Sequence: Synthetic coding sequence

SEQ ID NO: 83847 - DNA, 525 bp, Artificial Sequence
  Description of Artificial Sequence: Synthetic coding sequence
atgttcgacgtgggcggccagagagacgagagaagaaagtggatccagtgcttcaacgacgtgaccgccatcatctacgtggccgcctgcagcagctacaacatggtgatcagagaggacaacaacaccaacagactgagagagagcctggacctgttcgagagcatctggaacaacagatggctgagaaccatcagcatcatcctgttcctgaacaagcaggacatgctggccgagaaggtgctggccggcaagagcaagatcgaggactacttccccgagtacgccaactacaccgtgcccgaggacgccacccccgacgccggcgaggaccccaaggtgaccagagccaagttcttcatcagagacctgttcctgagaatcagcaccgccaccggcgacggcaagcactactgctacccccacttcacctgcgccgtggacaccgagaacatcagaagagtgttcaacgactgcagagacatcatccagagaatgcacctgaagcagtacgagctgctgtag

SEQ ID NO: 83848 - DNA, 963 bp, Artificial Sequence
  Description of Artificial Sequence: Synthetic coding sequence
atgagaatcctgcacgtgaacggcttcaaccccgaggagaagaagcagaagatcctggacatcagaaagaacgtgaaggacgccatcgtgaccatcgtgagcgccatgagcaccatcatcccccccgtgcccctggccaaccccgagaaccagttcagaagcgactacatcaagagcatcgcccccatcaccgacttcgagtacagccaggagttcttcgaccacgtgaagaagctgtgggacgacgagggcgtgaaggcctgcttcgagagaagcaacgagtaccagctgatcgactgcgcccagtacttcctggagagaatcgacagcgtgagcctggtggactacacccccaccgaccaggacctgctgagatgcagagtgctgaccagcggcatcttcgagaccagattccaggtggacaaggtgaacttccacatgttcgacgtgggcggccagagagacgagagaagaaagtggatccagtgcttcaacgacgtgaccgccatcatctacgtggccgcctgcagcagctacaacatggtgatcagagaggacaacaacaccaacagactgagagagagcctggacctgttcgagagcatctggaacaacagatggctgagaaccatcagcatcatcctgttcctgaacaagcaggacatgctggccgagaaggtgctggccggcaagagcaagatcgaggactacttccccgagtacgccaactacaccgtgcccgaggacgccacccccgacgccggcgaggaccccaaggtgaccagagccaagttcttcatcagagacctgttcctgagaatcagcaccgccaccggcgacggcaagcactactgctacccccacttcacctgcgccgtggacaccgagaacatcagaagagtgttcaacgactgcagagacatcatccagagaatgcacctgaagcagtacgagctgctgtag

SEQ ID NO: 83849 - DNA, 1065 bp, Artificial Sequence
  Description of Artificial Sequence: Synthetic coding sequence
atgggctgcaccctgagcgccgaggacaaggccgccgtggagagaagcaagatgatcgacagaaacctgagagaggacggcgagaaggccgccagagaggtgaagctgctgctgctgggcgccggcgagagcggcaagagcaccatcgtgaagcagatgaagatcatccacgaggccggctacagcgaggaggagtgcaagcagtacaaggccgtggtgtacagcaacaccatccagagcatcatcgccatcatcagagccatgggcagactgaagatcgacttcggcgacagcgccagagccgacgacgccagacagctgttcgtgctggccggcgccgccgaggagggcttcatgaccgccgagctggccggcgtgatcaagagactgtggaaggacagcggcgtgcaggcctgcttcaacagaagcagagagtaccagctgaacgacagcgccgcctactacctgaacgacctggacagaatcgcccagcccaactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgactacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcaagaagagccccctgaccatctgctaccccgagtacgccggcagcaacacctacgaggaggccgccgcctacatccagtgccagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83850 - DNA, 72 bp, Artificial Sequence
  Description of Artificial Sequence: Synthetic coding sequence
atgggctgcaccctgagcgccgaggacaaggccgccgtggagagaagcaagatgatcgacagaaacctgtag

SEQ ID NO: 83851 - DNA, 909 bp, Artificial Sequence
  Description of Artificial Sequence: Synthetic coding sequence
atgaagatcatccacgaggccggctacagcgaggaggagtgcaagcagtacaaggccgtggtgtacagcaacaccatccagagcatcatcgccatcatcagagccatgggcagactgaagatcgacttcggcgacagcgccagagccgacgacgccagacagctgttcgtgctggccggcgccgccgaggagggcttcatgaccgccgagctggccggcgtgatcaagagactgtggaaggacagcggcgtgcaggcctgcttcaacagaagcagagagtaccagctgaacgacagcgccgcctactacctgaacgacctggacagaatcgcccagcccaactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgactacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcaagaagagccccctgaccatctgctaccccgagtacgccggcagcaacacctacgaggaggccgccgcctacatccagtgccagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83852 - DNA, 1020 bp, Artificial Sequence
  Description of Artificial Sequence: Synthetic coding sequence
atggagtacgccggccacctgcccgccagcagcgcccagggcaccatcctggcctgcaccagctgcaccggcgccggcgagagcggcaagagcaccatcgtgaagcagatgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83853 - DNA, 1068 bp, Artificial Sequence
  Description of Artificial Sequence: Synthetic coding sequence
atgggctgcaccgtgagcgccgaggacaaggccgccgccgagagaagcaagatgatcgacaagaacctgagagaggacggcgagaaggccgccagagaggtgaagctgctgctgctgggcgccggcgagagcggcaagagcaccatcgtgaagcagatgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83854 - DNA, 1020 bp, Artificial Sequence
  Description of Artificial Sequence: Synthetic coding sequence
atgaccgagggcgtgaagaccctgggctggaccaagcagaagggcggctgccactggggcagaagcgagggcgccggcgagagcggcaagagcaccatcgtgaagcagatgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83855 - DNA, 912 bp, Artificial Sequence
  Description of Artificial Sequence: Synthetic coding sequence
atgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83856 - DNA, 957 bp, Artificial Sequence
  Description of Artificial Sequence: Synthetic coding sequence
atgagaggcgccggcgagagcggcaagagcaccatcgtgaagcagatgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83857 - DNA, 825 bp, Artificial Sequence
  Description of Artificial Sequence: Synthetic coding sequence
atggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagaacgtgcagttcgtgttcgacgccgtgaccgacgtgatcatcaagaacaacctgaaggactgcggcctgttctag

SEQ ID NO: 83858 - DNA, 1086 bp, Artificial Sequence
  Description of Artificial Sequence: Synthetic coding sequence
atgggctgcaccgtgagcgccgaggacaaggccgccgccgagagaagcaagatgatcgacaagaacctgagagaggacggcgagaaggccgccagagaggtgaagctgctgctgctgggcgccggcgagagcggcaagagcaccatcgtgaagcagatgaagatcatccacgaggacggctacagcgaggaggagtgcagacagtacagagccgtggtgtacagcaacaccatccagagcatcatggccatcgtgaaggccatgggcaacctgcagatcgacttcgccgaccccagcagagccgacgacgccagacagctgttcgccctgagctgcaccgccgaggagcagggcgtgctgcccgacgacctgagcggcgtgatcagaagactgtgggccgaccacggcgtgcaggcctgcttcggcagaagcagagagtaccagctgaacgacagcgccgcctactacctgaacgacctggagagaatcgcccagagcgactacatccccacccagcaggacgtgctgagaaccagagtgaagaccaccggcatcgtggagacccacttcaccttcaaggacctgcacttcaagatgttcgacgtgggcggccagagaagcgagagaaagaagtggatccactgcttcgagggcgtgaccgccatcatcttctgcgtggccctgagcgcctacgacctggtgctggccgaggacgaggagatgaacagaatgcacgagagcatgaagctgttcgacagcatctgcaacaacaagtggttcaccgacaccagcatcatcctgttcctgaacaagaaggacctgttcgaggagaagatcacccacagccccctgaccatctgcttccccgagtacaccggcgccaacaagtacgacgaggccgccagctacatccagagcaagttcgaggacctgaacaagagaaaggacaccaaggagatctacacccacttcacctgcgccaccgacaccaagagcagaaagctgttcagagagaactacctgaagctgagcgaccccgaccagcagcccccccccgcccccctgcccagcgacagcgtgccctag

SEQ ID NO: 83859 - DNA, 1065 bp, Artificial Sequence
  Description of Artificial Sequence: Synthetic coding sequence
atgggctgcaccctgagcgccgaggacaaggccgccgtggagagaagcaagatgatcgacagaaacctgagagaggacggcgagaaggccgccaaggaggtgaagctgctgctgctgggcgccggcgagagcggcaagagcaccatcgtgaagcagatgaagatcatccacgaggacggctacagcgaggacgagtgcaagcagtacaaggtggtggtgtacagcaacaccatccagagcatcatcgccatcatcagagccatgggcagactgaagatcgacttcggcgaggccgccagagccgacgacgccagacagctgttcgtgctggccggcagcgccgaggagggcgtgatgacccccgagctggccggcgtgatcaagagactgtggagagacggcggcgtgcaggcctgcttcagcagaagcagagagtaccagctgaacgacagcgccagctactacctgaacgacctggacagaatcagccagagcaactacatccccacccagcaggacgtgctgagaaccagagtgaagaccaccggcatcgtggagacccacttcaccttcaaggacctgtacttcaagatgttcgacgtgggcggccagagaagcgagagaaagaagtggatccactgcttcgagggcgtgaccgccatcatcttctgcgtggccctgagcgactacgacctggtgctggccgaggacgaggagatgaacagaatgcacgagagcatgaagctgttcgacagcatctgcaacaacaagtggttcaccgagaccagcatcatcctgttcctgaacaagaaggacctgttcgaggagaagatcaagagaagccccctgaccatctgctaccccgagtacaccggcagcaacacctacgaggaggccgccgcctacatccagtgccagttcgaggacctgaacagaagaaaggacaccaaggagatctacacccacttcacctgcgccaccgacaccaagaacgtgcagttcgtgttcgacgccgtgaccgacgtgatcatcaagaacaacctgaaggagtgcggcctgtactag

SEQ ID NO: 83860 - DNA, 2652 bp, Artificial Sequence
  Description of Artificial Sequence: Synthetic coding sequence
atggccgagaacagcgtgctgaccagcaccaccggcagaaccagcctggccgacagcagcatcttcgacagcaaggtgaccgagatcagcaaggagaacctgctgatcggcagcaccagctacgtggaggaggagatgccccagatcgagaccagagtgatcctggtgcaggaggccggcaagcaggaggagctgatcaaggccctgaaggacatcaaggtgggcttcgtgaagatggagagcgtggaggagttcgagggcctggacagccccgagttcgagaacgtgttcgtggtgaccgacttccaggacagcgtgttcaacgacctgtacaaggccgactgcagagtgatcggcccccccgtggtgctgaactgcagccagaagggcgagcccctgcccttcagctgcagacccctgtactgcaccagcatgatgaacctggtgctgtgcttcaccggcttcagaaagaaggaggagctggtgagactggtgaccctggtgcaccacatgggcggcgtgatcagaaaggacttcaacagcaaggtgacccacctggtggccaactgcacccagggcgagaagttcagagtggccgtgagcctgggcacccccatcatgaagcccgagtggatctacaaggcctgggagagaagaaacgagcaggacttctacgccgccgtggacgacttcagaaacgagttcaaggtgccccccttccaggactgcatcctgagcttcctgggcttcagcgacgaggagaagaccaacatggaggagatgaccgagatgcagggcggcaagtacctgcccctgggcgacgagagatgcacccacctggtggtggaggagaacatcgtgaaggacctgcccttcgagcccagcaagaagctgtacgtggtgaagcaggagtggttctggggcagcatccagatggacgccagagccggcgagaccatgtacctgtacgagaaggccaacacccccgagctgaagaagagcgtgagcatgctgagcctgaacacccccaacagcaacagaaagagaagaagactgaaggagaccctggcccagctgagcagagagaccgacgtgagccccttcccccccagaaagagacccagcgccgagcacagcctgagcatcggcagcctgctggacatcagcaacacccccgagagcagcatcaactacggcgacacccccaagagctgcaccaagagcagcaagagcagcacccccgtgcccagcaagcagagcgccagatggcaggtggccaaggagctgtaccagaccgagagcaactacgtgaacatcctggccaccatcatccagctgttccaggtgcccctggaggaggagggccagagaggcggccccatcctggcccccgaggagatcaagaccatcttcggcagcatccccgacatcttcgacgtgcacaccaagatcaaggacgacctggaggacctgatcgtgaactgggacgagagcaagagcatcggcgacatcttcctgaagtacagcaaggacctggtgaagacctacccccccttcgtgaacttcttcgagatgagcaaggagaccatcatcaagtgcgagaagcagaagcccagattccacgccttcctgaagatcaaccaggccaagcccgagtgcggcagacagagcctggtggagctgctgatcagacccgtgcagagactgcccagcgtggccctgctgctgaacgacctgaagaagcacaccgccgacgagaaccccgacaagagcaccctggagaaggccatcggcagcctgaaggaggtgatgacccacatcaacgaggacaagagaaagaccgaggcccagaagcagatcttcgacgtggtgtacgaggtggacggctgccccgccaacctgctgagcagccacagaagcctggtgcagagagtggagaccatcagcctgggcgagcacccctgcgacagaggcgagcaggtgaccctgttcctgttcaacgactgcctggagatcgccagaaagagacacaaggtgatcggcaccttcagaagcccccacggccagaccagaccccccgccagcctgaagcacatccacctgatgcccctgagccagatcaagaaggtgctggacatcagagagaccgaggactgccacaacgccttcgccctgctggtgagaccccccaccgagcaggccaacgtgctgctgagcttccagatgaccagcgacgagctgcccaaggagaactggctgaagatgctgtgcagacacgtggccaacaccatctgcaaggccgacgccgagaacctgatctacaccgccgaccccgagagcttcgaggtgaacaccaaggacatggacagcaccctgagcagagccagcagagccatcaagaagaccagcaagaaggtgaccagagccttcagcttcagcaagacccccaagagagccctgagaagagccctgatgaccagccacggcagcgtggagggcagaagccccagcagcaacgacaagcacgtgatgagcagactgagcagcaccagcagcctggccggcatccccagccccagcctggtgagcctgcccagcttcttcgagagaagaagccacaccctgagcagaagcaccacccacctgatctag

SEQ ID NO: 83861 - DNA, 1053 bp, Artificial Sequence
  Description of Artificial Sequence: Synthetic coding sequence
atgggcgccggcgccagcgccgaggagaagcacagcagagagctggagaagaagctgaaggaggacgccgagaaggacgccagaaccgtgaagctgctgctgctgggcgccggcgagagcggcaagagcaccatcgtgaagcagatgaagatcatccaccaggacggctacagcctggaggagtgcctggagttcatcgccatcatctacggcaacaccctgcagagcatcctggccatcgtgagagccatgaccaccctgaacatccagtacggcgacagcgccagacaggacgacgccagaaagctgatgcacatggccgacaccatcgaggagggcaccatgcccaaggagatgagcgacatcatccagagactgtggaaggacagcggcatccaggcctgcttcgagagagccagcgagtaccagctgaacgacagcgccggctactacctgagcgacctggagagactggtgacccccggctacgtgcccaccgagcaggacgtgctgagaagcagagtgaagaccaccggcatcatcgagacccagttcagcttcaaggacctgaacttcagaatgttcgacgtgggcggccagagaagcgagagaaagaagtggatccactgcttcgagggcgtgacctgcatcatcttcatcgccgccctgagcgcctacgacatggtgctggtggaggacgacgaggtgaacagaatgcacgagagcctgcacctgttcaacagcatctgcaaccacagatacttcgccaccaccagcatcgtgctgttcctgaacaagaaggacgtgttcttcgagaagatcaagaaggcccacctgagcatctgcttccccgactacgacggccccaacacctacgaggacgccggcaactacatcaaggtgcagttcctggagctgaacatgagaagagacgtgaaggagatctacagccacatgacctgcgccaccgacacccagaacgtgaagttcgtgttcgacgccgtgaccgacatcatcatcaaggagaacctgaaggactgcggcctgttctag

SEQ ID NO: 83862 - DNA, 1065 bp, Artificial Sequence
  Description of Artificial Sequence: Synthetic coding sequence
atgggcagcggcgccagcgccgaggacaaggagctggccaagagaagcaaggagctggagaagaagctgcaggaggacgccgacaaggaggccaagaccgtgaagctgctgctgctgggcgccggcgagagcggcaagagcaccatcgtgaagcagatgaagatcatccaccaggacggctacagccccgaggagtgcctggagttcaaggccatcatctacggcaacgtgctgcagagcatcctggccatcatcagagccatgaccaccctgggcatcgactacgccgagcccagctgcgccgacgacggcagacagctgaacaacctggccgacagcatcgaggagggcaccatgccccccgagctggtggaggtgatcagaagactgtggaaggacggcggcgtgcaggcctgcttcgagagagccgccgagtaccagctgaacgacagcgccagctactacctgaaccagctggagagaatcaccgaccccgagtacctgcccagcgagcaggacgtgctgagaagcagagtgaagaccaccggcatcatcgagaccaagttcagcgtgaaggacctgaacttcagaatgttcgacgtgggcggccagagaagcgagagaaagaagtggatccactgcttcgagggcgtgacctgcatcatcttctgcgccgccctgagcgcctacgacatggtgctggtggaggacgacgaggtgaacagaatgcacgagagcctgcacctgttcaacagcatctgcaaccacaagttcttcgccgccaccagcatcgtgctgttcctgaacaagaaggacctgttcgaggagaagatcaagaaggtgcacctgagcatctgcttccccgagtacgacggcaacaacagctacgacgacgccggcaactacatcaagagccagttcctggacctgaacatgagaaaggacgtgaaggagatctacagccacatgacctgcgccaccgacacccagaacgtgaagttcgtgttcgacgccgtgaccgacatcatcatcaaggagaacctgaaggactgcggcctgttctag

SEQ ID NO: 83863 - DNA, 1068 bp, Artificial Sequence
  Description of Artificial Sequence: Synthetic coding sequence
atgggctgcagacagagcagcgaggagaaggaggccgccagaagaagcagaagaatcgacagacacctgagaagcgagagccagagacagagaagagagatcaagctgctgctgctgggcaccagcaacagcggcaagagcaccatcgtgaagcagatgaagatcatccacagcggcggcttcaacctggaggcctgcaaggagtacaagcccctgatcatctacaacgccatcgacagcctgaccagaatcatcagagccctggccgccctgagaatcgacttccacaaccccgacagagcctacgacgccgtgcagctgttcgccctgaccggccccgccgagagcaagggcgagatcacccccgagctgctgggcgtgatgagaagactgtgggccgaccccggcgcccaggcctgcttcagcagaagcagcgagtaccacctggaggacaacgccgcctactacctgaacgacctggagagaatcgccgccgccgactacatccccaccgtggaggacatcctgagaagcagagacatgaccaccggcatcgtggagaacaagttcaccttcaaggagctgaccttcaagatggtggacgtgggcggccagagaagcgagagaaagaagtggatccactgcttcgagggcgtgaccgccatcatcttctgcgtggagctgagcggctacgacctgaagctgtacgaggacaaccagaccagcagaatggccgagagcctgagactgttcgacagcatctgcaacaacaactggttcatcaacaccagcctgatcctgttcctgaacaagaaggacctgctggccgagaagatcagaagaatccccctgaccatctgcttccccgagtacaagggccagaacacctacgaggaggccgccgtgtacatccagagacagttcgaggacctgaacagaaacaaggagaccaaggagatctacagccacttcacctgcgccaccgacaccagcaacatccagttcgtgttcgacgccgtgaccgacgtgatcatccagaacaacctgaagtacatcggcctgtgctag

SEQ ID NO: 83864 - DNA, 912 bp, Artificial Sequence
  Description of Artificial Sequence: Synthetic coding sequence
atgaagatcatccacagcggcggcttcaacctggaggcctgcaaggagtacaagcccctgatcatctacaacgccatcgacagcctgaccagaatcatcagagccctggccgccctgagaatcgacttccacaaccccgacagagcctacgacgccgtgcagctgttcgccctgaccggccccgccgagagcaagggcgagatcacccccgagctgctgggcgtgatgagaagactgtgggccgaccccggcgcccaggcctgcttcagcagaagcagcgagtaccacctggaggacaacgccgcctactacctgaacgacctggagagaatcgccgccgccgactacatccccaccgtggaggacatcctgagaagcagagacatgaccaccggcatcgtggagaacaagttcaccttcaaggagctgaccttcaagatggtggacgtgggcggccagagaagcgagagaaagaagtggatccactgcttcgagggcgtgaccgccatcatcttctgcgtggagctgagcggctacgacctgaagctgtacgaggacaaccagaccagcagaatggccgagagcctgagactgttcgacagcatctgcaacaacaactggttcatcaacaccagcctgatcctgttcctgaacaagaaggacctgctggccgagaagatcagaagaatccccctgaccatctgcttccccgagtacaagggccagaacacctacgaggaggccgccgtgtacatccagagacagttcgaggacctgaacagaaacaaggagaccaaggagatctacagccacttcacctgcgccaccgacaccagcaacatccagttcgtgttcgacgccgtgaccgacgtgatcatccagaacaacctgaagtacatcggcctgtgctag

SEQ ID NO: 83865 - DNA, 1188 bp, Artificial Sequence
  Description of Artificial Sequence: Synthetic coding sequence
atgtgcgaccagaccttcctggtgaacgtgttcggcagctgcgacaagtgcttcaagcagagagccctgagacccgtgttcaagaagagccagcagctgagctactgcagcacctgcgccgagatcatggccaccgagggcctgcacgagaacgagaccctggccagcctgaagagcgaggccgagagcctgaagggcaagctggaggaggagagagccaagctgcacgacgtggagctgcaccaggtggccgagagagtggaggccctgggccagttcgtgatgaagaccagaagaaccctgaagggccacggcaacaaggtgctgtgcatggactggtgcaaggacaagagaagaatcgtgagcagcagccaggacggcaaggtgatcgtgtgggacagcttcaccaccaacaaggagcacgccgtgaccatgccctgcacctgggtgatggcctgcgcctacgcccccagcggctgcgccatcgcctgcggcggcctggacaacaagtgcagcgtgtaccccctgaccttcgacaagaacgagaacatggccgccaagaagaagagcgtggccatgcacaccaactacctgagcgcctgcagcttcaccaacagcgacatgcagatcctgaccgccagcggcgacggcacctgcgccctgtgggacgtggagagcggccagctgctgcagagcttccacggccacggcgccgacgtgctgtgcctggacctggcccccagcgagaccggcaacaccttcgtgagcggcggctgcgacaagaaggccatggtgtgggacatgagaagcggccagtgcgtgcaggccttcgagacccacgagagcgacatcaacagcgtgagatactaccccagcggcgacgccttcgccagcggcagcgacgacgccacctgcagactgtacgacctgagagccgacagagaggtggccatctacagcaaggagagcatcatcttcggcgccagcagcgtggacttcagcctgagcggcagactgctgttcgccggctacaacgactacaccatcaacgtgtgggacgtgctgaagggcagcagagtgagcatcctgttcggccacgagaacagagtgagcaccctgagagtgagccccgacggcaccgccttctgcagcggcagctgggaccacaccctgagagtgtgggcctag

SEQ ID NO: 83866 - DNA, 1062 bp, Artificial Sequence
  Description of Artificial Sequence: Synthetic coding sequence
atggccaccgagggcctgcacgagaacgagaccctggccagcctgaagagcgaggccgagagcctgaagggcaagctggaggaggagagagccaagctgcacgacgtggagctgcaccaggtggccgagagagtggaggccctgggccagttcgtgatgaagaccagaagaaccctgaagggccacggcaacaaggtgctgtgcatggactggtgcaaggacaagagaagaatcgtgagcagcagccaggacggcaaggtgatcgtgtgggacagcttcaccaccaacaaggagcacgccgtgaccatgccctgcacctgggtgatggcctgcgcctacgcccccagcggctgcgccatcgcctgcggcggcctggacaacaagtgcagcgtgtaccccctgaccttcgacaagaacgagaacatggccgccaagaagaagagcgtggccatgcacaccaactacctgagcgcctgcagcttcaccaacagcgacatgcagatcctgaccgccagcggcgacggcacctgcgccctgtgggacgtggagagcggccagctgctgcagagcttccacggccacggcgccgacgtgctgtgcctggacctggcccccagcgagaccggcaacaccttcgtgagcggcggctgcgacaagaaggccatggtgtgggacatgagaagcggccagtgcgtgcaggccttcgagacccacgagagcgacatcaacagcgtgagatactaccccagcggcgacgccttcgccagcggcagcgacgacgccacctgcagactgtacgacctgagagccgacagagaggtggccatctacagcaaggagagcatcatcttcggcgccagcagcgtggacttcagcctgagcggcagactgctgttcgccggctacaacgactacaccatcaacgtgtgggacgtgctgaagggcagcagagtgagcatcctgttcggccacgagaacagagtgagcaccctgagagtgagccccgacggcaccgccttctgcagcggcagctgggaccacaccctgagagtgtgggcctag

SEQ ID NO: 83867 - DNA, 852 bp, Artificial Sequence
  Description of Artificial Sequence: Synthetic coding sequence
atggccaccgagggcctgcacgagaacgagaccctggccagcctgaagagcgaggccgagagcctgaagggcaagctggaggaggagagagccaagctgcacgacgtggagctgcaccaggtggccgagagagtggaggccctgggccagttcgtgatgaagaccagaagaaccctgaagggccacggcaacaaggtgctgtgcatggactggtgcaaggacaagagaagaatcgtgagcagcagccaggacggcaaggtgatcgtgtgggacagcttcaccaccaacaagatcctgaccgccagcggcgacggcacctgcgccctgtgggacgtggagagcggccagctgctgcagagcttccacggccacggcgccgacgtgctgtgcctggacctggcccccagcgagaccggcaacaccttcgtgagcggcggctgcgacaagaaggccatggtgtgggacatgagaagcggccagtgcgtgcaggccttcgagacccacgagagcgacatcaacagcgtgagatactaccccagcggcgacgccttcgccagcggcagcgacgacgccacctgcagactgtacgacctgagagccgacagagaggtggccatctacagcaaggagagcatcatcttcggcgccagcagcgtggacttcagcctgagcggcagactgctgttcgccggctacaacgactacaccatcaacgtgtgggacgtgctgaagggcagcagagtgagcatcctgttcggccacgagaacagagtgagcaccctgagagtgagccccgacggcaccgccttctgcagcggcagctgggaccacaccctgagagtgtgggcctag

SEQ ID NO: 83868 - DNA, 582 bp, Artificial Sequence
  Description of Artificial Sequence: Synthetic coding sequence
atgagcaagctgctgatcctgatcctgaccgccagcggcgacggcacctgcgccctgtgggacgtggagagcggccagctgctgcagagcttccacggccacggcgccgacgtgctgtgcctggacctggcccccagcgagaccggcaacaccttcgtgagcggcggctgcgacaagaaggccatggtgtgggacatgagaagcggccagtgcgtgcaggccttcgagacccacgagagcgacatcaacagcgtgagatactaccccagcggcgacgccttcgccagcggcagcgacgacgccacctgcagactgtacgacctgagagccgacagagaggtggccatctacagcaaggagagcatcatcttcggcgccagcagcgtggacttcagcctgagcggcagactgctgttcgccggctacaacgactacaccatcaacgtgtgggacgtgctgaagggcagcagagtgagcatcctgttcggccacgagaacagagtgagcaccctgagagtgagccccgacggcaccgccttctgcagcggcagctgggaccacaccctgagagtgtgggcctag

SEQ ID NO: 83869 - DNA, 1023 bp, Artificial Sequence
  Description of Artificial Sequence: Synthetic coding sequence
atgagcgagctggaccagctgagacaggaggccgagcagctgaagaaccagatcagagacgccagaaaggcctgcgccgacgccaccctgagccagatcaccaacaacatcgaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaactacgtggcctgcggcggcctggacaacatctgcagcatctacaacctgaagaccagagagggcaacgtgagagtgagcagagagctggccggccacaccggctacctgagctgctgcagattcctggacgacaaccagatcgtgaccagcagcggcgacaccacctgcgccctgtgggacatcgagaccggccagcagaccaccaccttcaccggccacaccggcgacgtgatgagcctgagcctggcccccgacaccagactgttcgtgagcggcgcctgcgacgccagcgccaagctgtgggacgtgagagagggcatgtgcagacagaccttcaccggccacgagagcgacatcaacgccatctgcttcttccccaacggcaacgccttcgccaccggcagcgacgacgccacctgcagactgttcgacctgagagccgaccaggagctgatgacctacagccacgacaacatcatctgcggcatcaccagcgtgagcttcagcaagagcggcagactgctgctggccggctacgacgacttcaactgcaacgtgtgggacgccctgaaggccgacagagccggcgtgctggccggccacgacaacagagtgagctgcctgggcgtgaccgacgacggcatggccgtggccaccggcagctgggacagcttcctgaagatctggaactag

SEQ ID NO: 83870 - DNA, 1023 bp, Artificial Sequence; identical to SEQ ID NO: 83869
  Description of Artificial Sequence: Synthetic coding sequence

SEQ ID NO: 83871 - DNA, 597 bp, Artificial Sequence
  Description of Artificial Sequence: Synthetic coding sequence
tgaggctacctgagctgctgcagattcctggacgacaaccagatcgtgaccagcagcggcgacaccacctgcgccctgtgggacatcgagaccggccagcagaccaccaccttcaccggccacaccggcgacgtgatgagcctgagcctggcccccgacaccagactgttcgtgagcggcgcctgcgacgccagcgccaagctgtgggacgtgagagagggcatgtgcagacagaccttcaccggccacgagagcgacatcaacgccatctgcttcttccccaacggcaacgccttcgccaccggcagcgacgacgccacctgcagactgttcgacctgagagccgaccaggagctgatgacctacagccacgacaacatcatctgcggcatcaccagcgtgagcttcagcaagagcggcagactgctgctggccggctacgacgacttcaactgcaacgtgtgggacgccctgaaggccgacagagccggcgtgctggccggccacgacaacagagtgagctgcctgggcgtgaccgacgacggcatggccgtggccaccggcagctgggacagcttcctgaagatctggaactag

SEQ ID NO: 83872 - DNA, 444 bp, Artificial Sequence
  Description of Artificial Sequence: Synthetic coding sequence
atgagcgagctggaccagctgagacaggaggccgagcagctgaagaaccagatcagagacgccagaaaggcctgcgccgacgccaccctgagccagatcaccaacaacatcgaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaactacgtggcctgcggcggcctggacaacatctgcagcatctacaacctgaagaccagagagggcaacgtgagagtgagcagagagctggccggccacaccggcacctgcccctag

SEQ ID NO: 83873 - DNA, 327 bp, Artificial Sequence
  Description of Artificial Sequence: Synthetic coding sequence
atgagcgagctggaccagctgagacaggaggccgagcagctgaagaaccagatcagagacgccagaaaggcctgcgccgacgccaccctgagccagatcaccaacaacatcgaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagctag

SEQ ID NO: 83874 - DNA, 405 bp, Artificial Sequence
  Description of Artificial Sequence: Synthetic coding sequence
atgagcgagctggaccagctgagacaggaggccgagcagctgaagaaccagatcagaatcaccaacaacatcgaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaactacgtggcctgcggcggcctggacaacatctgcagcatctacaacctgaagaccagagagggcaacgtgagagtgagcagagagctggccggccacaccggcacctgcccctag

SEQ ID NO: 83875 - DNA, 723 bp, Artificial Sequence
  Description of Artificial Sequence: Synthetic coding sequence
atgacctgcgcctacgcccccagcggcaactacgtggcctgcggcggcctggacaacatctgcagcatctacaacctgaagaccagagagggcaacgtgagagtgagcagagagctggccggccacaccggctacctgagctgctgcagattcctggacgacaaccagatcgtgaccagcagcggcgacaccacctgcgccctgtgggacatcgagaccggccagcagaccaccaccttcaccggccacaccggcgacgtgatgagcctgagcctggcccccgacaccagactgttcgtgagcggcgcctgcgacgccagcgccaagctgtgggacgtgagagagggcatgtgcagacagaccttcaccggccacgagagcgacatcaacgccatctgcttcttccccaacggcaacgccttcgccaccggcagcgacgacgccacctgcagactgttcgacctgagagccgaccaggagctgatgacctacagccacgacaacatcatctgcggcatcaccagcgtgagcttcagcaagagcggcagactgctgctggccggctacgacgacttcaactgcaacgtgtgggacgccctgaaggccgacagagccggcgtgctggccggccacgacaacagagtgagctgcctgggcgtgaccgacgacggcatggccgtggccaccggcagctgggacagcttcctgaagatctggaactag

SEQ ID NO: 83876 - DNA, 984 bp, Artificial Sequence
  Description of Artificial Sequence: Synthetic coding sequence
atgaccgccccctgccccccccccccccccgacccccagttcgtgctgagaggcacccagagccccgtgcacgccctgcacttctgcgagggcgcccaggcccagggcagacccctgctgttcagcggcagccagagcggcctggtgcacatctggagcctgcagaccagaagagccgtgaccaccctggacggccacggcggccagtgcgtgacctggctgcagaccctgccccagggcagacagctgctgagccagggcagagacctgaagctgtgcctgtgggacctggccgagggcagaagcgccgtggtggacagcgtgtgcctggagagcgtgggcttctgcagaagcagcatcctggccggcggccagcccagatggaccctggccgtgcccggcagaggcagcgacgaggtgcagatcctggagatgcccagcaagaccagcgtgtgcgccctgaagcccaaggccgacgccaagctgggcatgcccatgtgcctgagactgtggcaggccgactgcagcagcagacccctgctgctggccggctacgaggacggcagcgtggtgctgtgggacgtgagcgagcagaaggtgtgcagcagaatcgcctgccacgaggagcccgtgatggacctggacttcgacagccagaaggccagaggcatcagcggcagcgccggcaaggccctggccgtgtggagcctggactggcagcaggccctgcaggtgagaggcacccacgagctgaccaaccccggcatcgccgaggtgaccatcagacccgacagaaagatcctggccaccgccggctgggaccacagaatcagagtgttccactggagaaccatgcagcccctggccgtgctggccttccacagcgccgccgtgcagtgcgtggccttcaccgccgacggcctgctggccgccggcagcaaggaccagagaatcagcctgtggagcctgtaccccagagcctag

SEQ ID NO: 83877 - DNA, 984 bp, Artificial Sequence; identical to SEQ ID NO: 83876
  Description of Artificial Sequence: Synthetic coding sequence

SEQ ID NO: 83878 - DNA, 639 bp, Artificial Sequence
  Description of Artificial Sequence: Synthetic coding sequence
atgaccgccccctgccccccccccccccccgacccccagttcgtgctgagaggcacccagagccccgtgcacgccctgcacttctgcgagggcgcccaggcccagggcagacccctgctgttcagcggcagccagagcggcctggtgcacatctggagcctgcagaccagaagagccgtgaccaccctggacggccacggcggccagtgcgtgacctggctgcagaccctgccccagggcagacagctgctgagccagggcagagacctgaagctgtgcctgtgggacctggccgagggcagaagcgccgtggtggacagcgtgtgcctggagagcgtgggcttctgcagaagcagcatcctggccggcggccagcccagatggaccctggccgtgcccggcagaggcagcgacgaggtgcagatcctggagatgcccagcaagaccagcgtgtgcgccctgaagcccaaggccgacgccaagctgggcatgcccatgtgcctgagactgtggcaggccgactgcagcagcagacccctgctgctggccggctacgaggacggcagcgtggtgctgtgggacgtgagcgagcagaaggtgtgcagcagaatcgcctgccacgaggagcccggcctgtag

SEQ ID NO: 83879 - DNA, 1023 bp, Artificial Sequence
  Description of Artificial Sequence: Synthetic coding sequence
atgagcgagctggagcagctgagacaggaggccgagcagctgagaaaccagatcagagacgccagaaaggcctgcggcgacagcaccctgacccagatcaccgccggcctggaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctggacgacaaccagatcatcaccagcagcggcgacaccacctgcgccctgtgggacatcgagaccggccagcagaccgtgggcttcgccggccacagcggcgacgtgatgagcctgagcctggcccccgacggcagaaccttcgtgagcggcgcctgcgacgccagcatcaagctgtgggacgtgagagacagcatgtgcagacagaccttcatcggccacgagagcgacatcaacgccgtggccttcttccccaacggctacgccttcaccaccggcagcgacgacgccacctgcagactgttcgacctgagagccgaccaggagctgctgatgtacagccacgacaacatcatctgcggcatcaccagcgtggccttcagcagaagcggcagactgctgctggccggctacgacgacttcaactgcaacatctgggacgccatgaagggcgacagagccggcgtgctggccggccacgacaacagagtgagctgcctgggcgtgaccgacgacggcatggccgtggccaccggcagctgggacagcttcctgaagatctggaactag

SEQ ID NO: 83880 - DNA, 1023 bp, Artificial Sequence; identical to SEQ ID NO: 83879
  Description of Artificial Sequence: Synthetic coding sequence

SEQ ID NO: 83881 - DNA, 1023 bp, Artificial Sequence; identical to SEQ ID NO: 83879
  Description of Artificial Sequence: Synthetic coding sequence

SEQ ID NO: 83882 - DNA, 459 bp, Artificial Sequence
  Description of Artificial Sequence: Synthetic coding sequence
atgagcgagctggagcagctgagacaggaggccgagcagctgagaaaccagatcagagacgccagaaaggcctgcggcgacagcaccctgacccagatcaccgccggcctggaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctgtag

SEQ ID NO: 83883 - DNA, 723 bp, Artificial Sequence
  Description of Artificial Sequence: Synthetic coding sequence
atgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctggacgacaaccagatcatcaccagcagcggcgacaccacctgcgccctgtgggacatcgagaccggccagcagaccgtgggcttcgccggccacagcggcgacgtgatgagcctgagcctggcccccgacggcagaaccttcgtgagcggcgcctgcgacgccagcatcaagctgtgggacgtgagagacagcatgtgcagacagaccttcatcggccacgagagcgacatcaacgccgtggccttcttccccaacggctacgccttcaccaccggcagcgacgacgccacctgcagactgttcgacctgagagccgaccaggagctgctgatgtacagccacgacaacatcatctgcggcatcaccagcgtggccttcagcagaagcggcagactgctgctggccggctacgacgacttcaactgcaacatctgggacgccatgaagggcgacagagccggcgtgctggccggccacgacaacagagtgagctgcctgggcgtgaccgacgacggcatggccgtggccaccggcagctgggacagcttcctgaagatctggaactag

SEQ ID NO: 83884 - DNA, 891 bp, Artificial Sequence
  Description of Artificial Sequence: Synthetic coding sequence
atgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctggacgacaaccagatcatcaccagcagcggcgacaccacctgcgccctgtgggacatcgagaccggccagcagaccgtgggcttcgccggccacagcggcgacgtgatgagcctgagcctggcccccgacggcagaaccttcgtgagcggcgcctgcgacgccagcatcaagctgtgggacgtgagagacagcatgtgcagacagaccttcatcggccacgagagcgacatcaacgccgtggccttcttccccaacggctacgccttcaccaccggcagcgacgacgccacctgcagactgttcgacctgagagccgaccaggagctgctgatgtacagccacgacaacatcatctgcggcatcaccagcgtggccttcagcagaagcggcagactgctgctggccggctacgacgacttcaactgcaacatctgggacgccatgaagggcgacagagccggcgtgctggccggccacgacaacagagtgagctgcctgggcgtgaccgacgacggcatggccgtggccaccggcagctgggacagcttcctgaagatctggaactag

SEQ ID NO: 83885 - DNA, 723 bp, Artificial Sequence; identical to SEQ ID NO: 83883
  Description of Artificial Sequence: Synthetic coding sequence

SEQ ID NO: 83886 - DNA, 699 bp, Artificial Sequence
  Description of Artificial Sequence: Synthetic coding sequence
atgagcgagctggagcagctgagacaggaggccgagcagctgagaaaccagatcagagacgccagaaaggcctgcggcgacagcaccctgacccagatcaccgccggcctggaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctggacgacaaccagatcatcaccagcagcggcgacaccacctgcgccctgtgggacatcgagaccggccagcagaccgtgggcttcgccggccacagcggcgacgtgatgagcctgagcctggcccccgacggcagaaccttcgtgagcggcgcctgcgacgccagcatcaagctgtgggacgtgagagacagcatgtgcagacagaccttcatcggccacgagagcgacatcaacgccgtgtag

SEQ ID NO: 83887 - DNA, 891 bp, Artificial Sequence; identical to SEQ ID NO: 83884
  Description of Artificial Sequence: Synthetic coding sequence

SEQ ID NO: 83888 - DNA, 756 bp, Artificial Sequence
  Description of Artificial Sequence: Synthetic coding sequence
atgagcgagctggagcagctgagacaggaggccgagcagctgagaaaccagatcagagacgccagaaaggcctgcggcgacagcaccctgacccagatcaccgccggcctggaccccgtgggcagaatccagatgagaaccagaagaaccctgagaggccacctggccaagatctacgccatgcactggggcaccgacagcagactgctggtgagcgccagccaggacggcaagctgatcatctgggacagctacaccaccaacaaggtgcacgccatccccctgagaagcagctgggtgatgacctgcgcctacgcccccagcggcaacttcgtggcctgcggcggcctggacaacatctgcagcatctacagcctgaagaccagagagggcaacgtgagagtgagcagagagctgcccggccacaccggctacctgagctgctgcagattcctggacgacaaccagatcatcaccagcagcggcgacaccacctgcgccctgtgggacatcgagaccggccagcagaccgtgggcttcgccggccacagcggcgacgtgatgagcctgagcctggcccccgacggcagaaccttcgtgagcggcgcctgcgacgccagcatcaagctgtgggacgtgagagacagcatgtgcagacagaccttcatcggccacgagagcgacatcaacgccgtggccttcttccccaacggctacgccttcaccaccggcagcgacgacgccacctgcagatag

SEQ ID NO: 83889 - DNA, 828 bp, Artificial Sequence
  Description of Artificial Sequence: Synthetic coding sequence
atgagcgccgaggtgaaggtgaccggccagaaccaggagcagttcctgctgctggccaagagcgccaagggcgccgccctggccaccctgatccaccaggtgctggaggcccccggcgtgtacgtgttcggcgagctgctggacatgcccaacgtgagagagctggccgagagcgacttcgccagcaccttcagactgctgaccgtgttcgcctacggcacctacgccgactacctggccgaggccagaaacctgccccccctgaccgaggcccagaagaacaagctgagacacctgagcgtggtgaccctggccgccaaggtgaagtgcatcccctacgccgtgctgctggaggccctggccctgagaaacgtgagacagctggaggacctggtgatcgaggccgtgtacgccgacgtgctgagaggcagcctggaccagagaaaccagagactggaggtggactacagcatcggcagagacatccagagacaggacctgagcgccatcgccagaaccctgcaggagtggtgcgtgggctgcgaggtggtgctgagcggcatcgaggagcaggtgagcagagccaaccagcacaaggagcagcagctgggcctgaagcagcagatcgagagcgaggtggccaacctgaagaagaccatcaaggtgaccaccgccgccgccgccgccgccaccagccaggaccccgagcagcacctgaccgagctgagagagcccgcccccggcaccaaccagagacagcccagcaagaaggccagcaagggcaagggcctgagaggcagcgccaagatctggagcaagagcaactag

SEQ ID NO: 83890 - DNA, 387 bp, Artificial Sequence
  Description of Artificial Sequence: Synthetic coding sequence
atgaccagcctgttcgcccaggagatcagactgagcaagagacacgaggagatcgtgagccagagactgatgctgctgcagcagatggagaacaagctgggcgaccagcacaccgagaaggccagccagctgcagaccgtggagaccgccttcaagagaaacctgagcctgctgaaggacatcgaggccgccgagaagagcctgcagaccagaatccaccccctgcccagacccgaggtggtgagcctggagaccagatactgggccagcgtggaggagtacatccccaagtgggagcagttcctgctgggcagagccccctaccccttcgccgtggagaaccagaacgaggccgagaacaccatccagaacgaggcccagagatag

SEQ ID NO: 83891 - DNA, 1023 bp, Artificial Sequence
  Description of Artificial Sequence: Synthetic coding sequence
atgagcgagctggagcagctgagacaggaggccgagcagctgagaaaccagatccaggacgccagaaaggcctgcaacgacgccaccctggtgcagatcaccagcaacatggacagcgtgggcagaatccagatgagaaccagaagaaccctgagaggccacctggccaagatctacgccatgcactggggctacgacagcagactgctggtgagcgccagccaggacggcaagctgatcatctgggacagctacaccaccaacaagatgcacgccatccccctgagaagcagctgggtgatgacctgcgcctacgcccccagcggcaactacgtggcctgcggcggcctggacaacatctgcagcatctacaacctgaagaccagagagggcaacgtgagagtgagcagagagctgcccggccacaccggctacctgagctgctgcagattcctggacgacagccagatcgtgaccagcagcggcgacaccacctgcgccctgtgggacatcgagaccgcccagcagaccaccaccttcaccggccacagcggcgacgtgatgagcctgagcctgagccccgacatgagaaccttcgtgagcggcgcctgcgacgccagcagcaagctgtgggacatcagagacggcatgtgcagacagagcttcaccggccacgtgagcgacatcaacgccgtgagcttcttccccaacggctacgccttcgccaccggcagcgacgacgccacctgcagactgttcgacctgagagccgaccaggagctgctgctgtacagccacgacaacatcatctgcggcatcaccagcgtggccttcagcaagagcggcagactgctgctggccggctacgacgacttcaactgcaacgtgtgggacaccctgaagggcgacagagccggcgtgctggccggccacgacaacagagtgagctgcctgggcgtgaccgacgacggcatggccgtggccaccggcagctgggacagcttcctgagaatctggaactag

SEQ ID NO: 83892 - DNA, 240 bp, Artificial Sequence
  Description of Artificial Sequence: Synthetic coding sequence
atgagcgagctggagcagctgagacaggaggccgagcagctgagaaaccagatccaggacgccagaaaggcctgcaacgacgccaccctggtgcagatcaccagcaacatggacagcgtgggcagaatccagatgagaaccagaagaaccctgagaggccacctggccaagatctacgccatgcactggggctacgacagcagactgctggtgagcgccagccaggacggcaagctgtag

SEQ ID NO: 83893 - DNA, 204 bp, Artificial Sequence
  Description of Artificial Sequence: Synthetic coding sequence
atggaggagtgggacgtgccccagatgaagaaggaggtggagagcctgaagtaccagctggccttccagagagagatggccagcaagaccatccccgagctgctgaagtggatcgaggacggcatccccaaggaccccttcctgaaccccgacctgatgaagaacaacccctgggtggagaagggcaagtgcaccatcctgtag

SEQ ID NO: 83894 - DNA, 216 bp, Artificial Sequence
  Description of Artificial Sequence: Synthetic coding sequence
atggccagcaacaacaccgccagcatcgcccaggccagaaagctggtggagcagctgaagatggaggccaacatcgacagaatcaaggtgagcaaggccgccgccgacctgatggcctactgcgaggcccacgccaaggaggaccccctgctgacccccgtgcccgccagcgagaaccccttcagagagaagaagttcttctgcgccatcctgtag

SEQ ID NO: 83895 - DNA, 309 bp, Artificial Sequence
  Description of Artificial Sequence: Synthetic coding sequence
atgcagggcaagctgcagccccccatggagagagaggccagagacggcgtgcccagcggcaaggtgttcctgaaggacctgagcagcacccccatggccagcaacaacaccgccagcatcgcccaggccagaaagctggtggagcagctgaagatggaggccaacatcgacagaatcaaggtgagcaaggccgccgccgacctgatggcctactgcgaggcccacgccaaggaggaccccctgctgacccccgtgcccgccagcgagaaccccttcagagagaagaagttcttctgcgccatcctgtag

SEQ ID NO: 83896 - DNA, 216 bp, Artificial Sequence; identical to SEQ ID NO: 83894
  Description of Artificial Sequence: Synthetic coding sequence

SEQ ID NO: 83897 - DNA, 216 bp, Artificial Sequence; identical to SEQ ID NO: 83894
  Description of Artificial Sequence: Synthetic coding sequence

SEQ ID NO: 83898 - DNA, 216 bp, Artificial Sequence; identical to SEQ ID NO: 83894
  Description of Artificial Sequence: Synthetic coding sequence

SEQ ID NO: 83899 - DNA, 216 bp, Artificial Sequence; identical to SEQ ID NO: 83894
  Description of Artificial Sequence: Synthetic coding sequence

SEQ ID NO: 83900 - DNA, 333 bp, Artificial Sequence
  Description of Artificial Sequence: Synthetic coding sequence
atggtgtacctgcaggccaagaccagaatccccgagcacagaaaggtgacccagctgatcaagtgctggagccccgacctgaaccccgtgttcctgaaggacctgagcagcacccccatggccagcaacaacaccgccagcatcgcccaggccagaaagctggtggagcagctgaagatggaggccaacatcgacagaatcaaggtgagcaaggccgccgccgacctgatggcctactgcgaggcccacgccaaggaggaccccctgctgacccccgtgcccgccagcgagaaccccttcagagagaagaagttcttctgcgccatcctgtag

SEQ ID NO: 83901 - DNA, 207 bp, Artificial Sequence
  Description of Artificial Sequence: Synthetic coding sequence
atgagcggcagcagcagcgtggccgccatgaagaaggtggtgcagcagctgagactggaggccggcctgaacagagtgaaggtgagccaggccgccgccgacctgaagcagttctgcctgcagaacgcccagcacgaccccctgctgaccggcgtgagcagcagcaccaaccccttcagaccccagaaggtgtgcagcttcctgtag

SEQ ID NO: 83902 - DNA, 207 bp, Artificial Sequence; identical to SEQ ID NO: 83901
  Description of Artificial Sequence: Synthetic coding sequence

SEQ ID NO: 83903 - DNA, 225 bp, Artificial Sequence
  Description of Artificial Sequence: Synthetic coding sequence
atgcccgtgatcaacatcgaggacctgaccgagaaggacaagctgaagatggaggtggaccagctgaagaaggaggtgaccctggagagaatgctggtgagcaagtgctgcgaggaggtgagagactacgtggaggagagaagcggcgaggaccccctggtgaagggcatccccgaggacaagaaccccttcaaggagctgaagggcggctgcgtgatcagctag

SEQ ID NO: 83904 - DNA, 225 bp, Artificial Sequence; identical to SEQ ID NO: 83903
  Description of Artificial Sequence: Synthetic coding sequence

SEQ ID NO: 83905 - DNA, 210 bp, Artificial Sequence
  Description of Artificial Sequence: Synthetic coding sequence
atggcccaggacctgagcgagaaggacctgctgaagatggaggtggagcagctgaagaaggaggtgaagaacaccagaatccccatcagcaaggccggcaaggagatcaaggagtacgtggaggcccaggccggcaacgaccccttcctgaagggcatccccgaggacaagaaccccttcaaggagaagggcggctgcctgatcagctag

SEQ ID NO: 83906 - DNA, 210 bp, Artificial Sequence; identical to SEQ ID NO: 83905
  Description of Artificial Sequence: Synthetic coding sequence

SEQ ID NO: 83907 - DNA, 210 bp, Artificial Sequence; identical to SEQ ID NO: 83905
  Description of Artificial Sequence: Synthetic coding sequence

SEQ ID NO: 83908 - DNA, 210 bp, Artificial Sequence; identical to SEQ ID NO: 83905
  Description of Artificial Sequence: Synthetic coding sequence

SEQ ID NO: 83909 - DNA, 210 bp, Artificial Sequence; identical to SEQ ID NO: 83905
  Description of Artificial Sequence: Synthetic coding sequence

SEQ ID NO: 83910 - DNA, 1080 bp, Artificial Sequence
  Description of Artificial Sequence: Synthetic coding sequence
atgaccctggagagcatcatggcctgctgcctgagcgaggaggccaaggaggccagaagaatcaacgacgagatcgagagacagctgagaagagacaagagagacgccagaagagagctgaagctgctgctgctgggcaccggcgagagcggcaagagcaccttcatcaagcagatgagaatcatccacggcagcggctacagcgacgaggacaagagaggcttcaccaagctggtgtaccagaacatcttcaccgccatgcaggccatgatcagagccatggacaccctgaagatcccctacaagtacgagcacaacaaggcccacgcccagctggtgagagaggtggacgtggagaaggtgagcgccttcgagaacccctacgtggacgccatcaagagcctgtggaacgaccccggcatccaggagtgctacgacagaagaagagagtaccagctgagcgacagcaccaagtactacctgaacgacctggacagagtggccgaccccgcctacctgcccacccagcaggacgtgctgagagtgagagtgcccaccaccggcatcatcgagtaccccttcgacctgcagagcgtgatcttcagaatggtggacgtgggcggccagagaagcgagagaagaaagtggatccactgcttcgagaacgtgaccagcatcatgttcctggtggccctgagcgagtacgaccaggtgctggtggagagcgacaacgagaacagaatggaggagagcaaggccctgttcagaaccatcatcacctacccctggttccagaacagcagcgtgatcctgttcctgaacaagaaggacctgctggaggagaagatcatgtacagccacctggtggactacttccccgagtacgacggcccccagagagacgcccaggccgccagagagttcatcctgaagatgttcgtggacctgaaccccgacagcgacaagatcatctacagccacttcacctgcgccaccgacaccgagaacatcagattcgtgttcgccgccgtgaaggacaccatcctgcagctgaacctgaaggagtacaacctggtgtag

SEQ ID NO: 83911 - DNA, 474 bp, Artificial Sequence
  Description of Artificial Sequence: Synthetic coding sequence
atggtggacgtgggcggccagagaagcgagagaagaaagtggatccactgcttcgagaacgtgaccagcatcatgttcctggtggccctgagcgagtacgaccaggtgctggtggagagcgacaacgagaacagaatggaggagagcaaggccctgttcagaaccatcatcacctacccctggttccagaacagcagcgtgatcctgttcctgaacaagaaggacctgctggaggagaagatcatgtacagccacctggtggactacttccccgagtacgacggcccccagagagacgcccaggccgccagagagttcatcctgaagatgttcgtggacctgaaccccgacagcgacaagatcatctacagccacttcacctgcgccaccgacaccgagaacatcagattcgtgttcgccgccgtgaaggacaccatcctgcagctgaacctgaaggagtacaacctggtgtag

SEQ ID NO: 83912 - DNA, 513 bp, Artificial Sequence
  Description of Artificial Sequence: Synthetic coding sequence
atgggcgagagatgggccgacagccagctggacagcagaagcacccacggcaccggcgagagcggcaagagcaccttcatcaagcagatgagaatcatccacggcagcggctacagcgacgaggacaagagaggcttcaccaagctggtgtaccagaacatcttcaccgccatgcaggccatgatcagagccatggacaccctgaagatcccctacaagtacgagcacaacaaggcccacgcccagctggtgagagaggtggacgtggagaaggtgagcgccttcgagaacccctacgtggacgccatcaagagcctgtggaacgaccccggcatccaggagtgctacgacagaagaagagagtaccagctgagcgacagcaccaagtactacctgaacgacctggacagagtggccgaccccgcctacctgcccacccagcaggacgtgctgagagtgagagtgcccaccaccggcatcatcgagtaccccttcgacctgcagagcgtgtag

SEQ ID NO: 83913 - DNA, 1824 bp, Artificial Sequence
  Description of Artificial Sequence: Synthetic coding sequence
atgcccagaaagaagcccttcagcgtgaagcagaagaagaagcagctgcaggacaagagagagagaaagagaggcctgcaggacggcctgagaagcagcagcaacagcagaagcggcagcagagagagaagagaggagcagaccgacaccagcgacggcgagagcgtgacccaccacatcagaagactgaaccagcagcccagccagggcctgggccccagaggctacgaccccaacagatacagactgcacttcgagagagacagcagagaggaggtggagagaagaaagagagccgccagagagcaggtgctgcagcccgtgagcgccgagctgctggagctggacatcagagaggtgtaccagcccggcagcgtgctggacttccccagaagacccccctggagctacgagatgagcaaggagcagctgatgagccaggaggagagaagcttccaggactacctgggcaagatccacggcgcctacagcagcgagaagctgagctacttcgagcacaacctggagacctggagacagctgtggagagtgctggagatgagcgacatcgtgctgctgatcaccgacatcagacaccccgtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggaccccagcagcgtgctgaagaagagcagaagaagaggcagaggctggaccagagccctgggccccgagcagctgctgagagcctgcgaggccatcaccgtgggcaaggtggacctgagcagctggagagagaagatcgccagagacgtggccggcgccacctggggcaacggcagcggcgaggaggaggaggaggaggacggccccgccgtgctggtggagcagcagaccgacagcgccatggagcccaccggccccacccaggagagatacaaggacggcgtggtgaccatcggctgcgtgggcttccccaacgtgggcaagagcagcctgatcaacggcctggtgggcagaaaggtggtgagcgtgagcagaacccccggccacaccagatacttccagacctacttcctgacccccagcgtgaagctgtgcgactgccccggcctgatcttccccagcctgctgcccagacagctgcaggtgctggccggcatctaccccatcgcccagatccaggagccctacaccgccgtgggctacctggccagcagaatccccgtgcaggccctgctgcacctgagacaccccgaggccgaggaccccagcgccgagcacccctggtgcgcctgggacatctgcgaggcctgggccgagaagagaggctacaagaccgccaaggccgccagaaacgacgtgtacagagccgccaacagcctgctgagactggccgtggacggcagactgagcctgtgcttccacccccccggctacagcgagcagaagggcacctgggagagccaccccgagaccaccgagctggtggtgctgcagggcagagtgggccccgccggcgacgaggaggaggaggaggaggaggagctgagcagcagctgcgaggaggagggcgaggaggacagagacgccgacgaggagggcgagggcgacgaggagacccccaccagcgcccccggcagcagcctggccggcagaaacccctacgccctgctgggcgaggacgagtgctag

SEQ ID NO: 83914 - DNA, 1224 bp, Artificial Sequence
  Description of Artificial Sequence: Synthetic coding sequence
gtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggaccccagcagcgtgctgaagaagagcagaagaagaggcagaggctggaccagagccctgggccccgagcagctgctgagagcctgcgaggccatcaccgtgggcaaggtggacctgagcagctggagagagaagatcgccagagacgtggccggcgccacctggggcaacggcagcggcgaggaggaggaggaggaggacggccccgccgtgctggtggagcagcagaccgacagcgccatggagcccaccggccccacccaggagagatacaaggacggcgtggtgaccatcggctgcgtgggcttccccaacgtgggcaagagcagcctgatcaacggcctggtgggcagaaaggtggtgagcgtgagcagaacccccggccacaccagatacttccagacctacttcctgacccccagcgtgaagctgtgcgactgccccggcctgatcttccccagcctgctgcccagacagctgcaggtgctggccggcatctaccccatcgcccagatccaggagccctacaccgccgtgggctacctggccagcagaatccccgtgcaggccctgctgcacctgagacaccccgaggccgaggaccccagcgccgagcacccctggtgcgcctgggacatctgcgaggcctgggccgagaagagaggctacaagaccgccaaggccgccagaaacgacgtgtacagagccgccaacagcctgctgagactggccgtggacggcagactgagcctgtgcttccacccccccggctacagcgagcagaagggcacctgggagagccaccccgagaccaccgagctggtggtgctgcagggcagagtgggccccgccggcgacgaggaggaggaggaggaggaggagctgagcagcagctgcgaggaggagggcgaggaggacagagacgccgacgaggagggcgagggcgacgaggagacccccaccagcgcccccggcagcagcctggccggcagaaacccctacgccctgctgggcgaggacgagtgctag

SEQ ID NO: 83915 - DNA, 1824 bp, Artificial Sequence; identical to SEQ ID NO: 83913
  Description of Artificial Sequence: Synthetic coding sequence

SEQ ID NO: 83916 - DNA, 795 bp, Artificial Sequence
  Description of Artificial Sequence: Synthetic coding sequence
atgggcgagagagtgctgtggcccctgagagccggccagcactggagacacagacccctgcccgccggcctgcaggacggcctgagaagcagcagcaacagcagaagcggcagcagagagagaagagaggagcagaccgacaccagcgacggcgagagcgtgacccaccacatcagaagactgaaccagcagcccagccagggcctgggccccagaggctacgaccccaacagatacagactgcacttcgagagagacagcagagaggaggtggagagaagaaagagagccgccagagagcaggtgctgcagcccgtgagcgccgagctgctggagctggacatcagagaggtgtaccagcccggcagcgtgctggacttccccagaagacccccctggagctacgagatgagcaaggagcagctgatgagccaggaggagagaagcttccaggactacctgggcaagatccacggcgcctacagcagcgagaagctgagctacttcgagcacaacctggagacctggagacagctgtggagagtgctggagatgagcgacatcgtgctgctgatcaccgacatcagacaccccgtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggactag

SEQ ID NO: 83917 - DNA, 1824 bp, Artificial Sequence; identical to SEQ ID NO: 83913
  Description of Artificial Sequence: Synthetic coding sequence

SEQ ID NO: 83918 - DNA, 1290 bp, Artificial Sequence
  Description of Artificial Sequence: Synthetic coding sequence
atggaggccgccgtggtgctggagatgagcgacatcgtgctgctgatcaccgacatcagacaccccgtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggaccccagcagcgtgctgaagaagagcagaagaagaggcagaggctggaccagagccctgggccccgagcagctgctgagagcctgcgaggccatcaccgtgggcaaggtggacctgagcagctggagagagaagatcgccagagacgtggccggcgccacctggggcaacggcagcggcgaggaggaggaggaggaggacggccccgccgtgctggtggagcagcagaccgacagcgccatggagcccaccggccccacccaggagagatacaaggacggcgtggtgaccatcggctgcgtgggcttccccaacgtgggcaagagcagcctgatcaacggcctggtgggcagaaaggtggtgagcgtgagcagaacccccggccacaccagatacttccagacctacttcctgacccccagcgtgaagctgtgcgactgccccggcctgatcttccccagcctgctgcccagacagctgcaggtgctggccggcatctaccccatcgcccagatccaggagccctacaccgccgtgggctacctggccagcagaatccccgtgcaggccctgctgcacctgagacaccccgaggccgaggaccccagcgccgagcacccctggtgcgcctgggacatctgcgaggcctgggccgagaagagaggctacaagaccgccaaggccgccagaaacgacgtgtacagagccgccaacagcctgctgagactggccgtggacggcagactgagcctgtgcttccacccccccggctacagcgagcagaagggcacctgggagagccaccccgagaccaccgagctggtggtgctgcagggcagagtgggccccgccggcgacgaggaggaggaggaggaggaggagctgagcagcagctgcgaggaggagggcgaggaggacagagacgccgacgaggagggcgagggcgacgaggagacccccaccagcgcccccggcagcagcctggccggcagaaacccctacgccctgctgggcgaggacgagtgctag

SEQ ID NO: 83919 - DNA, 1824 bp, Artificial Sequence; identical to SEQ ID NO: 83913
  Description of Artificial Sequence: Synthetic coding sequence

SEQ ID NO: 83920 - DNA, 1215 bp, Artificial Sequence
  Description of Artificial Sequence: Synthetic coding sequence
atgagcaaggagcagctgatgagccaggaggagagaagcttccaggactacctgggcaagatccacggcgcctacagcagcgagaagctgagctacttcgagcacaacctggagacctggagacagctgtggagagtgctggagatgagcgacatcgtgctgctgatcaccgacatcagacaccccgtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggaccccagcagcgtgctgaagaagagcagaagaagaggcagaggctggaccagagccctgggccccgagcagctgctgagagcctgcgaggccatcaccgtgggcaagggcttccccaacgtgggcaagagcagcctgatcaacggcctggtgggcagaaaggtggtgagcgtgagcagaacccccggccacaccagatacttccagacctacttcctgacccccagcgtgaagctgtgcgactgccccggcctgatcttccccagcctgctgcccagacagctgcaggtgctggccggcatctaccccatcgcccagatccaggagccctacaccgccgtgggctacctggccagcagaatccccgtgcaggccctgctgcacctgagacaccccgaggccgaggaccccagcgccgagcacccctggtgcgcctgggacatctgcgaggcctgggccgagaagagaggctacaagaccgccaaggccgccagaaacgacgtgtacagagccgccaacagcctgctgagactggccgtggacggcagactgagcctgtgcttccacccccccggctacagcgagcagaagggcacctgggagagccaccccgagaccaccgagctggtggtgctgcagggcagagtgggccccgccggcgacgaggaggaggaggaggaggaggagctgagcagcagctgcgaggaggagggcgaggaggacagagacgccgacgaggagggcgagggcgacgaggagacccccaccagcgcccccggcagcagcctggccggcagaaacccctacgccctgctgggcgaggacgagtgctag

SEQ ID NO: 83921 - DNA, 795 bp, Artificial Sequence; identical to SEQ ID NO: 83916
  Description of Artificial Sequence: Synthetic coding sequence

SEQ ID NO: 83922 - DNA, 795 bp, Artificial Sequence; identical to SEQ ID NO: 83916
  Description of Artificial Sequence: Synthetic coding sequence

SEQ ID NO: 83923 - DNA, 795 bp, Artificial Sequence; identical to SEQ ID NO: 83916
  Description of Artificial Sequence: Synthetic coding sequence

SEQ ID NO: 83924 - DNA, 1824 bp, Artificial Sequence; identical to SEQ ID NO: 83913
  Description of Artificial Sequence: Synthetic coding sequence

SEQ ID NO: 83925 - DNA, 1824 bp, Artificial Sequence; identical to SEQ ID NO: 83913
  Description of Artificial Sequence: Synthetic coding sequence

SEQ ID NO: 83926 - DNA, 795 bp, Artificial Sequence; identical to SEQ ID NO: 83916
  Description of Artificial Sequence: Synthetic coding sequence

SEQ ID NO: 83927 - DNA, 795 bp, Artificial Sequence; identical to SEQ ID NO: 83916
  Description of Artificial Sequence: Synthetic coding sequence

SEQ ID NO: 83928 - DNA, 1824 bp, Artificial Sequence; identical to SEQ ID NO: 83913
  Description of Artificial Sequence: Synthetic coding sequence

SEQ ID NO: 83929 - DNA, 201 bp, Artificial Sequence
  Description of Artificial Sequence: Synthetic coding sequence
gtggtgaacttcccccccgccctgtacgagtacgtgaccggcgagctgggcctggccctggtgctggtgctgaacaaggtggacctggccccccccgccctggtggtggcctggaagcactacttccaccagcactacccccagctgcacgtggtgctgttcaccagcttccccagagaccccagaaccccccaggactag

SEQ ID NO: 83930 - DNA, 795 bp, Artificial Sequence; identical to SEQ ID NO: 83916
  Description of Artificial Sequence: Synthetic coding sequence

SEQ ID NO: 83931 - DNA, 1215 bp, Artificial Sequence; identical to SEQ ID NO: 83920
  Description of Artificial Sequence: Synthetic coding sequence

SEQ ID NO: 83932 - DNA, 789 bp, Artificial Sequence
  Description of Artificial Sequence: Synthetic coding sequence
atggagcccaccggccccacccaggagagatacaaggacggcgtggtgaccatcggctgcgtgggcttccccaacgtgggcaagagcagcctgatcaacggcctggtgggcagaaaggtggtgagcgtgagcagaacccccggccacaccagatacttccagacctacttcctgacccccagcgtgaagctgtgcgactgccccggcctgatcttccccagcctgctgcccagacagctgcaggtgctggccggcatctaccccatcgcccagatccaggagccctacaccgccgtgggctacctggccagcagaatccccgtgcaggccctgctgcacctgagacaccccgaggccgaggaccccagcgccgagcacccctggtgcgcctgggacatctgcgaggcctgggccgagaagagaggctacaagaccgccaaggccgccagaaacgacgtgtacagagccgccaacagcctgctgagactggccgtggacggcagactgagcctgtgcttccacccccccggctacagcgagcagaagggcacctgggagagccaccccgagaccaccgagctggtggtgctgcagggcagagtgggccccgccggcgacgaggaggaggaggaggaggaggagctgagcagcagctgcgaggaggagggcgaggaggacagagacgccgacgaggagggcgagggcgacgaggagacccccaccagcgcccccggcagcagcctggccggcagaaacccctacgccctgctgggcgaggacgagtgctag

SEQ ID NO: 83933 - DNA, 789 bp, Artificial Sequence; identical to SEQ ID NO: 83932
  Description of Artificial Sequence: Synthetic coding sequence

SEQ ID NO: 83934 - DNA, 1290 bp, Artificial Sequence; identical to SEQ ID NO: 83918
  Description of Artificial Sequence: Synthetic coding sequence

SEQ ID NO: 83935 - DNA, 1215 bp, Artificial Sequence; identical to SEQ ID NO: 83920
  Description of Artificial Sequence: Synthetic coding sequence

SEQ ID NO: 83936 - DNA, 1215 bp, Artificial Sequence; identical to SEQ ID NO: 83920
  Description of Artificial Sequence: Synthetic coding sequence

SEQ ID NO: 83937 - DNA, 789 bp, Artificial Sequence; identical to SEQ ID NO: 83932
  Description of Artificial Sequence: Synthetic coding sequence

SEQ ID NO: 83938 - DNA, 1290 bp, Artificial Sequence; identical to SEQ ID NO: 83918
  Description of Artificial Sequence: Synthetic coding sequence

SEQ ID NO: 83939 - DNA, 1290 bp, Artificial Sequence; identical to SEQ ID NO: 83918
  Description of Artificial Sequence: Synthetic coding sequence

SEQ ID NO: 83940 - DNA, 789 bp, Artificial Sequence; identical to SEQ ID NO: 83932
  Description of Artificial Sequence: Synthetic coding sequence

SEQ ID NO: 83941 - DNA, 1215 bp, Artificial Sequence; identical to SEQ ID NO: 83920
  Description of Artificial Sequence: Synthetic coding sequence

SEQ ID NO: 83942 - DNA, 1290 bp, Artificial Sequence; identical to SEQ ID NO: 83918
  Description of Artificial Sequence: Synthetic coding sequence

SEQ ID NO: 83943 - DNA, 1290 bp, Artificial Sequence; identical to SEQ ID NO: 83918
  Description of Artificial Sequence: Synthetic coding sequence

SEQ ID NO: 83944 - DNA, 789 bp, Artificial Sequence; identical to SEQ ID NO: 83932
  Description of Artificial Sequence: Synthetic coding sequence

SEQ ID NO: 83945 - DNA, 1290 bp, Artificial Sequence; identical to SEQ ID NO: 83918
  Description of Artificial Sequence: Synthetic coding sequence

SEQ ID NO: 83946 - DNA, 1215 bp, Artificial Sequence; identical to SEQ ID NO: 83920
  Description of Artificial Sequence: Synthetic coding sequence

SEQ ID NO: 83947 - DNA, 1215 bp, Artificial Sequence; identical to SEQ ID NO: 83920
  Description of Artificial Sequence: Synthetic coding sequence

SEQ ID NO: 83948 - DNA, 789 bp, Artificial Sequence; identical to SEQ ID NO: 83932
  Description of Artificial Sequence: Synthetic coding sequence

SEQ ID NO: 83949 - DNA, 2196 bp, Artificial Sequence
  Description of Artificial Sequence: Synthetic coding sequence
atggtgaagcccaagtacaagggcagaagcaccatcaaccccagcaaggccagcaccaaccccgacagagtgcagggcgccggcggccagaacatgagagacagagccaccatcagaagactgaacatgtacagacagaaggagagaagaaacagcagaggcaagatcatcaagcccctgcagtaccagagcaccgtggccagcggcaccgtggccagagtggagcccaacatcaagtggttcggcaacaccagagtgatcaagcagagcagcctgcagaagttccaggaggagatggacaccgtgatgaaggacccctacaaggtggtgatgaagcagagcaagctgcccatgagcctgctgcacgacagaatcagaccccacaacctgaaggtgcacatcctggacaccgagagcttcgagaccaccttcggccccaagagccagagaaagagacccaacctgttcgccagcgacatgcagagcctgatcgagaacgccgagatgagcaccgagagctacgaccagggcaaggacagagacctggtgaccgaggacaccggcgtgagaaacgaggcccaggaggagatctacaagaagggccagagcaagagaatctggggcgagctgtacaaggtgatcgacagcagcgacgtggtggtgcaggtgctggacgccagagaccccatgggcaccagaagcccccacatcgagacctacctgaagaaggagaagccctggaagcacctgatcttcgtgctgaacaagtgcgacctggtgcccacctgggccaccaagagatgggtggccgtgctgagccaggactaccccaccctggccttccacgccagcctgaccaaccccttcggcaagggcgccttcatccagctgctgagacagttcggcaagctgcacaccgacaagaagcagatcagcgtgggcttcatcggctaccccaacgtgggcaagagcagcgtgatcaacaccctgagaagcaagaaggtgtgcaacgtggcccccatcgccggcgagaccaaggtgtggcagtacatcaccctgatgagaagaatcttcctgatcgactgccccggcgtggtgtaccccagcgaggacagcgagaccgacatcgtgctgaagggcgtggtgcaggtggagaagatcaagagccccgaggaccacatcggcgccgtgctggagagagccaagcccgagtacatcagcaagacctacaagatcgacagctgggagaacgccgaggacttcctggagaagctggccttcagaaccggcaagctgctgaagggcggcgagcccgacctgcagaccgtgggcaagatggtgctgaacgactggcagagaggcagaatccccttcttcgtgaagccccccaacgccgagcccctggtggccccccagctgctgcccagcagcagcctggaggtggtgcccgaggccgcccagaacaaccccggcgaggaggtgaccgagaccgccggcgagggcagcgagagcatcatcaaggaggagaccgaggagaacagccactgcgacgccaacaccgagatgcagcagatcctgaccagagtgagacagaacttcggcaagatcaacgtggtgccccagttcagcggcgacgacctggtgcccgtggaggtgagcgacctggaggaggagctggagagcttcagcgacgaggaggaggaggagcaggagcagcagagagacgacgccgaggagagcagcagcgagcccgaggaggagaacgtgggcaacgacaccaaggccgtgatcaaggccctggacgagaagatcgccaagtaccagaagttcctggacaaggccaaggccaagaagttcagcgccgtgagaatcagcaagggcctgagcgagaagatcttcgccaagcccgaggagcagagaaagaccctggaggaggacgtggacgacagagcccccagcaagaagggcaagaagagaaaggcccagagagaggaggagcaggagcacagcaacaaggcccccagagccctgaccagcaaggagagaagaagagccgtgagacagcagagacccaagaaggtgggcgtgagatactacgagacccacaacgtgaagaacagaaacagaaacaagaagaagaccaacgacagcgagggccagaagcacaagagaaagaagttcagacagaagcagtag

SEQ ID NO: 83950 - DNA, 579 bp, Artificial Sequence
  Description of Artificial Sequence: Synthetic coding sequence
atgcagagcctgatcgagaacgccgagatgagcaccgagagctacgaccagggcaaggacagagacctggtgaccgaggacaccggcgtgagaaacgaggcccaggaggagatctacaagaagggccagagcaagagaatctggggcgagctgtacaaggtgatcgacagcagcgacgtggtggtgcaggtgctggacgccagagaccccatgggcaccagaagcccccacatcgagacctacctgaagaaggagaagccctggaagcacctgatcttcgtgctgaacaagtgcgacctggtgcccacctgggccaccaagagatgggtggccgtgctgagccaggactaccccaccctggccttccacgccagcctgaccaaccccttcggcaagggcgccttcatccagctgctgagacagttcggcaagctgcacaccgacaagaagcagatcagcgtgggcttcatcggctaccccaacgtgggcaagagcagcgtgatcaacaccctgagaagcaagaaggtgtgcaacgtggcccccatcgccggcgagaccaaggtgagcatcctgctgtag

SEQ ID NO: 83951 - DNA, 1614 bp, Artificial Sequence
  Description of Artificial Sequence: Synthetic coding sequence
atgacctgccacaagagatacaagatccagaagaaggtgagagagcaccacagaaagctgagaaaggaggccaagaagagaggccacaagaagcccagaaaggaccccggcgtgcccaacagcgcccccttcaaggaggccctgctgagagaggccgagctgagaaagcagagactggaggagctgaagcagcagcagaagctggacagacagaaggagctggagaagaagagaaagctggagaccaaccccgacatcaagcccagcaacgtggagcccatggagaaggagttcggcctgtgcaagaccgagaacaaggccaagagcggcaagcagaacagcaagaagctgtactgccaggagctgaagaaggtgatcgaggccagcgacgtggtgctggaggtgctggacgccagagaccccctgggctgcagatgcccccaggtggaggaggccatcgtgcagagcggccagaagaagctggtgctgatcctgaacaagagcgacctggtgcccaaggagaacctggagagctggctgaactacctgaagaaggagctgcccaccgtggtgttcagagccagcaccaagcccaaggacaagggcaagatcaccaagagagtgaaggccaagaagaacgccgcccccttcagaagcgaggtgtgcttcggcaaggagggcctgtggaagctgctgggcggcttccaggagacctgcagcaaggccatcagagtgggcgtgatcggcttccccaacgtgggcaagagcagcatcatcaacagcctgaagcaggagcagatgtgcaacgtgggcgtgagcatgggcctgaccagaagcatgcaggtggtgcccctggacaagcagatcaccatcatcgacagccccagcttcatcgtgagccccctgaacagcagcagcgccctggccctgagaagccccgccagcatcgaggtggtgaagcccatggaggccgccagcgccatcctgagccaggccgacgccagacaggtggtgctgaagtacaccgtgcccggctacagaaacagcctggagttcttcaccgtgctggcccagagaagaggcatgcaccagaagggcggcatccccaacgtggagggcgccgccaagctgctgtggagcgagtggaccggcgccagcctggcctactactgccacccccccaccagctggaccccccccccctacttcaacgagagcatcgtggtggacatgaagagcggcttcaacctggaggagctggagaagaacaacgcccagagcatcagagccatcaagggcccccacctggccaacagcatcctgttccagagcagcggcctgaccaacggcatcatcgaggagaaggacatccacgaggagctgcccaagagaaaggagagaaagcaggaggagagagaggacgacaaggacagcgaccaggagaccgtggacgaggaggtggacgagaacagcagcggcatgttcgccgccgaggagaccggcgaggccctgagcgaggagaccaccgccggcgagcagagcaccagaagcttcatcctggacaagatcatcgaggaggacgacgcctacgacttcagcaccgactacgtgtag

SEQ ID NO: 83952 - DNA, 1650 bp, Artificial Sequence
  Description of Artificial Sequence: Synthetic coding sequence
atgaagagacccaagctgaagaaggccagcaagagaatgacctgccacaagagatacaagatccagaagaaggtgagagagcaccacagaaagctgagaaaggaggccaagaagagaggccacaagaagcccagaaaggaccccggcgtgcccaacagcgcccccttcaaggaggccctgctgagagaggccgagctgagaaagcagagactggaggagctgaagcagcagcagaagctggacagacagaaggagctggagaagaagagaaagctggagaccaaccccgacatcaagcccagcaacgtggagcccatggagaaggagttcggcctgtgcaagaccgagaacaaggccaagagcggcaagcagaacagcaagaagctgtactgccaggagctgaagaaggtgatcgaggccagcgacgtggtgctggaggtgctggacgccagagaccccctgggctgcagatgcccccaggtggaggaggccatcgtgcagagcggccagaagaagctggtgctgatcctgaacaagagcgacctggtgcccaaggagaacctggagagctggctgaactacctgaagaaggagctgcccaccgtggtgttcagagccagcaccaagcccaaggacaagggcaagatcaccaagagagtgaaggccaagaagaacgccgcccccttcagaagcgaggtgtgcttcggcaaggagggcctgtggaagctgctgggcggcttccaggagacctgcagcaaggccatcagagtgggcgtgatcggcttccccaacgtgggcaagagcagcatcatcaacagcctgaagcaggagcagatgtgcaacgtgggcgtgagcatgggcctgaccagaagcatgcaggtggtgcccctggacaagcagatcaccatcatcgacagccccagcttcatcgtgagccccctgaacagcagcagcgccctggccctgagaagccccgccagcatcgaggtggtgaagcccatggaggccgccagcgccatcctgagccaggccgacgccagacaggtggtgctgaagtacaccgtgcccggctacagaaacagcctggagttcttcaccgtgctggcccagagaagaggcatgcaccagaagggcggcatccccaacgtggagggcgccgccaagctgctgtggagcgagtggaccggcgccagcctggcctactactgccacccccccaccagctggaccccccccccctacttcaacgagagcatcgtggtggacatgaagagcggcttcaacctggaggagctggagaagaacaacgcccagagcatcagagccatcaagggcccccacctggccaacagcatcctgttccagagcagcggcctgaccaacggcatcatcgaggagaaggacatccacgaggagctgcccaagagaaaggagagaaagcaggaggagagagaggacgacaaggacagcgaccaggagaccgtggacgaggaggtggacgagaacagcagcggcatgttcgccgccgaggagaccggcgaggccctgagcgaggagaccaccgccggcgagcagagcaccagaagcttcatcctggacaagatcatcgaggaggacgacgcctacgacttcagcaccgactacgtgtag

SEQ ID NO: 83953 - DNA, 291 bp, Artificial Sequence
  Description of Artificial Sequence: Synthetic coding sequence
atgacctgccacaagagatacaagatccagaagaaggtgagagagcaccacagaaagctgagaaaggaggccaagaagagaggccacaagaagcccagaaaggaccccggcgtgcccaacagcgcccccttcaaggaggccctgctgagagaggccgagctgagaaagcagagactggaggagctgaagcagcagcagaagctggacagacagaaggagctggagaagaagagaaagctggagaccaaccccgacatcaagcccagcaacgtggagcccatggagaagtag

SEQ ID NO: 83954 - DNA, 408 bp, Artificial Sequence
  Description of Artificial Sequence: Synthetic coding sequence
atgacctgccacaagagatacaagatccagaagaaggtgagagagcaccacagaaagctgagaaaggaggccaagaagagaggccacaagaagcccagaaaggaccccggcgtgcccaacagcgcccccttcaaggaggccctgctgagagaggccgagctgagaaagcagagactggaggagctgaagcagcagcagaagctggacagacagaaggagctggagaagaagagaaagctggagaccaaccccgacatcaagcccagcaacgtggagcccatggagaaggagttcggcctgtgcaagaccgagaacaaggccaagagcggcaagcagaacagcaagaagctgtactgccaggagctgaagaaggtgatcgaggccagcgacgtggtgctggaggtgtag

SEQ ID NO: 83955 - DNA, 417 bp, Artificial Sequence
  Description of Artificial Sequence: Synthetic coding sequence
atgaagagacccaagctgaagaaggccagcaagagaatgacctgccacaagagatacaagatccagaagaaggtgagagagcaccacagaaagctgagaaaggaggccaagaagagaggccacaagaagcccagaaaggaccccggcgtgcccaacagcgcccccttcaaggaggccctgctgagagaggccgagctgagaaagcagagactggaggagctgaagcagcagcagaagctggacagacagaaggagctggagaagaagagaaagctggagaccaaccccgacatcaagcccagcaacgtggagcccatggagaaggagttcggcctgtgcaagaccgagaacaaggccaagagcggcaagcagaacagcaagaagctgtactgccaggagctgaagaaggtgagctag

SEQ ID NO: 83956 - DNA, 1038 bp, Artificial Sequence
  Description of Artificial Sequence: Synthetic coding sequence
atgcccagaatcgacgccgacctgaagctggacttcaaggacgtgctgctgagacccaagagaagcagcctgaagagcagagccgaggtggacctggagagaaccttcaccttcagaaacagcaagcagacctacagcggcatccccatcatcgtggccaacatggacaccgtgggcaccttcgagatggccgccgtgatgagccagcacagcatgttcaccgccatccacaagcactacagcctggacgactggaagctgttcgccaccaaccaccccgagtgcctgcagaacgtggccgtgagcagcggcagcggccagaacgacctggagaagatgaccagcatcctggaggccgtgccccaggtgaagttcatctgcctggacgtggccaacggctacagcgagcacttcgtggagttcgtgaagctggtgagagccaagttccccgagcacaccatcatggccggcaacgtggtgaccggcgagatggtggaggagctgatcctgagcggcgccgacatcatcaaggtgggcgtgggccccggcagcgtgtgcaccaccagaaccaagaccggcgtgggctacccccagctgagcgccgtgatcgagtgcgccgacagcgcccacggcctgaagggccacatcatcagcgacggcggctgcacctgccccggcgacgtggccaaggccttcggcgccggcgccgacttcgtgatgctgggcggcatgttcagcggccacaccgagtgcgccggcgaggtgttcgagagaaacggcagaaagctgaagctgttctacggcatgagcagcgacaccgccatgaacaagcacgccggcggcgtggccgagtacagagccagcgagggcaagaccgtggaggtgccctacaagggcgacgtggagaacaccatcctggacatcctgggcggcctgagaagcacctgcacctacgtgggcgccgccaagctgaaggagctgagcagaagagccaccttcatcagagtgacccagcagcacaacaccgtgttcagctag

SEQ ID NO: 83957 - DNA, 1230 bp, Artificial Sequence
  Description of Artificial Sequence: Synthetic coding sequence
atgccccacatcgacaacgacgtgaagctggacttcaaggacgtgctgctgagacccaagagaagcaccctgaagagcagaagcgaggtggacctgaccagaagcttcagcttcagaaacagcaagcagacctacagcggcgtgcccatcatcgccgccaacatggacaccgtgggcaccttcgagatggccaaggtgctgtgcaagttcagcctgttcaccgccgtgcacaagcactacagcctggtgcagtggcaggagttcgccggccagaaccccgactgcctggagcacctggccgccagcagcggcaccggcagcagcgacttcgagcagctggagcagatcctggaggccatcccccaggtgaagtacatctgcctggacgtggccaacggctacagcgagcacttcgtggagttcgtgaaggacgtgagaaagagattcccccagcacaccatcatggccggcaacgtggtgaccggcgagatggtggaggagctgatcctgagcggcgccgacatcatcaaggtgggcatcggccccggcagcgtgtgcaccaccagaaagaagaccggcgtgggctacccccagctgagcgccgtgatggagtgcgccgacgccgcccacggcctgaagggccacatcatcagcgacggcggctgcagctgccccggcgacgtggccaaggccttcggcgccggcgccgacttcgtgatgctgggcggcatgctggccggccacagcgagagcggcggcgagctgatcgagagagacggcaagaagtacaagctgttctacggcatgagcagcgagatggccatgaagaagtacgccggcggcgtggccgagtacagatacgtgtggagacccagaagcctggtgatcgtgtggagacagaacagctggctgctgagaggcggctggtacagcagccagagaagcatggtgaacagaggcagcatgctgggcagcgtggagaagagcctgggcctgagaaaccccgagggcgaggacaacaaggtgttccccaccctgagagccagcgagggcaagaccgtggaggtgcccttcaagggcgacgtggagcacaccatcagagacatcctgggcggcatcagaagcacctgcacctacgtgggcgccgccaagctgaaggagctgagcagaagaaccaccttcatcagagtgacccagcaggtgaaccccatcttcagcgaggcctgctag

SEQ ID NO: 83958 - DNA, 1047 bp, Artificial Sequence
  Description of Artificial Sequence: Synthetic coding sequence
atgccccacatcgacaacgacgtgaagctggacttcaaggacgtgctgctgagacccaagagaagcaccctgaagagcagaagcgaggtggacctgaccagaagcttcagcttcagaaacagcaagcagacctacagcggcgtgcccatcatcgccgccaacatggacaccgtgggcaccttcgagatggccaaggtgctgtgcaagttcagcctgttcaccgccgtgcacaagcactacagcctggtgcagtggcaggagttcgccggccagaaccccgactgcctggagcacctggccgccagcagcggcaccggcagcagcgacttcgagcagctggagcagatcctggaggccatcccccaggtgaagtacatctgcctggacgtggccaacggctacagcgagcacttcgtggagttcgtgaaggacgtgagaaagagattcccccagcacaccatcatggccggcaacgtggtgaccggcgagatggtggaggagctgatcctgagcggcgccgacatcatcaaggtgggcatcggccccggcagcgtgtgcaccaccagaaagaagaccggcgtgggctacccccagctgagcgccgtgatggagtgcgccgacgccgcccacggcctgaagggccacatcatcagcgacggcggctgcagctgccccggcgacgtggccaaggccttcggcgccggcgccgacttcgtgatgctgggcggcatgctggccggccacagcgagagcggcggcgagctgatcgagagagacggcaagaagtacaagctgttctacggcatgagcagcgagatggccatgaagaagtacgccggcggcgtggccgagtacagagccagcgagggcaagaccgtggaggtgcccttcaagggcgacgtggagcacaccatcagagacatcctgggcggcatcagaagcacctgcacctacgtgggcgccgccaagctgaaggagctgagcagaagaaccaccttcatcagagtgacccagcaggtgaaccccatcttcagcgaggcctgctag

SEQ ID NO: 83959 - DNA, 1047 bp, Artificial Sequence; identical to SEQ ID NO: 83958
  Description of Artificial Sequence: Synthetic coding sequence

SEQ ID NO: 83960 - DNA, 1101 bp, Artificial Sequence
  Description of Artificial Sequence: Synthetic coding sequence
atgaccagctgcctgcccgccctgagattcatcgccacccccagactgagcgccatgccccacatcgacaacgacgtgaagctggacttcaaggacgtgctgctgagacccaagagaagcaccctgaagagcagaagcgaggtggacctgaccagaagcttcagcttcagaaacagcaagcagacctacagcggcgtgcccatcatcgccgccaacatggacaccgtgggcaccttcgagatggccaaggtgctgtgcaagttcagcctgttcaccgccgtgcacaagcactacagcctggtgcagtggcaggagttcgccggccagaaccccgactgcctggagcacctggccgccagcagcggcaccggcagcagcgacttcgagcagctggagcagatcctggaggccatcccccaggtgaagtacatctgcctggacgtggccaacggctacagcgagcacttcgtggagttcgtgaaggacgtgagaaagagattcccccagcacaccatcatggccggcaacgtggtgaccggcgagatggtggaggagctgatcctgagcggcgccgacatcatcaaggtgggcatcggccccggcagcgtgtgcaccaccagaaagaagaccggcgtgggctacccccagctgagcgccgtgatggagtgcgccgacgccgcccacggcctgaagggccacatcatcagcgacggcggctgcagctgccccggcgacgtggccaaggccttcggcgccggcgccgacttcgtgatgctgggcggcatgctggccggccacagcgagagcggcggcgagctgatcgagagagacggcaagaagtacaagctgttctacggcatgagcagcgagatggccatgaagaagtacgccggcggcgtggccgagtacagagccagcgagggcaagaccgtggaggtgcccttcaagggcgacgtggagcacaccatcagagacatcctgggcggcatcagaagcacctgcacctacgtgggcgccgccaagctgaaggagctgagcagaagaaccaccttcatcagagtgacccagcaggtgaaccccatcttcagcgaggcctgctag

SEQ ID NO: 83961 - DNA, 1047 bp, Artificial Sequence
  Description of Artificial Sequence: Synthetic coding sequence
atgccccacatcgacaacgacgtgaagctggacttcaaggacgtgctgctgagacccaagagaagcaccctgaagagcagaagcgaggtggacctgaccagaagcttcagcttcagaaacagcaagcagacctacagcggcgtgcccatcatcgccgccaacatggacaccgtgggcaccttcgagatggccaaggtgctgtgcaagttcagcctgttcaccgccgtgcacaagcactacagcctggtgcagtggcaggagttcgccggccagaaccccgactgcctggagagcatctggctgcccgcccaggcccaggccctgctgaccctgagcagctggaacagaagctggaagctgttccccagaaagtacatctgcctggacgtggccaacggctacagcgagcacttcgtggagttcgtgaaggacgtgagaaagagattcccccagcacaccatcatggccggcaacgtggtgaccggcgagatggtggaggagctgatcctgagcggcgccgacatcatcaaggtgggcatcggccccggcagcgtgtgcaccaccagaaagaagaccggcgtgggctacccccagctgagcgccgtgatggagtgcgccgacgccgcccacggcctgaagggccacatcatcagcgacggcggctgcagctgccccggcgacgtggccaaggccttcggcgccggcgccgacttcgtgatgctgggcggcatgctggccggccacagcgagagcggcggcgagctgatcgagagagacggcaagaagtacaagctgttctacggcatgagcagcgagatggccatgaagaagtacgccggcggcgtggccgagtacagagccagcgagggcaagaccgtggaggtgcccttcaagggcgacgtggagcacaccatcagagacatcctgggcggcatcagaagcacctgcacctacgtgggcgccgccaagctgaaggagctgagcagaagaaccaccttcatcagagtgacccagcaggtgaaccccatcttcagcgaggcctgctag

SEQ ID NO: 83962 - DNA, 1047 bp, Artificial Sequence; identical to SEQ ID NO: 83958
  Description of Artificial Sequence: Synthetic coding sequence

SEQ ID NO: 83963 - DNA, 1779 bp, Artificial Sequence
  Description of Artificial Sequence: Synthetic coding sequence
atggccagcgagatccacatgaccggccccatgtgcctgatcgagaacaccaacggcagactgatggccaaccccgaggccctgaagatcctgagcgccatcacccagcccatggtggtggtggccatcgtgggcctgtacagaaccggcaagagctacctgatgaacaagctggccggcaagaagaagggcttcagcctgggcagcaccgtgcagagccacaccaagggcatctggatgtggtgcgtgccccaccccaagaagcccggccacatcctggtgctgctggacaccgagggcctgggcgacgtggagaagggcgacaaccagaacgacagctggatcttcgccctggccgtgctgctgagcagcaccttcgtgtacaacagcatcggcaccatcaaccagcaggccatggaccagctgtactacgtgaccgagctgacccacagaatcagaagcaagagcagccccgacgagaacgagaacgaggtggaggacagcgccgacttcgtgagcttcttccccgacttcgtgtggaccctgagagacttcagcctggacctggaggccgacggccagcccctgacccccgacgagtacctgacctacagcctgaagctgaagaagggcaccagccagaaggacgagaccttcaacctgcccagactgtgcatcagaaagttcttccccaagaagaagtgcttcgtgttcgacagacccgtgcacagaagaaagctggcccagctggagaagctgcaggacgaggagctggaccccgagttcgtgcagcaggtggccgacttctgcagctacatcttcagcaacagcaagaccaagaccctgagcggcggcatccaggtgaacggccccagactggagagcctggtgctgacctacgtgaacgccatcagcagcggcgacctgccctgcatggagaacgccgtgctggccctggcccagatcgagaacagcgccgccgtgcagaaggccatcgcccactacgagcagcagatgggccagaaggtgcagctgcccaccgagaccctgcaggagctgctggacctgcacagagacagcgagagagaggccatcgaggtgttcatcagaagcagcttcaaggacgtggaccacctgttccagaaggagctggccgcccagctggagaagaagagagacgacttctgcaagcagaaccaggaggccagcagcgacagatgcagcgccctgctgcaggtgatcttcagccccctggaggaggaggtgaaggccggcatctacagcaagcccggcggctacagactgttcgtgcagaagctgcaggacctgaagaagaagtactacgaggagcccagaaagggcatccaggccgaggagatcctgcagacctacctgaagagcaaggagagcatgaccgacgccatcctgcagaccgaccagaccctgaccgagaaggagaaggagatcgaggtggagagagtgaaggccgagagcgcccaggccagcgccaagatgctgcaggagatgcagagaaagaacgagcagatgatggagcagaaggagagaagctaccaggagcacctgaagcagctgaccgagaagatggagaacgacagagtgcagctgctgaaggagcaggagagaaccctggccctgaagctgcaggagcaggagcagctgctgaaggagggcttccagaaggagagcagaatcatgaagaacgagatccaggacctgcagaccaagatgagaagaagaaaggcctgcaccatcagctag

SEQ ID NO: 83964 - DNA, 1668 bp, Artificial Sequence
  Description of Artificial Sequence: Synthetic coding sequence
atggtggtggtggccatcgtgggcctgtacagaaccggcaagagctacctgatgaacaagctggccggcaagaagaagggcttcagcctgggcagcaccgtgcagagccacaccaagggcatctggatgtggtgcgtgccccaccccaagaagcccggccacatcctggtgctgctggacaccgagggcctgggcgacgtggagaagggcgacaaccagaacgacagctggatcttcgccctggccgtgctgctgagcagcaccttcgtgtacaacagcatcggcaccatcaaccagcaggccatggaccagctgtactacgtgaccgagctgacccacagaatcagaagcaagagcagccccgacgagaacgagaacgaggtggaggacagcgccgacttcgtgagcttcttccccgacttcgtgtggaccctgagagacttcagcctggacctggaggccgacggccagcccctgacccccgacgagtacctgacctacagcctgaagctgaagaagggcaccagccagaaggacgagaccttcaacctgcccagactgtgcatcagaaagttcttccccaagaagaagtgcttcgtgttcgacagacccgtgcacagaagaaagctggcccagctggagaagctgcaggacgaggagctggaccccgagttcgtgcagcaggtggccgacttctgcagctacatcttcagcaacagcaagaccaagaccctgagcggcggcatccaggtgaacggccccagactggagagcctggtgctgacctacgtgaacgccatcagcagcggcgacctgccctgcatggagaacgccgtgctggccctggcccagatcgagaacagcgccgccgtgcagaaggccatcgcccactacgagcagcagatgggccagaaggtgcagctgcccaccgagaccctgcaggagctgctggacctgcacagagacagcgagagagaggccatcgaggtgttcatcagaagcagcttcaaggacgtggaccacctgttccagaaggagctggccgcccagctggagaagaagagagacgacttctgcaagcagaaccaggaggccagcagcgacagatgcagcgccctgctgcaggtgatcttcagccccctggaggaggaggtgaaggccggcatctacagcaagcccggcggctacagactgttcgtgcagaagctgcaggacctgaagaagaagtactacgaggagcccagaaagggcatccaggccgaggagatcctgcagacctacctgaagagcaaggagagcatgaccgacgccatcctgcagaccgaccagaccctgaccgagaaggagaaggagatcgaggtggagagagtgaaggccgagagcgcccaggccagcgccaagatgctgcaggagatgcagagaaagaacgagcagatgatggagcagaaggagagaagctaccaggagcacctgaagcagctgaccgagaagatggagaacgacagagtgcagctgctgaaggagcaggagagaaccctggccctgaagctgcaggagcaggagcagctgctgaaggagggcttccagaaggagagcagaatcatgaagaacgagatccaggacctgcagaccaagatgagaagaagaaaggcctgcaccatcagctag

SEQ ID NO: 83965 - DNA, 1776 bp, Artificial Sequence
  Description of Artificial Sequence: Synthetic coding sequence
atggcccccgagatcaacctgcccggccccatgagcctgatcgacaacaccaagggccagctggtggtgaaccccgaggccctgaagatcctgagcgccatcacccagcccgtggtggtggtggccatcgtgggcctgtacagaaccggcaagagctacctgatgaacaagctggccggcaagaagaacggcttcagcctgggcagcaccgtgaagagccacaccaagggcatctggatgtggtgcgtgccccaccccaagaagcccgagcacaccctggtgctgctggacaccgagggcctgggcgacatcgagaagggcgacaacgagaacgacagctggatcttcgccctggccatcctgctgagcagcaccttcgtgtacaacagcatgggcaccatcaaccagcaggccatggaccagctgcactacgtgaccgagctgaccgacagaatcaaggccaacagcagccccggcaacaacagcgtggacgacagcgccgacttcgtgagcttcttccccgccttcgtgtggaccctgagagacttcaccctggagctggaggtggacggcgagcccatcaccgccgacgactacctggagctgagcctgaagctgagaaagggcaccgacaagaagagcaagagcttcaacgaccccagactgtgcatcagaaagttcttccccaagagaaagtgcttcgtgttcgactggcccgcccccaagaagtacctggcccacctggagcagctgaaggaggaggagctgaaccccgacttcatcgagcaggtggccgagttctgcagctacatcctgagccacagcaacgtgaagaccctgagcggcggcatccccgtgaacggccccagactggagagcctggtgctgacctacgtgaacgccatcagcagcggcgacctgccctgcatggagaacgccgtgctggccctggcccagatcgagaacagcgccgccgtggagaaggccatcgcccactacgagcagcagatgggccagaaggtgcagctgcccaccgagaccctgcaggagctgctggacctgcacagagacagcgagagagaggccatcgaggtgttcatgaagaacagcttcaaggacgtggaccagatgttccagagaaagctgggcgcccagctggaggccagaagagacgacttctgcaagcagaacagcaaggccagcagcgactgctgcatggccctgctgcaggacatcttcggccccctggaggaggacgtgaagcagggcaccttcagcaagcccggcggctacagactgttcacccagaagctgcaggagctgaagaacaagtactaccaggtgcccagaaagggcatccaggccaaggaggtgctgaagaagtacctggagagcaaggaggacgtggccgacgccctgctgcagaccgaccagagcctgagcgagaaggagaaggccatcgaggtggagagaatcaaggccgagagcgccgaggccgccaagaagatgctggaggagatccagaagaagaacgaggagatgatggagcagaaggagaagagctaccaggagcacgtgaagcagctgaccgagaagatggagagagacagagcccagctgatggccgagcaggagaagaccctggccctgaagctgcaggagcaggagagactgctgaaggagggcttcgagaacgagagcaagagactgcagaaggacatctgggacatccagatgagaagcaagagcctggagcccatctgcaacatcctgtag

SEQ ID NO: 83966 - DNA, 1776 bp, Artificial Sequence; identical to SEQ ID NO: 83965
  Description of Artificial Sequence: Synthetic coding sequence

SEQ ID NO: 83967 - DNA, 1323 bp, Artificial Sequence
  Description of Artificial Sequence: Synthetic coding sequence
atggcccccgagatccacatgaccggccccatgtgcctgatcgagaacaccaacggcgagctggtggccaaccccgaggccctgaagatcctgagcgccatcacccagcccgtggtggtggtggccatcgtgggcctgtacagaaccggcaagagctacctgatgaacaagctggccggcaagaacaagggcttcagcctgggcagcaccgtgaagagccacaccaagggcatctggatgtggtgcgtgccccaccccaagaagcccgagcacaccctggtgctgctggacaccgagggcctgggcgacgtgaagaagggcgacaaccagaacgacagctggatcttcaccctggccgtgctgctgagcagcaccctggtgtacaacagcatgggcaccatcaaccagcaggccatggaccagctgtactacgtgaccgagctgacccacagaatcagaagcaagagcagccccgacgagaacgagaacgaggacagcgccgacttcgtgagcttcttccccgacttcgtgtggaccctgagagacttcagcctggacctggaggccgacggccagcccctgacccccgacgagtacctggagtacagcctgaagctgacccagggcaccagccagaaggacaagaacttcaacctgcccagactgtgcatcagaaagttcttccccaagaagaagtgcttcgtgttcgacctgcccatccacagaagaaagctggcccagctggagaagctgcaggacgaggagctggaccccgagttcgtgcagcaggtggccgacttctgcagctacatcttcagcaacagcaagaccaagaccctgagcggcggcatcaaggtgaacggccccagactggagagcctggtgctgacctacatcaacgccatcagcagaggcgacctgccctgcatggagaacgccgtgctggccctggcccagatcgagaacagcgccgccgtgcagaaggccatcgcccactacgaccagcagatgggccagaaggtgcagctgcccgccgagaccctgcaggagctgctggacctgcacagagtgagcgagagagaggccaccgaggtgtacatgaagaacagcttcaaggacgtggaccacctgttccagaagaagctggccgcccagctggacaagaagagagacgacttctgcaagcagaaccaggaggccagcagcgacagatgcagcgccctgctgcaggtgatcttcagccccctggaggaggaggtgaaggccggcatctacagcaagcccggcggctactgcctgttcatccagaagctgcaggactag

SEQ ID NO: 83968 - DNA, 1788 bp, Artificial Sequence
  Description of Artificial Sequence: Synthetic coding sequence
atggcccccgagatccacatgaccggccccatgtgcctgatcgagaacaccaacggcgagctggtggccaaccccgaggccctgaagatcctgagcgccatcacccagcccgtggtggtggtggccatcgtgggcctgtacagaaccggcaagagctacctgatgaacaagctggccggcaagaacaagggcttcagcctgggcagcaccgtgaagagccacaccaagggcatctggatgtggtgcgtgccccaccccaagaagcccgagcacaccctggtgctgctggacaccgagggcctgggcgacgtgaagaagggcgacaaccagaacgacagctggatcttcaccctggccgtgctgctgagcagcaccctggtgtacaacagcatgggcaccatcaaccagcaggccatggaccagctgtactacgtgaccgagctgacccacagaatcagaagcaagagcagccccgacgagaacgagaacgaggacagcgccgacttcgtgagcttcttccccgacttcgtgtggaccctgagagacttcagcctggacctggaggccgacggccagcccctgacccccgacgagtacctggagtacagcctgaagctgacccagggcaccagccagaaggacaagaacttcaacctgcccagactgtgcatcagaaagttcttccccaagaagaagtgcttcgtgttcgacctgcccatccacagaagaaagctggcccagctggagaagctgcaggacgaggagctggaccccgagttcgtgcagcaggtggccgacttctgcagctacatcttcagcaacagcaagaccaagaccctgagcggcggcatcaaggtgaacggccccagactggagagcctggtgctgacctacatcaacgccatcagcagaggcgacctgccctgcatggagaacgccgtgctggccctggcccagatcgagaacagcgccgccgtgcagaaggccatcgcccactacgaccagcagatgggccagaaggtgcagctgcccgccgagaccctgcaggagctgctggacctgcacagagtgagcgagagagaggccaccgaggtgtacatgaagaacagcttcaaggacgtggaccacctgttccagaagaagctggccgcccagctggacaagaagagagacgacttctgcaagcagaaccaggaggccagcagcgacagatgcagcgccctgctgcaggtgatcttcagccccctggaggaggaggtgaaggccggcatctacagcaagcccggcggctactgcctgttcatccagaagctgcaggacctggagaagaagtactacgaggagcccagaaagggcatccaggccgaggagatcctgcagacctacctgaagagcaaggagagcgtgaccgacgccatcctgcagaccgaccagatcctgaccgagaaggagaaggagatcgaggtggagtgcgtgaaggccgagagcgcccaggccagcgccaagatggtggaggagatgcagatcaagtaccagcagatgatggaggagaaggagaagagctaccaggagcacgtgaagcagctgaccgagaagatggagagagagagagcccagctgctggaggagcaggagaagaccctgaccagcaagctgcaggagcaggccagagtgctgaaggagagatgccagggcgagagcacccagctgcagaacgagatccagaagctgcagaagaccctgaagaagaagaccaagagatacatgagccacaagctgaagatctag

SEQ ID NO: 83969 - DNA, 1692 bp, Artificial Sequence
  Description of Artificial Sequence: Synthetic coding sequence
atggcccccgagatccacatgaccggccccatgtgcctgatcgagaacaccaacggcgagctggtggccaaccccgaggccctgaagatcctgagcgccatcacccagcccgtggtggtggtggccatcgtgggcctgtacagaaccggcaagagctacctgatgaacaagctggccggcaagaacaagggcttcagcctgggcagcaccgtgaagagccacaccaagggcatctggatgtggtgcgtgccccaccccaagaagcccgagcacaccctggtgctgctggacaccgagggcctgggcgacgtgaagaagggcgacaaccagaacgacagctggatcttcaccctggccgtgctgctgagcagcaccctggtgtacaacagcatgggcaccatcaaccagcaggccatggaccagctgtactacgtgaccgagctgacccacagaatcagaagcaagagcagccccgacgagaacgagaacgaggacagcgccgacttcgtgagcttcttccccgacttcgtgtggaccctgagagacttcagcctggacctggaggccgacggccagcccctgacccccgacgagtacctggagtacagcctgaagctgacccagggcaacagaaagctggcccagctggagaagctgcaggacgaggagctggaccccgagttcgtgcagcaggtggccgacttctgcagctacatcttcagcaacagcaagaccaagaccctgagcggcggcatcaaggtgaacggccccagactggagagcctggtgctgacctacatcaacgccatcagcagaggcgacctgccctgcatggagaacgccgtgctggccctggcccagatcgagaacagcgccgccgtgcagaaggccatcgcccactacgaccagcagatgggccagaaggtgcagctgcccgccgagaccctgcaggagctgctggacctgcacagagtgagcgagagagaggccaccgaggtgtacatgaagaacagcttcaaggacgtggaccacctgttccagaagaagctggccgcccagctggacaagaagagagacgacttctgcaagcagaaccaggaggccagcagcgacagatgcagcgccctgctgcaggtgatcttcagccccctggaggaggaggtgaaggccggcatctacagcaagcccggcggctactgcctgttcatccagaagctgcaggacctggagaagaagtactacgaggagcccagaaagggcatccaggccgaggagatcctgcagacctacctgaagagcaaggagagcgtgaccgacgccatcctgcagaccgaccagatcctgaccgagaaggagaaggagatcgaggtggagtgcgtgaaggccgagagcgcccaggccagcgccaagatggtggaggagatgcagatcaagtaccagcagatgatggaggagaaggagaagagctaccaggagcacgtgaagcagctgaccgagaagatggagagagagagagcccagctgctggaggagcaggagaagaccctgaccagcaagctgcaggagcaggccagagtgctgaaggagagatgccagggcgagagcacccagctgcagaacgagatccagaagctgcagaagaccctgaagaagaagaccaagagatacatgagccacaagctgaagatctag

SEQ ID NO: 83970 - DNA, 414 bp, Artificial Sequence
  Description of Artificial Sequence: Synthetic coding sequence
caggacgaggagctggaccccgagttcgtgcagcaggtggccgacttctgcagctacatcttcagcaacagcaagaccaagaccctgagcggcggcatcaaggccgaggagatcctgcagacctacctgaagagcaaggagagcgtgaccgacgccatcctgcagaccgaccagatcctgaccgagaaggagaaggagatcgaggtggagtgcgtgaaggccgagagcgcccaggccagcgccaagatggtggaggagatgcagatcaagtaccagcagatgatggaggagaaggagaagagctaccaggagcacgtgaagcagctgaccgagaagatggagagagagagagcccagctgctggaggagcaggagaagaccctgaccagcaagctgcaggtgagcaagtgctag

SEQ ID NO: 83971 - DNA, 1923 bp, Artificial Sequence
  Description of Artificial Sequence: Synthetic coding sequence
atgggcgagagaaccctgcacgccgccgtgcccacccccggctaccccgagagcgagagcatcatgatggcccccatctgcctggtggagaaccaggaggagcagctgaccgtgaacagcaaggccctggagatcctggacaagatcagccagcccgtggtggtggtggccatcgtgggcctgtacagaaccggcaagagctacctgatgaacagactggccggcaagagaaacggcttccccctgggcagcaccgtgcagagcgagaccaagggcatctggatgtggtgcgtgccccacctgagcaagcccaaccacaccctggtgctgctggacaccgagggcctgggcgacgtggagaagagcaaccccaagaacgacagctggatcttcgccctggccgtgctgctgagcagcagcttcgtgtacaacagcgtgagcaccatcaaccaccaggccctggagcagctgcactacgtgaccgagctggccgagctgatcagagccaagagctgccccagacccgacgaggccgaggacagcagcgagttcgccagcttcttccccgacttcatctggaccgtgagagacttcaccctggagctgaagctggacggcaaccccatcaccgaggacgagtacctggagaacgccctgaagctgatccccggcaagaaccccaagatccagaacagcaacatgcccagagagtgcatcagacacttcttcagaaagagaaagtgcttcgtgttcgacagacccaccaacgacaagcagtacctgaaccacatggacgaggtgcccgaggagaacctggagagacacttcctgatgcagagcgacaacttctgcagctacatcttcacccacgccaagaccaagaccctgagagagggcatcatcgtgaccggcaagagactgggcaccctggtggtgacctacgtggacgccatcaacagcggcgccgtgccctgcctggagaacgccgtgaccgccctggcccagctggagaaccccgccgccgtgcagagagccgccgaccactacagccagcagatggcccagcagctgagactgcccaccgacaccctgcaggagctgctggacgtgcacgccgcctgcgagagagaggccatcgccgtgttcatggagcacagcttcaaggacgagaaccacgagttccagaagaagctggtggacaccatcgagaagaagaagggcgacttcgtgctgcagaacgaggaggccagcgccaagtactgccaggccgagctgaagagactgagcgagcacctgaccgagagcatcctgagaggcatcttcagcgtgcccggcggccacaacctgtacctggaggagaagaagcaggtggagtgggactacaagctggtgcccagaaagggcgtgaaggccaacgaggtgctgcagaacttcctgcagagccaggtggtggtggaggagagcatcctgcagagcgacaaggccctgaccgccggcgagaaggccatcgccgccgagagagccatgaaggaggccgccgagaaggagcaggagctgctgagagagaagcagaaggagcagcagcagatgatggaggcccaggagagaagcttccaggagtacatggcccagatggagaagaagctggaggaggagagagagaacctgctgagagagcacgagagactgctgaagcacaagctgaaggtgcaggaggagatgctgaaggaggagttccagaagaagagcgagcagctgaacaaggagatcaaccagctgaaggagaagatcgagagcaccaagaacgagcagctgagactgctgaagatcctggacatggccagcaacatcatgatcgtgaccctgcccggcgccagcaagctgctgggcgtgggcaccaagtacctgggcagcagaatctag

SEQ ID NO: 83972 - DNA, 1761 bp, Artificial Sequence
  Description of Artificial Sequence: Synthetic coding sequence
atggccctggagatccacatgagcgaccccatgtgcctgatcgagaacttcaacgagcagctgaaggtgaaccaggaggccctggagatcctgagcgccatcacccagcccgtggtggtggtggccatcgtgggcctgtacagaaccggcaagagctacctgatgaacaagctggccggcaagaacaagggcttcagcgtggccagcaccgtgcagagccacaccaagggcatctggatctggtgcgtgccccaccccaactggcccaaccacaccctggtgctgctggacaccgagggcctgggcgacgtggagaaggccgacaacaagaacgacatccagatcttcgccctggccctgctgctgagcagcaccttcgtgtacaacaccgtgaacaagatcgaccagggcgccatcgacctgctgcacaacgtgaccgagctgaccgacctgctgaaggccagaaacagccccgacctggacagagtggaggaccccgccgacagcgccagcttcttccccgacctggtgtggaccctgagagacttctgcctgggcctggagatcgacggccagctggtgacccccgacgagtacctggagaacagcctgagacccaagcagggcagcgaccagagagtgcagaacttcaacctgcccagactgtgcatccagaagttcttccccaagaagaagtgcttcatcttcgacctgcccgcccaccagaagaagctggcccagctggagaccctgcccgacgacgagctggagcccgagttcgtgcagcaggtgaccgagttctgcagctacatcttcagccacagcatgaccaagaccctgcccggcggcatcatggtgaacggcagcagactgaagaacctggtgctgacctacgtgaacgccatcagcagcggcgacctgccctgcatcgagaacgccgtgctggccctggcccagagagagaacagcgccgccgtgcagaaggccatcgcccactacgaccagcagatgggccagaaggtgcagctgcccatggagaccctgcaggagctgctggacctgcacagaaccagcgagagagaggccatcgaggtgttcatgaagaacagcttcaaggacgtggaccagagcttccagaaggagctggagaccctgctggacgccaagcagaacgacatctgcaagagaaacctggaggccagcagcgactactgcagcgccctgctgaaggacatcttcggccccctggaggaggccgtgaagcagggcatctacagcaagcccggcggccacaacctgttcatccagaagaccgaggagctgaaggccaagtactacagagagcccagaaagggcatccaggccgaggaggtgctgcagaagtacctgaagagcaaggagagcgtgagccacgccatcctgcagaccgaccaggccctgaccgagaccgagaagaagaagaaggaggcccaggtgaaggccgaggccgagaaggccgaggcccagagactggccgccatccagagacagaacgagcagatgatgcaggagagagagagactgcaccaggagcaggtgagacagatggagatcgccaagcagaactggctggccgagcagcagaagatgcaggagcagcagatgcaggagcaggccgcccagctgagcaccaccttccaggcccagaacagaagcctgctgagcgagctgcagcacgcccagagaaccgtgaacaacgacgacccctgcgtgctgctgtag

SEQ ID NO: 83973 - DNA, 1761 bp, Artificial Sequence; identical to SEQ ID NO: 83972
  Description of Artificial Sequence: Synthetic coding sequence

SEQ ID NO: 83974 - DNA, 1452 bp, Artificial Sequence
  Description of Artificial Sequence: Synthetic coding sequence
atggccctggagatccacatgagcgaccccatgtgcctgatcgagaacttcaacgagcagctgaaggtgaaccaggaggccctggagatcctgagcgccatcacccagcccgtggtggtggtggccatcgtgggcctgtacagaaccggcaagagctacctgatgaacaagctggccggcaagaacaagggcttcagcgtggccagcaccgtgcagagccacaccaagggcatctggatctggtgcgtgccccaccccaactggcccaaccacaccctggtgctgctggacaccgagggcctgggcgacgtggagaaggccgacaacaagaacgacatccagatcttcgccctggccctgctgctgagcagcaccttcgtgtacaacaccgtgaacaagatcgaccagggcgccatcgacctgctgcacaacgtgaccgagctgaccgacctgctgaaggccagaaacagccccgacctggacagagtggaggaccccgccgacagcgccagcttcttccccgacctggtgtggaccctgagagacttctgcctgggcctggagatcgacggccagctggtgacccccgacgagtacctggagaacagcctgagacccaagcagggcagcgaccagagagtgcagaacttcaacctgcccagactgtgcatccagaagttcttccccaagaagaagtgcttcatcttcgacctgcccgcccaccagaagaagctggcccagctggagaccctgcccgacgacgagctggagcccgagttcgtgcagcaggtgaccgagttctgcagctacatcttcagccacagcatgaccaagaccctgcccggcggcatcatggtgaacggcagcagactgaagaacctggtgctgacctacgtgaacgccatcagcagcggcgacctgccctgcatcgagaacgccgtgctggccctggcccagagagagaacagcgccgccgtgcagaaggccatcgcccactacgaccagcagatgggccagaaggtgcagctgcccatggagaccctgcaggagctgctggacctgcacagaaccagcgagagagaggccatcgaggtgttcatgaagaacagcttcaaggacgtggaccagagcttccagaaggagctggagaccctgctggacgccaagcagaacgacatctgcaagagaaacctggaggccagcagcgactactgcagcgccctgctgaaggacatcttcggccccctggaggaggccgtgaagcagggcatctacagcaagcccggcggccacaacctgttcatccagaagaccgaggagctgaaggccaagtactacagagagcccagaaagggcatccaggccgaggaggtgctgcagaagtacctgaagagcaaggagagcgtgagccacgccatcctgcagaccgaccaggccctgaccgagacctag

SEQ ID NO: 83975 - DNA, 1917 bp, Artificial Sequence
  Description of Artificial Sequence: Synthetic coding sequence
atggccagcgagatccacatgcccggccccgtgtgcctgaccgagaacaccaagggccacctggtggtgaacagcgaggccctggagatcctgagcgccatcacccagcccgtggtggtggtggccatcgtgggcctgtacagaaccggcaagagctacctgatgaacaagctggccggcaagaacaagggcttccccctgggctgcaccgtgaagagcgagaccaagggcatctggatgtggtgcgtgccccaccccagcaagcccaaccacaccctgatcctgctggacaccgagggcctgggcgacatggagaagagcgaccccaagagcgacagctggatcttcgccctggccgtgctgctgagcagcagcttcgtgtacaacagcatgggcaccatcaaccaccaggccctggagcagctgcactacgtgaccgagctgaccgagctgatcagagccaagagctgccccagacccgacgaggtggaggacagcagcgagttcgtgagcttcttccccgacttcatctggaccgtgagagacttcaccctggagctgaagctggacggccaccccatcaccgaggacgagtacctggagaacgccctgaagctgatcagcggcaagaacccccagatccagaacagcaacaagcccagagagtggatcagacacttcttccccaagcagaagtgcttcgtgttcgacagacccatcaacgacaagaagctgctgctgcacgtggaggaggtgagagaggaccagctggacagcaacttccagatgcagagcgagaacttctgcagctacatcttcacccacgccaagaccaagaccctgagagagggcatcctggtgaccggcaacagactgggcatgctggtggagacctacctggacgccatcaacagcggcgccaccccctgcctggagaacgccatggccgtgctggcccagtgcgagaacagcgccgccgtgcagagagccgccaaccactacagccagcagatggcccagcaggtgagattccccaccgacaccctgcaggagctgctggacgtgcacgccgtgtgcgagagagaggccatcgccgtgttcatggagtacagcttcaaggacaagagccaggagttccagaagaagctggtggacaccatggagaagaagaaggaggacttcgtgctgcagaacgaggaggccagcgccaagtactgccaggccgagctgaagagactgagcgagctgctgaccgagagcatcagcagaggcaccttcttcgtgcccggcggccacaacatctacctggaggccaagaagaagatcgagcaggactacaccctggtgcccagaaagggcgtgaaggccgacgaggtgctgcagagcttcctgcagagccaggtggtgatcgaggagagcatcctgcagagcgacaaggccctgaccgccggcgagaaggccatcgccgccaagcaggccaagaaggaggccgccgagaaggagcaggagctgctgagacagaagcagaaggagcagcagcagatgatggaggcccaggagagaagcttccaggagaacatcgcccagctgaagaagaagatggagagagagagagagaactacatgagagagctgagaaagatgctgagccacaagatgaaggtgctggaggagctgctgaccgagggcttcaaggagatcttcgagagcctgaacgaggagatcaacagactgaaggagcagatcgaggccgccgagaacgaggagcccagcgtgttcagccagatcctggacgtggccggcagcatcttcatcgccgccctgcccggcgccgccaagctggtggacctgggcatgaagatcctgagcagcctgtgcaacagactgagaaaccccggcaagaagatcatcagctag

SEQ ID NO: 83976 - DNA, 1902 bp, Artificial Sequence
  Description of Artificial Sequence: Synthetic coding sequence
atggagagcggccccaagatgctggcccccgtgtgcctggtggagaacaacaacgagcagctgctggtgaaccagcaggccatccagatcctggagaagatcagccagcccgtggtggtggtggccatcgtgggcctgtacagaaccggcaagagctacctgatgaaccacctggccggccagaaccacggcttccccctgggcagcaccgtgcagagcgagaccaagggcatctggatgtggtgcgtgccccaccccagcaagcccaaccacaccctggtgctgctggacaccgagggcctgggcgacgtggagaagggcgaccccaagaacgacagctggatcttcgccctggccgtgctgctgtgcagcaccttcgtgtacaacagcatgagcaccatcaaccaccaggccctggagcagctgcactacgtgaccgagctgaccgagctgatcaaggccaagagcagccccagacccgacggcgtggaggacagcaccgagttcgtgagcttcttccccgacttcctgtggaccgtgagagacttcaccctggagctgaagctgaacggccaccccatcaccgaggacgagtacctggagaacgccctgaagctgatccagggcaacaaccccagagtgcagaccagcaacttccccagagagtgcatcagaagattcttccccaagagaaagtgcttcgtgttcgacagacccaccaacgacaaggacctgctggccaacatcgagaaggtgagcgagaagcagctggaccccaagttccaggagcagaccaacatcttctgcagctacatcttcacccacgccagaaccaagaccctgagagagggcatcaccgtgaccggcaacagactgggcaccctggccgtgacctacgtggaggccatcaacagcggcgccgtgccctgcctggagaacgccgtgatcaccctggcccagagagagaacagcgccgccgtgcagagagccgccgactactacagccagcagatggcccagagagtgaagctgcccaccgacaccctgcaggagctgctggacatgcacgccgcctgcgagagagaggccatcgccatcttcatggagcacagcttcaaggacgagaaccaggagttccagaagaagttcatggagaccaccatgaacaagaagggcgacttcctgctgcagaacgaggagagcagcgtgcagtactgccaggccaagctgaacgagctgagcaagggcctgatggagagcatcagcgccggcagcttcagcgtgcccggcggccacaagctgtacatggagaccaaggagagaatcgagcaggactactggcaggtgcccagaaagggcgtgaaggccaaggaggtgttccagagattcctggagagccagatggtgatcgaggagagcatcctgcagagcgacaaggccctgaccgacagagagaaggccgtggccgtggacagagccaagaaggaggccgccgagaaggagcaggagctgctgaagcagaagctgcaggagcagcagcagcagatggaggcccaggacaagagcagaaaggagaacatcgcccagctgaaggagaagctgcagatggagagagagcacctgctgagagagcagatcatgatgctggagcacacccagaaggtgcagaacgactggctgcacgagggcttcaagaagaagtacgaggagatgaacgccgagatcagccagttcaagagaatgatcgacaccaccaagaacgacgacaccccctggatcgccagaaccctggacaacctggccgacgagctgaccgccatcctgagcgcccccgccaagctgatcggccacggcgtgaagggcgtgagcagcctgttcaagaagcacaagctgcccttctag

SEQ ID NO: 83977 - DNA, 1512 bp, Artificial Sequence
  Description of Artificial Sequence: Synthetic coding sequence
atgagcaccatcaaccaccaggccctggagcagctgcactacgtgaccgagctgaccgagctgatcaaggccaagagcagccccagacccgacggcgtggaggacagcaccgagttcgtgagcttcttccccgacttcctgtggaccgtgagagacttcaccctggagctgaagctgaacggccaccccatcaccgaggacgagtacctggagaacgccctgaagctgatccagggcaacaaccccagagtgcagaccagcaacttccccagagagtgcatcagaagattcttccccaagagaaagtgcttcgtgttcgacagacccaccaacgacaaggacctgctggccaacatcgagaaggtgagcgagaagcagctggaccccaagttccaggagcagaccaacatcttctgcagctacatcttcacccacgccagaaccaagaccctgagagagggcatcaccgtgaccggcaacagactgggcaccctggccgtgacctacgtggaggccatcaacagcggcgccgtgccctgcctggagaacgccgtgatcaccctggcccagagagagaacagcgccgccgtgcagagagccgccgactactacagccagcagatggcccagagagtgaagctgcccaccgacaccctgcaggagctgctggacatgcacgccgcctgcgagagagaggccatcgccatcttcatggagcacagcttcaaggacgagaaccaggagttccagaagaagttcatggagaccaccatgaacaagaagggcgacttcctgctgcagaacgaggagagcagcgtgcagtactgccaggccaagctgaacgagctgagcaagggcctgatggagagcatcagcgccggcagcttcagcgtgcccggcggccacaagctgtacatggagaccaaggagagaatcgagcaggactactggcaggtgcccagaaagggcgtgaaggccaaggaggtgttccagagattcctggagagccagatggtgatcgaggagagcatcctgcagagcgacaaggccctgaccgacagagagaaggccgtggccgtggacagagccaagaaggaggccgccgagaaggagcaggagctgctgaagcagaagctgcaggagcagcagcagcagatggaggcccaggacaagagcagaaaggagaacatcgcccagctgaaggagaagctgcagatggagagagagcacctgctgagagagcagatcatgatgctggagcacacccagaaggtgcagaacgactggctgcacgagggcttcaagaagaagtacgaggagatgaacgccgagatcagccagttcaagagaatgatcgacaccaccaagaacgacgacaccccctggatcgccagaaccctggacaacctggccgacgagctgaccgccatcctgagcgcccccgccaagctgatcggccacggcgtgaagggcgtgagcagcctgttcaagaagcacaagctgcccttctag

SEQ ID NO: 83978 - DNA, 1815 bp, Artificial Sequence
  Description of Artificial Sequence: Synthetic coding sequence
atggagagcggccccaagatgctggcccccgtgtgcctggtggagaacaacaacgagcagctgctggtgaaccagcaggccatccagatcctggagaagatcagccagcccgtggtggtggtggccatcgtgggcctgtacagaaccggcaagagctacctgatgaaccacctggccggccagaaccacggcttccccctggacaccgagggcctgggcgacgtggagaagggcgaccccaagaacgacagctggatcttcgccctggccgtgctgctgtgcagcaccttcgtgtacaacagcatgagcaccatcaaccaccaggccctggagcagctgcactacgtgaccgagctgaccgagctgatcaaggccaagagcagccccagacccgacggcgtggaggacagcaccgagttcgtgagcttcttccccgacttcctgtggaccgtgagagacttcaccctggagctgaagctgaacggccaccccatcaccgaggacgagtacctggagaacgccctgaagctgatccagggcaacaaccccagagtgcagaccagcaacttccccagagagtgcatcagaagattcttccccaagagaaagtgcttcgtgttcgacagacccaccaacgacaaggacctgctggccaacatcgagaaggtgagcgagaagcagctggaccccaagttccaggagcagaccaacatcttctgcagctacatcttcacccacgccagaaccaagaccctgagagagggcatcaccgtgaccggcaacagactgggcaccctggccgtgacctacgtggaggccatcaacagcggcgccgtgccctgcctggagaacgccgtgatcaccctggcccagagagagaacagcgccgccgtgcagagagccgccgactactacagccagcagatggcccagagagtgaagctgcccaccgacaccctgcaggagctgctggacatgcacgccgcctgcgagagagaggccatcgccatcttcatggagcacagcttcaaggacgagaaccaggagttccagaagaagttcatggagaccaccatgaacaagaagggcgacttcctgctgcagaacgaggagagcagcgtgcagtactgccaggccaagctgaacgagctgagcaagggcctgatggagagcatcagcgccggcagcttcagcgtgcccggcggccacaagctgtacatggagaccaaggagagaatcgagcaggactactggcaggtgcccagaaagggcgtgaaggccaaggaggtgttccagagattcctggagagccagatggtgatcgaggagagcatcctgcagagcgacaaggccctgaccgacagagagaaggccgtggccgtggacagagccaagaaggaggccgccgagaaggagcaggagctgctgaagcagaagctgcaggagcagcagcagcagatggaggcccaggacaagagcagaaaggagaacatcgcccagctgaaggagaagctgcagatggagagagagcacctgctgagagagcagatcatgatgctggagcacacccagaaggtgcagaacgactggctgcacgagggcttcaagaagaagtacgaggagatgaacgccgagatcagccagttcaagagaatgatcgacaccaccaagaacgacgacaccccctggatcgccagaaccctggacaacctggccgacgagctgaccgccatcctgagcgcccccgccaagctgatcggccacggcgtgaagggcgtgagcagcctgttcaagaagcacaagctgcccttctag

SEQ ID NO: 83979 - DNA, 1299 bp, Artificial Sequence
  Description of Artificial Sequence: Synthetic coding sequence
atgaagagcaccaagcccagcctgagccccagcaagccccagagcagcctggtgatccccaccagcctgttctgcaagaccttccccttccacttcatgttcgacaaggacatgaccatcctgcagttcggcaacggcatcagaagactgatgaacagaagagacttccagggcaagcccaacttcgaggagtacttcgagatcctgacccccaagatcaaccagaccttcagcggcatcatgaccatgctgaacatgcagttcgtggtgagagtgagaagatgggacaacagcgtgaagaagagcagcagagtgatggacctgaagggccagatgatctacatcgtggagagcagcgccatcctgttcctgggcagcccctgcgtggacagactggaggacttcaccggcagaggcctgtacctgagcgacatccccatccacaacgccctgagagacgtggtgctgatcggcgagcaggccagagcccaggacggcctgaagaagagactgggcaagctgaaggccaccctggagcaggcccaccaggccctggaggaggagaagaagaagaccgtggacctgctgtgcagcatcttcccctgcgaggtggcccagcagctgtggcagggccaggtggtgcaggccaagaagttcagcaacgtgaccatgctgttcagcgacatcgtgggcttcaccgccatctgcagccagtgcagccccctgcaggtgatcaccatgctgaacgccctgtacaccagattcgaccagcagtgcggcgagctggacgtgtacaaggtggagaccatcggcgacgcctactgcgtggccggcggcctgcacaaggagagcgacacccacgccgtgcagatcgccctgatggccctgaagatgatggagctgagcgacgaggtgatgagcccccacggcgagcccatcaagatgagaatcggcctgcacagcggcagcgtgttcgccggcgtggtgggcgtgaagatgcccagatactgcctgttcggcaacaacgtgaccctggccaacaagttcgagagctgcagcgtgcccagaaagatcaacgtgagccccaccacctacagactgctgaaggactgccccggcttcgtgttcacccccagaagcagagaggagctgccccccaacttccccagcgagatccccggcatctgccacttcctggacgcctaccagcagggcaccaacagcaagccctgcttccagaagaaggacgtggaggacggcaacgccaacttcctgggcaaggccagcggcatcgactag

SEQ ID NO: 83980 - DNA, 1875 bp, Artificial Sequence
  Description of Artificial Sequence: Synthetic coding sequence
atgttctgcaccaagctgaaggacctgaagatcaccggcgagtgccccttcagcctgctggcccccggccaggtgcccaacgagagcagcgaggaggccgccggcagcagcgagagctgcaaggccaccgtgcccatctgccaggacatccccgagaagaacatccaggagagcctgccccagagaaagaccagcagaagcagagtgtacctgcacaccctggccgagagcatctgcaagctgatcttccccgagttcgagagactgaacgtggccctgcagagaaccctggccaagcacaagatcaaggagagcagaaagagcctggagagagaggacttcgagaagaccatcgccgagcaggccgtggccgccggcgtgcccgtggaggtgatcaaggagagcctgggcgaggaggtgttcaagatctgctacgaggaggacgagaacatcctgggcgtggtgggcggcaccctgaaggacttcctgaacagcttcagcaccctgctgaagcagagcagccactgccaggaggccggcaagagaggcagactggaggacgccagcatcctgtgcctggacaaggaggacgacttcctgcacgtgtactacttcttccccaagagaaccaccagcctgatcctgcccggcatcatcaaggccgccgcccacgtgctgtacgagaccgaggtggaggtgagcctgatgcccccctgcttccacaacgactgcagcgagttcgtgaaccagccctacctgctgtacagcgtgcacatgaagagcaccaagcccagcctgagccccagcaagccccagagcagcctggtgatccccaccagcctgttctgcaagaccttccccttccacttcatgttcgacaaggacatgaccatcctgcagttcggcaacggcatcagaagactgatgaacagaagagacttccagggcaagcccaacttcgaggagtacttcgagatcctgacccccaagatcaaccagaccttcagcggcatcatgaccatgctgaacatgcagttcgtggtgagagtgagaagatgggacaacagcgtgaagaagagcagcagagtgatggacctgaagggccagatgatctacatcgtggagagcagcgccatcctgttcctgggcagcccctgcgtggacagactggaggacttcaccggcagaggcctgtacctgagcgacatccccatccacaacgccctgagagacgtggtgctgatcggcgagcaggccagagcccaggacggcctgaagaagagactgggcaagctgaaggccaccctggagcaggcccaccaggccctggaggaggagaagaagaagaccgtggacctgctgtgcagcatcttcccctgcgaggtggcccagcagctgtggcagggccaggtggtgcaggccaagaagttcagcaacgtgaccatgctgttcagcgacatcgtgggcttcaccgccatctgcagccagtgcagccccctgcaggtgatcaccatgctgaacgccctgtacaccagattcgaccagcagtgcggcgagctggacgtgtacaaggtggagaccatcggcgacgcctactgcgtggccggcggcctgcacaaggagagcgacacccacgccgtgcagatcgccctgatggccctgaagatgatggagctgagcgacgaggtgatgagcccccacggcgagcccatcaagatgagaatcggcctgcacagcggcagcgtgttcgccggcgtggtgggcgtgaagatgcccagatactgcctgttcggcaacaacgtgaccctggccaacaagttcgagagctgcagcgtgcccagaaagatcaacgtgagccccaccacctacagatag

SEQ ID NO: 83981 - DNA, 2292 bp, Artificial Sequence
  Description of Artificial Sequence: Synthetic coding sequence
atgagcagaagaaagatcagcagcgagagcttcagcagcctgggcagcgactacctggagaccagccccgaggaggagggcgagtgccccctgagcagactgtgctggaacggcagcagaagcccccccggccccctggagcccagccccgccgccgccgccgccgccgccgcccccgcccccacccccgccgccagcgccgccgccgccgccgccaccgccggcgccagaagagtgcagagaagaagaagagtgaacctggacagcctgggcgagagcatcagcagactgaccgcccccagcccccagaccatccagcagaccctgaagagaaccctgcagtactacgagcaccaggtgatcggctacagagacgccgagaagaacttccacaacatcagcaacagatgcagctacgccgaccacagcaacaaggaggagatcgaggacgtgagcggcatcctgcagtgcaccgccaacatcctgggcctgaagttcgaggagatccagaagagattcggcgaggagttcttcaacatctgcttccacgagaacgagagagtgctgagagccgtgggcggcaccctgcaggacttcttcaacggcttcgacgccctgctggagcacatcagaaccagcttcggcaagcaggccaccctggagagccccagcttcctgtgcaaggagctgcccgagggcaccctgatgctgcactacttccacccccaccacatcgtgggcttcgccatgctgggcatgatcaaggccgccggcaagaagatctacagactggacgtggaggtggagcaggtggccaacgagaagctgtgcagcgacgtgagcaaccccggcaactgcagctgcctgaccttcctgatcaaggagtgcgagaacaccaacatcatgaagaacctgccccagggcaccagccaggtgcccgccgacctgagaatcagcatcaacaccttctgcagagccttccccttccacctgatgttcgaccccagcatgagcgtgctgcagctgggcgagggcctgagaaagcagctgagatgcgacacccacaaggtgctgaagttcgaggactgcttcgagatcgtgagccccaaggtgaacgccaccttcgagagagtgctgctgagactgagcacccccttcgtgatcagaaccaagcccgaggccagcggcagcgagaacaaggacaaggtgatggaggtgaagggccagatgatccacgtgcccgagagcaacagcatcctgttcctgggcagcccctgcgtggacaagctggacgagctgatgggcagaggcctgcacctgagcgacatccccatccacgacgccaccagagacgtgatcctggtgggcgagcaggccaaggcccaggacggcctgaagaagagaatggacaagctgaaggccaccctggagagaacccaccaggccctggaggaggagaagaagaagaccgtggacctgctgtacagcatcttccccggcgacgtggcccagcagctgtggcagggccagcaggtgcaggccagaaagttcgacgacgtgaccatgctgttcagcgacatcgtgggcttcaccgccatctgcgcccagtgcacccccatgcaggtgatcagcatgctgaacgagctgtacaccagattcgaccaccagtgcggcttcctggacatctacaaggtggagaccatcggcgacgcctactgcgtggccgccggcctgcacagaaagagcctgtgccacgccaagcccatcgccctgatggccctgaagatgatggagctgagcgaggaggtgctgacccccgacggcagacccatccagccccagagaagcgagctgctgttcagcttccccgtgagcatccagctggtgcccgaccagcaccagagcgagaccgacctgggcaccgagaagatgagaatcggcatccacagcggcagcgtgctggccggcgtggtgggcgtgagaatgcccagatactgcctgttcggcaacaacgtgaccctggccagcaagttcgagagcggcagccaccccagaagaatcaacgtgagccccaccacctaccagctgctgaagagagaggagagcttcaccttcatccccagaagcagagaggagctgcccgacaacttccccaaggagatccccggcatctgctacttcctggaggtgagaaccggccccaagccccccaagcccagcctgagcagcagcagaatcaagaaggtgagctacaacatcggcaccatgttcctgagagagaccagcctgtag

SEQ ID NO: 83982 - DNA, 2199 bp, Artificial Sequence
  Description of Artificial Sequence: Synthetic coding sequence
atgagcagaagaaagatcagcagcgagagcttcagcagcctgggcagcgactacctggagaccagccccgaggaggagggcgagtgccccctgagcagactgtgctggaacggcagcagaagcccccccggccccctggagcccagccccgccgccgccgccgccgccgccgcccccgcccccacccccgccgccagcgccgccgccgccgccgccaccgccggcgccagaagagtgcagagaagaagaagagtgaacctggacagcctgggcgagagcatcagcagactgaccgcccccagcccccagaccatccagcagaccctgaagagaaccctgcagtactacgagcaccaggtgatcggctacagagacgccgagaagaacttccacaacatcagcaacagatgcagctacgccgaccacagcaacaaggaggagatcgaggacgtgagcggcatcctgcagtgcaccgccaacatcctgggcctgaagttcgaggagatccagaagagattcggcgaggagttcttcaacatctgcttccacgagaacgagagagtgctgagagccgtgggcggcaccctgcaggacttcttcaacggcttcgacgccctgctggagcacatcagaaccagcttcggcaagcaggccaccctggagagccccagcttcctgtgcaaggagctgcccgagggcaccctgatgctgcactacttccacccccaccacatcgtgggcttcgccatgctgggcatgatcaaggccgccggcaagaagatctacagactggacgtggaggtggagcaggtggccaacgagaagctgtgcagcgacgtgagcaaccccggcaactgcagctgcctgaccttcctgatcaaggagtgcgagaacaccaacatcatgaagaacctgccccagggcaccagccaggtgcccgccgacctgagaatcagcatcaacaccttctgcagagccttccccttccacctgatgttcgaccccagcatgagcgtgctgcagctgggcgagggcctgagaaagcagctgagatgcgacacccacaaggtgctgaagttcgaggactgcttcgagatcgtgagccccaaggtgaacgccaccttcgagagagtgctgctgagactgagcacccccttcgtgatcagaaccaagcccgaggccagcggcagcgagaacaaggacaaggtgatggaggtgaagggccagatgatccacgtgcccgagagcaacagcatcctgttcctgggcagcccctgcgtggacaagctggacgagctgatgggcagaggcctgcacctgagcgacatccccatccacgacgccaccagagacgtgatcctggtgggcgagcaggccaaggcccaggacggcctgaagaagagaatggacaagctgaaggccaccctggagagaacccaccaggccctggaggaggagaagaagaagaccgtggacctgctgtacagcatcttccccggcgacgtggcccagcagctgtggcagggccagcaggtgcaggccagaaagttcgacgacgtgaccatgctgttcagcgacatcgtgggcttcaccgccatctgcgcccagtgcacccccatgcaggtgatcagcatgctgaacgagctgtacaccagattcgaccaccagtgcggcttcctggacatctacaaggtggagaccatcggcgacgcctactgcgtggccgccggcctgcacagaaagagcctgtgccacgccaagcccatcgccctgatggccctgaagatgatggagctgagcgaggaggtgctgacccccgacggcagacccatccagatgagaatcggcatccacagcggcagcgtgctggccggcgtggtgggcgtgagaatgcccagatactgcctgttcggcaacaacgtgaccctggccagcaagttcgagagcggcagccaccccagaagaatcaacgtgagccccaccacctaccagctgctgaagagagaggagagcttcaccttcatccccagaagcagagaggagctgcccgacaacttccccaaggagatccccggcatctgctacttcctggaggtgagaaccggccccaagccccccaagcccagcctgagcagcagcagaatcaagaaggtgagctacaacatcggcaccatgttcctgagagagaccagcctgtag

SEQ ID NO: 83983 - DNA, 2073 bp, Artificial Sequence
  Description of Artificial Sequence: Synthetic coding sequence
atgttctgcaccaagctgaaggacctgaagatcaccggcgagtgccccttcagcctgctggcccccggccaggtgcccaacgagagcagcgaggaggccgccggcagcagcgagagctgcaaggccaccgtgcccatctgccaggacatccccgagaagaacatccaggagagcctgccccagagaaagaccagcagaagcagagtgtacctgcacaccctggccgagagcatctgcaagctgatcttccccgagttcgagagactgaacgtggccctgcagagaaccctggccaagcacaagatcaaggagagcagaaagagcctggagagagaggacttcgagaagaccatcgccgagcaggccgtggccgccggcgtgcccgtggaggtgatcaaggagagcctgggcgaggaggtgttcaagatctgctacgaggaggacgagaacatcctgggcgtggtgggcggcaccctgaaggacttcctgaacagcttcagcaccctgctgaagcagagcagccactgccaggaggccggcaagagaggcagactggaggacgccagcatcctgtgcctggacaaggaggacgacttcctgcacgtgtactacttcttccccaagagaaccaccagcctgatcctgcccggcatcatcaaggccgccgcccacgtgctgtacgagaccgaggtggaggtgagcctgatgcccccctgcttccacaacgactgcagcgagttcgtgaaccagccctacctgctgtacagcgtgcacatgaagagcaccaagcccagcctgagccccagcaagccccagagcagcctggtgatccccaccagcctgttctgcaagaccttccccttccacttcatgttcgacaaggacatgaccatcctgcagttcggcaacggcatcagaagactgatgaacagaagagacttccagggcaagcccaacttcgaggagtacttcgagatcctgacccccaagatcaaccagaccttcagcggcatcatgaccatgctgaacatgcagttcgtggtgagagtgagaagatgggacaacagcgtgaagaagagcagcagagtgatggacctgaagggccagatgatctacatcgtggagagcagcgccatcctgttcctgggcagcccctgcgtggacagactggaggacttcaccggcagaggcctgtacctgagcgacatccccatccacaacgccctgagagacgtggtgctgatcggcgagcaggccagagcccaggacggcctgaagaagagactgggcaagctgaaggccaccctggagcaggcccaccaggccctggaggaggagaagaagaagaccgtggacctgctgtgcagcatcttcccctgcgaggtggcccagcagctgtggcagggccaggtggtgcaggccaagaagttcagcaacgtgaccatgctgttcagcgacatcgtgggcttcaccgccatctgcagccagtgcagccccctgcaggtgatcaccatgctgaacgccctgtacaccagattcgaccagcagtgcggcgagctggacgtgtacaaggtggagaccatcggcgacgcctactgcgtggccggcggcctgcacaaggagagcgacacccacgccgtgcagatcgccctgatggccctgaagatgatggagctgagcgacgaggtgatgagcccccacggcgagcccatcaagatgagaatcggcctgcacagcggcagcgtgttcgccggcgtggtgggcgtgaagatgcccagatactgcctgttcggcaacaacgtgaccctggccaacaagttcgagagctgcagcgtgcccagaaagatcaacgtgagccccaccacctacagactgctgaaggactgccccggcttcgtgttcacccccagaagcagagaggagctgccccccaacttccccagcgagatccccggcatctgccacttcctggacgcctaccagcagggcaccaacagcaagccctgcttccagaagaaggacgtggaggacggcaacgccaacttcctgggcaaggccagcggcatcgactag

SEQ ID NO: 83984 - DNA, 2073 bp, Artificial Sequence; identical to SEQ ID NO: 83983
  Description of Artificial Sequence: Synthetic coding sequence

SEQ ID NO: 83985 - DNA, 2073 bp, Artificial Sequence; identical to SEQ ID NO: 83983
  Description of Artificial Sequence: Synthetic coding sequence

SEQ ID NO: 83986 - DNA, 2073 bp, Artificial Sequence; identical to SEQ ID NO: 83983
  Description of Artificial Sequence: Synthetic coding sequence

SEQ ID NO: 83987 - DNA, 2073 bp, Artificial Sequence; identical to SEQ ID NO: 83983
  Description of Artificial Sequence: Synthetic coding sequence

SEQ ID NO: 83988 - DNA, 1860 bp, Artificial Sequence
  Description of Artificial Sequence: Synthetic coding sequence
atgtacggcttcgtgaaccacgccctggagctgctggtgatcagaaactacggccccgaggtgtgggaggacatcaagaaggaggcccagctggacgaggagggccagttcctggtgagaatcatctacgacgacagcaagacctacgacctggtggccgccgccagcaaggtgctgaacctgaacgccggcgagatcctgcagatgttcggcaagatgttcttcgtgttctgccaggagagcggctacgacaccatcctgagagtgctgggcagcaacgtgagagagttcctgcagaacctggacgccctgcacgaccacctggccaccatctaccccggcatgagagcccccagcttcagatgcaccgacgccgagaagggcaagggcctgatcctgcactactacagcgagagagagggcctgcaggacatcgtgatcggcatcatcaagaccgtggcccagcagatccacggcaccgagatcgacatgaaggtgatccagcagagaaacgaggagtgcgaccacacccagttcctgatcgaggagaaggagagcaaggaggaggacttctacgaggacctggacagattcgaggagaacggcacccaggagagcagaatcagcccctacaccttctgcaaggccttccccttccacatcatcttcgacagagacctggtggtgacccagtgcggcaacgccatctacagagtgctgccccagctgcagcccggcaactgcagcctgctgagcgtgttcagcctggtgagaccccacatcgacatcagcttccacggcatcctgagccacatcaacaccgtgttcgtgctgagaagcaaggagggcctgctggacgtggagaagctggagtgcgaggacgagctgaccggcaccgagatcagctgcctgagactgaagggccagatgatctacctgcccgaggccgacagcatcctgttcctgtgcagccccagcgtgatgaacctggacgacctgaccagaagaggcctgtacctgagcgacatccccctgcacgacgccaccagagacctggtgctgctgggcgagcagttcagagaggagtacaagctgacccaggagctggagatcctgaccgacagactgcagctgaccctgagagccctggaggacgagaagaagaagaccgacaccctgctgtacagcgtgctgccccccagcgtggccaacgagctgagacacaagagacccgtgcccgccaagagatacgacaacgtgaccatcctgttcagcggcatcgtgggcttcaacgccttctgcagcaagcacgccagcggcgagggcgccatgaagatcgtgaacctgctgaacgacctgtacaccagattcgacaccctgaccgacagcagaaagaaccccttcgtgtacaaggtggagaccgtgggcgacaagtacatgaccgtgagcggcctgcccgagccctgcatccaccacgccagaagcatctgccacctggccctggacatgatggagatcgccggccaggtgcaggtggacggcgagagcgtgcagatcaccatcggcatccacaccggcgaggtggtgaccggcgtgatcggccagagaatgcccagatactgcctgttcggcaacaccgtgaacctgaccagcagaaccgagaccaccggcgagaagggcaagatcaacgtgagcgagtacacctacagatgcctgatgagccccgagaacagcgacccccagttccacctggagcacagaggccccgtgagcatgaagggcaagaaggagcccatgcaggtgtggttcctgagcagaaagaacaccggcaccgaggagaccaagcaggacgacgactag

SEQ ID NO: 83989 - DNA, 1656 bp, Artificial Sequence
  Description of Artificial Sequence: Synthetic coding sequence
atgttcggcaagatgttcttcgtgttctgccaggagagcggctacgacaccatcctgagagtgctgggcagcaacgtgagagagttcctgcagaacctggacgccctgcacgaccacctggccaccatctaccccggcatgagagcccccagcttcagatgcaccgacgccgagaagggcaagggcctgatcctgcactactacagcgagagagagggcctgcaggacatcgtgatcggcatcatcaagaccgtggcccagcagatccacggcaccgagatcgacatgaaggtgatccagcagagaaacgaggagtgcgaccacacccagttcctgatcgaggagaaggagagcaaggaggaggacttctacgaggacctggacagattcgaggagaacggcacccaggagagcagaatcagcccctacaccttctgcaaggccttccccttccacatcatcttcgacagagacctggtggtgacccagtgcggcaacgccatctacagagtgctgccccagctgcagcccggcaactgcagcctgctgagcgtgttcagcctggtgagaccccacatcgacatcagcttccacggcatcctgagccacatcaacaccgtgttcgtgctgagaagcaaggagggcctgctggacgtggagaagctggagtgcgaggacgagctgaccggcaccgagatcagctgcctgagactgaagggccagatgatctacctgcccgaggccgacagcatcctgttcctgtgcagccccagcgtgatgaacctggacgacctgaccagaagaggcctgtacctgagcgacatccccctgcacgacgccaccagagacctggtgctgctgggcgagcagttcagagaggagtacaagctgacccaggagctggagatcctgaccgacagactgcagctgaccctgagagccctggaggacgagaagaagaagaccgacaccctgctgtacagcgtgctgccccccagcgtggccaacgagctgagacacaagagacccgtgcccgccaagagatacgacaacgtgaccatcctgttcagcggcatcgtgggcttcaacgccttctgcagcaagcacgccagcggcgagggcgccatgaagatcgtgaacctgctgaacgacctgtacaccagattcgacaccctgaccgacagcagaaagaaccccttcgtgtacaaggtggagaccgtgggcgacaagtacatgaccgtgagcggcctgcccgagccctgcatccaccacgccagaagcatctgccacctggccctggacatgatggagatcgccggccaggtgcaggtggacggcgagagcgtgcagatcaccatcggcatccacaccggcgaggtggtgaccggcgtgatcggccagagaatgcccagatactgcctgttcggcaacaccgtgaacctgaccagcagaaccgagaccaccggcgagaagggcaagatcaacgtgagcgagtacacctacagatgcctgatgagccccgagaacagcgacccccagttccacctggagcacagaggccccgtgagcatgaagggcaagaaggagcccatgcaggtgtggttcctgagcagaaagaacaccggcaccgaggagaccaagcaggacgacgactag

SEQ ID NO: 83990 - DNA, 1800 bp, Artificial Sequence
  Description of Artificial Sequence: Synthetic coding sequence
atgctgatgtgcttcatcaaggaggcccagctggacgaggagggccagttcctggtgagaatcatctacgacgacagcaagacctacgacctggtggccgccgccagcaaggtgctgaacctgaacgccggcgagatcctgcagatgttcggcaagatgttcttcgtgttctgccaggagagcggctacgacaccatcctgagagtgctgggcagcaacgtgagagagttcctgcagaacctggacgccctgcacgaccacctggccaccatctaccccggcatgagagcccccagcttcagatgcaccgacgccgagaagggcaagggcctgatcctgcactactacagcgagagagagggcctgcaggacatcgtgatcggcatcatcaagaccgtggcccagcagatccacggcaccgagatcgacatgaaggtgatccagcagagaaacgaggagtgcgaccacacccagttcctgatcgaggagaaggagagcaaggaggaggacttctacgaggacctggacagattcgaggagaacggcacccaggagagcagaatcagcccctacaccttctgcaaggccttccccttccacatcatcttcgacagagacctggtggtgacccagtgcggcaacgccatctacagagtgctgccccagctgcagcccggcaactgcagcctgctgagcgtgttcagcctggtgagaccccacatcgacatcagcttccacggcatcctgagccacatcaacaccgtgttcgtgctgagaagcaaggagggcctgctggacgtggagaagctggagtgcgaggacgagctgaccggcaccgagatcagctgcctgagactgaagggccagatgatctacctgcccgaggccgacagcatcctgttcctgtgcagccccagcgtgatgaacctggacgacctgaccagaagaggcctgtacctgagcgacatccccctgcacgacgccaccagagacctggtgctgctgggcgagcagttcagagaggagtacaagctgacccaggagctggagatcctgaccgacagactgcagctgaccctgagagccctggaggacgagaagaagaagaccgacaccctgctgtacagcgtgctgccccccagcgtggccaacgagctgagacacaagagacccgtgcccgccaagagatacgacaacgtgaccatcctgttcagcggcatcgtgggcttcaacgccttctgcagcaagcacgccagcggcgagggcgccatgaagatcgtgaacctgctgaacgacctgtacaccagattcgacaccctgaccgacagcagaaagaaccccttcgtgtacaaggtggagaccgtgggcgacaagtacatgaccgtgagcggcctgcccgagccctgcatccaccacgccagaagcatctgccacctggccctggacatgatggagatcgccggccaggtgcaggtggacggcgagagcgtgcagatcaccatcggcatccacaccggcgaggtggtgaccggcgtgatcggccagagaatgcccagatactgcctgttcggcaacaccgtgaacctgaccagcagaaccgagaccaccggcgagaagggcaagatcaacgtgagcgagtacacctacagatgcctgatgagccccgagaacagcgacccccagttccacctggagcacagaggccccgtgagcatgaagggcaagaaggagcccatgcaggtgtggttcctgagcagaaagaacaccggcaccgaggagaccaagcaggacgacgactag

SEQ ID NO: 83991 - DNA, 1656 bp, Artificial Sequence; identical to SEQ ID NO: 83989
  Description of Artificial Sequence: Synthetic coding sequence

SEQ ID NO: 83992 - DNA, 3222 bp, Artificial Sequence
  Description of Artificial Sequence: Synthetic coding sequence
atgaagaccctgctgctggacctggccctgtggagcctgctgttccagcccggctggctgagcttcagcagccaggtgagccagaactgccacaacggcagctacgagatcagcgtgctgatgatgggcaacagcgccttcgccgagcccctgaagaacctggaggacgccgtgaacgagggcctggagatcgtgagaggcagactgcagaacgccggcctgaacgtgaccgtgaacgccaccttcatgtacagcgacggcctgatccacaacagcggcgactgcagaagcagcacctgcgagggcctggacctgctgagaaagatcagcaacgcccagagaatgggctgcgtgctgatcggccccagctgcacctacagcaccttccagatgtacctggacaccgagctgagctaccccatgatcagcgccggcagcttcggcctgagctgcgactacaaggagaccctgaccagactgatgagccccgccagaaagctgatgtacttcctggtgaacttctggaagaccaacgacctgcccttcaagacctacagctggagcaccagctacgtgtacaagaacggcaccgagaccgaggactgcttctggtacctgaacgccctggaggccagcgtgagctacttcagccacgagctgggcttcaaggtggtgctgagacaggacaaggagttccaggacatcctgatggaccacaacagaaagagcaacgtgatcatcatgtgcggcggccccgagttcctgtacaagctgaagggcgacagagccgtggccgaggacatcgtgatcatcctggtggacctgttcaacgaccagtacttcgaggacaacgtgaccgcccccgactacatgaagaacgtgctggtgctgaccctgagccccggcaacagcctgctgaacagcagcttcagcagaaacctgagccccaccaagagagacttcgccctggcctacctgaacggcatcctgctgttcggccacatgctgaagatcttcctggagaacggcgagaacatcaccacccccaagttcgcccacgccttcagaaacctgaccttcgagggctacgacggccccgtgaccctggacgactggggcgacgtggacagcaccatggtgctgctgtacaccagcgtggacaccaagaagtacaaggtgctgctgacctacgacacccacgtgaacaagacctaccccgtggacatgagccccaccttcacctggaagaacagcaagctgcccaacgacatcaccggcagaggcccccagatcctgatgatcgccgtgttcaccctgaccggcgccgtggtgctgctgctgctggtggccctgctgatgctgagaaagtacagaaaggactacgagctgagacagaagaagtggagccacatcccccccgagaacatcttccccctggagaccaacgagaccaaccacgtgagcctgaagatcgacgacgacaagagaagagacaccatccagagactgagacagtgcaagtacgacaagaagagagtgatcctgaaggacctgaagcacaacgacggcaacttcaccgagaagcagaagatcgagctgaacaagctgctgcagatcgactactacaacctgaccaagttctacggcaccgtgaagctggacaccatgatcttcggcgtgatcgagtactgcgagagaggcagcctgagagaggtgctgaacgacaccatcagctaccccgacggcaccttcatggactgggagttcaagatcagcgtgctgtacgacatcgccaagggcatgagctacctgcacagcagcaagaccgaggtgcacggcagactgaagagcaccaactgcgtggtggacagcagaatggtggtgaagatcaccgacttcggctgcaacagcatcctgccccccaagaaggacctgtggaccgcccccgagcacctgagacaggccaacatcagccagaagggcgacgtgtacagctacggcatcatcgcccaggagatcatcctgagaaaggagaccttctacaccctgagctgcagagacagaaacgagaagatcttcagagtggagaacagcaacggcatgaagcccttcagacccgacctgttcctggagaccgccgaggagaaggagctggaggtgtacctgctggtgaagaactgctgggaggaggaccccgagaagagacccgacttcaagaagatcgagaccaccctggccaagatcttcggcctgttccacgaccagaagaacgagagctacatggacaccctgatcagaagactgcagctgtacagcagaaacctggagcacctggtggaggagagaacccagctgtacaaggccgagagagacagagccgacagactgaacttcatgctgctgcccagactggtggtgaagagcctgaaggagaagggcttcgtggagcccgagctgtacgaggaggtgaccatctacttcagcgacatcgtgggcttcaccaccatctgcaagtacagcacccccatggaggtggtggacatgctgaacgacatctacaagagcttcgaccacatcgtggaccaccacgacgtgtacaaggtggagaccatcggcgacgcctacatggtggccagcggcctgcccaagagaaacggcaacagacacgccatcgacatcgccaagatggccctggagatcctgagcttcatgggcaccttcgagctggagcacctgcccggcctgcccatctggatcagaatcggcgtgcacagcggcccctgcgccgccggcgtggtgggcatcaagatgcccagatactgcctgttcggcgacaccgtgaacaccgccagcagaatggagagcaccggcctgcccctgagaatccacgtgagcggcagcaccatcgccatcctgaagagaaccgagtgccagttcctgtacgaggtgagaggcgagacctacctgaagggcagaggcaacgagaccacctactggctgaccggcatgaaggaccagaagttcaacctgcccaccccccccaccgtggagaaccagcagagactgcaggccgagttcagcgacatgatcgccaacagcctgcagaagagacaggccgccggcatcagaagccagaagcccagaagagtggccagctacaagaagggcaccctggagtacctgcagctgaacaccaccgacaaggagagcacctacttctag

SEQ ID NO: 83993 - DNA, 3312 bp, Artificial Sequence
  Description of Artificial Sequence: Synthetic coding sequence
atgaccgcctgcgccagaagagccggcggcctgcccgaccccggcctgtgcggccccgcctggtgggcccccagcctgcccagactgcccagagccctgcccagactgcccctgctgctgctgctgctgctgctgcagccccccgccctgagcgccgtgttcaccgtgggcgtgctgggcccctgggcctgcgaccccatcttcagcagagccagacccgacctggccgccagactggccgccgccagactgaacagagaccccggcctggccggcggccccagattcgaggtggccctgctgcccgagccctgcagaacccccggcagcctgggcgccgtgagcagcgccctggccagagtgagcggcctggtgggccccgtgaaccccgccgcctgcagacccgccgagctgctggccgaggaggccggcatcgccctggtgccctggggctgcccctggacccaggccgagggcaccaccgcccccgccgtgacccccgccgccgacgccctgtacgccctgctgagagccttcggctgggccagagtggccctggtgaccgccccccaggacctgtgggtggaggccggcagaagcctgagcaccgccctgagagccagaggcctgcccgtggccagcgtgaccagcatggagcccctggacctgagcggcgccagagaggccctgagaaaggtgagagacggccccagagtgaccgccgtgatcatggtgatgcacagcgtgctgctgggcggcgaggagcagagatacctgctggaggccgccgaggagctgggcctgaccgacggcagcctggtgttcctgcccttcgacaccatccactacgccctgagccccggccccgaggccctggccgccctggccaacagcagccagctgagaagagcccacgacgccgtgctgaccctgaccagacactgccccagcgagggcagcgtgctggacagcctgagaagagcccaggagagaagagagctgcccagcgacctgaacctgcagcaggtgagccccctgttcggcaccatctacgacgccgtgttcctgctggccagaggcgtggccgaggccagagccgccgccggcggcagatgggtgagcggcgccgccgtggccagacacatcagagacgcccaggtgcccggcttctgcggcgacctgggcggcgacgaggagccccccttcgtgctgctggacaccgacgccgccggcgacagactgttcgccacctacatgctggaccccgccagaggcagcttcctgagcgccggcaccagaatgcacttccccagaggcggcagcgcccccggccccgaccccagctgctggttcgaccccaacaacatctgcggcggcggcctggagcccggcctggtgttcctgggcttcctgctggtggtgggcatgggcctggccggcgccttcctggcccactacgtgagacacagactgctgcacatgcagatggtgagcggccccaacaagatcatcctgaccgtggacgacatcaccttcctgcacccccacggcggcaccagcagaaaggtggcccagggcagcagaagcagcctgggcgccagaagcatgagcgacatcagaagcggccccagccagcacctggacagccccaacatcggcgtgtacgagggcgacagagtgtggctgaagaagttccccggcgaccagcacatcgccatcagacccgccaccaagaccgccttcagcaagctgcaggagctgagacacgagaacgtggccctgtacctgggcctgttcctggccagaggcgccgagggccccgccgccctgtgggagggcaacctggccgtggtgagcgagcactgcaccagaggcagcctgcaggacctgctggcccagagagagatcaagctggactggatgttcaagagcagcctgctgctggacctgatcaagggcatcagatacctgcaccacagaggcgtggcccacggcagactgaagagcagaaactgcatcgtggacggcagattcgtgctgaagatcaccgaccacggccacggcagactgctggaggcccagaaggtgctgcccgagccccccagagccgaggaccagctgtggaccgcccccgagctgctgagagaccccgccctggagagaagaggcaccctggccggcgacgtgttcagcctggccatcatcatgcaggaggtggtgtgcagaagcgccccctacgccatgctggagctgacccccgaggaggtggtgcagagagtgagaagccccccccccctgtgcagacccctggtgagcatggaccaggcccccgtggagtgcatcctgctgatgaagcagtgctgggccgagcagcccgagctgagacccagcatggaccacaccttcgacctgttcaagaacatcaacaagggcagaaagaccaacatcatcgacagcatgctgagaatgctggagcagtacagcagcaacctggaggacctgatcagagagagaaccgaggagctggagctggagaagcagaagaccgacagactgctgacccagatgctgccccccagcgtggccgaggccctgaagaccggcacccccgtggagcccgagtacttcgagcaggtgaccctgtacttcagcgacatcgtgggcttcaccaccatcagcgccatgagcgagcccatcgaggtggtggacctgctgaacgacctgtacaccctgttcgacgccatcatcggcagccacgacgtgtacaaggtggagaccatcggcgacgcctacatggtggccagcggcctgccccagagaaacggccagagacacgccgccgagatcgccaacatgagcctggacatcctgagcgccgtgggcaccttcagaatgagacacatgcccgaggtgcccgtgagaatcagaatcggcctgcacagcggcccctgcgtggccggcgtggtgggcctgaccatgcccagatactgcctgttcggcgacaccgtgaacaccgccagcagaatggagagcaccggcctgccctacagaatccacgtgaacctgagcaccgtgggcatcctgagagccctggacagcggctaccaggtggagctgagaggcagaaccgagctgaagggcaagggcgccgaggacaccttctggctggtgggcagaagaggcttcaacaagcccatccccaagccccccgacctgcagcccggcagcagcaaccacggcatcagcctgcaggagatcccccccgagagaagaagaaagctggagaaggccagacccggccagttcagctag

SEQ ID NO: 83994 - DNA, 594 bp, Artificial Sequence
  Description of Artificial Sequence: Synthetic coding sequence
atgagaaagtacagaagccactggagccagggcgacagagagggctaccagagaagaagcaactactacgagggcccccacaccagccacagcagccccgccgacagaaccagagaggaggtggtgacccccaccctgcccgagcacaccgccaccagaagccagatggccaccagcctggacttcaagacctacgtggaccaggcctgcagagccgccgaggagttcgtgaacatctactacgagaccatggacaagagaagaagagccctgaccagactgtacctggacaaggccaccctgatctggaacggcaacgccgtgagcggcctggacgccctgaacaacttcttcgacaccctgcccagcagcgagttccaggtgaacatgctggactgccagcccgtgcacgagcaggccacccagagccagaccaccgtgctggtggtgaccagcggcaccgtgaagttcgacggcaacaagcagcacttcttcaaccagaacttcctgctgaccgcccagagcacccccaacaacaccgtgtggaagatcgccagcgactgcttcagattccaggactggagcagcagctag

SEQ ID NO: 83995 - DNA, 606 bp, Artificial Sequence
  Description of Artificial Sequence: Synthetic coding sequence
atgggcaacgtgatggagggcaagagcgtggaggagctgagcagcaccgagtgccaccagtggtacaagaagttcatgaccgagtgccccagcggccagctgaccctgtacgagttcagacagttcttcggcctgaagaacctgagccccagcgccagccagtacgtggagcagatgttcgagaccttcgacttcaacaaggacggctacatcgacttcatggagtacgtggccgccctgagcctggtgctgaagggcaaggtggagcagaagctgagatggtacttcaagctgtacgacgtggacggcaacggctgcatcgacagagacgagctgctgaccatcatccaggccatcagagccatcaacccctgcagcgacaccaccatgaccgccgaggagttcaccgacaccgtgttcagcaagatcgacgtgaacggcgacggcgagctgagcctggaggagttcatcgagggcgtgcagaaggaccagatgctgctggacaccctgaccagaagcctggacctgaccagaatcgtgagaagactgcagaacggcgagcaggacgaggagggcgccgacgaggccgccgaggccgccggctag

SEQ ID NO: 83996 - DNA, 606 bp, Artificial Sequence; identical to SEQ ID NO: 83995
  Description of Artificial Sequence: Synthetic coding sequence

SEQ ID NO: 83997 - DNA, 618 bp, Artificial Sequence
  Description of Artificial Sequence: Synthetic coding sequence
atggagggcaagagcgtggaggagctgagcagcaccgagtgccaccagtggtacaagaagttcatgaccgagtgccccagcggccagctgaccctgtacgagttcagacagttcttcggcctgaagaacctgagccccagcgccagccagtacgtggagcagatgttcgagaccttcgacttcaacaaggacggctacatcgacttcatggagtacgtggccgccctgagcctggtgctgaagggcaaggtggagcagaagctgagatggtacttcaagctgtacgacgtggacggcaacggctgcatcgacagagacgagctgctgaccatcatccagttcccccaccagtaccagaagaccgccatcagagccatcaacccctgcagcgacaccaccatgaccgccgaggagttcaccgacaccgtgttcagcaagatcgacgtgaacggcgacggcgagctgagcctggaggagttcatcgagggcgtgcagaaggaccagatgctgctggacaccctgaccagaagcctggacctgaccagaatcgtgagaagactgcagaacggcgagcaggacgaggagggcgccgacgaggccgccgaggccgccggctag

SEQ ID NO: 83998 - DNA, 606 bp, Artificial Sequence; identical to SEQ ID NO: 83995
  Description of Artificial Sequence: Synthetic coding sequence

SEQ ID NO: 83999 - DNA, 267 bp, Artificial Sequence
  Description of Artificial Sequence: Synthetic coding sequence
atgggcaacgtgatggagggcaagagcgtggaggagctgagcagcaccgagtgccaccagtggtacaagaagttcatgaccgagtgccccagcggccagctgaccctgtacgagttcagacagttcttcggcctgaagaacctgagccccagcgccagccagtacgtggagcagatgttcgagaccttcgacttcaacaaggacggctacatcgacttcatggagtacgtggccgccctgagcctggtgctgaagggcaaggtgtag

SEQ ID NO: 84000 - DNA, 606 bp, Artificial Sequence; identical to SEQ ID NO: 83995
  Description of Artificial Sequence: Synthetic coding sequence

SEQ ID NO: 84001 - DNA, 1020 bp, Artificial Sequence
  Description of Artificial Sequence: Synthetic coding sequence
atggaccagaacaacagcctgcccccctacgcccagggcctggccagcccccagggcgccatgacccccggcatccccatcttcagccccatgatgccctacggcaccggcctgaccccccagcccatccagaacaccaacagcctgagcatcctggaggagcagcagagacagcagcagcagcagcagcagcagcagcagcagcagcagcagcagcagcagcagcagcagcagcagcagcagcagcagcagcagcagcagcagcagcagcagcagcagcagcaggccgtggccgccgccgccgtgcagcagagcaccagccagcaggccacccagggcaccagcggccaggccccccagctgttccacagccagaccctgaccaccgcccccctgcccggcaccacccccctgtaccccagccccatgacccccatgacccccatcacccccgccacccccgccagcgagagcagcggcatcgtgccccagctgcagaacatcgtgagcaccgtgaacctgggctgcaagctggacctgaagaccatcgccctgagagccagaaacgccgagtacaaccccaagagattcgccgccgtgatcatgagaatcagagagcccagaaccaccgccctgatcttcagcagcggcaagatggtgtgcaccggcgccaagagcgaggagcagagcagactggccgccagaaagtacgccagagtggtgcagaagctgggcttccccgccaagttcctggacttcaagatccagaacatggtgggcagctgcgacgtgaagttccccatcagactggagggcctggtgctgacccaccagcagttcagcagctacgagcccgagctgttccccggcctgatctacagaatgatcaagcccagaatcgtgctgctgatcttcgtgagcggcaaggtggtgctgaccggcgccaaggtgagagccgagatctacgaggccttcgagaacatctaccccatcctgaagggcttcagaaagaccacctag

SEQ ID NO: 84002 - DNA, 519 bp, Artificial Sequence
  Description of Artificial Sequence: Synthetic coding sequence
atgggccaggagttcagctgggaggaggccgaggccgccggcgagatcgacgtggccgagctgcaggagtggtacaagaagttcgtgatggagtgccccagcggcaccctgttcatgcacgagttcaagagattcttcaaggtgaccgacgacgaggaggccagccagtacgtggagggcatgttcagagccttcgacaagaacggcgacaacaccatcgacttcctggagtacgtggccgccctgaacctggtgctgagaggcaccctggagcacaagctgaagtggaccttcaagatctacgacaaggacggcaacggctgcatcgacagactggagctgctgaacatcgtggagtgcagaagagagctgcagaccgagcagggccagctgctgacccccgaggaggtggtggacagaatcttcctgctggtggacgagaacggcgacggccagctgagcctgaacgagttcgtggagggcgccagaagagacaacctgctgatgcccaccctgtag

SEQ ID NO: 84003 - DNA, 630 bp, Artificial Sequence
  Description of Artificial Sequence: Synthetic coding sequence
atgggcaacggcaagagcatcgccggcgaccagaaggccgtgcccacccaggagacccacgtgtggtacagaaccttcatgatggagtaccccagcggcctgcagaccctgcacgagttcaagaccctgctgggcctgcagggcctgaaccagaaggccaacaagcacatcgaccaggtgtacaacaccttcgacaccaacaaggacggcttcgtggacttcctggagttcatcgccgccgtgaacctgatcatgcaggagaagatggagcagaagctgaagtggtacttcaagctgtacgacgccgacggcaacggcagcatcgacaagaacgagctgctggacatgttcatggccgtgcaggccctgaacggccagcagaccctgagccccgaggagttcatcaacctggtgttccacaagatcgacatcaacaacgacggcgagctgaccctggaggagttcatcaacggcatggccaaggaccaggacctgctggagatcgtgtacaagagcttcgacttcagcaacgtgctgagagtgatctgcaacggcaagcagcccgacatggagaccgacagcagcaagagccccgacaaggccggcctgggcaaggtgaagatgaagtag

SEQ ID NO: 84004 - DNA, 591 bp, Artificial Sequence
  Description of Artificial Sequence: Synthetic coding sequence
atgggcaacggcaagagcatcgccggcgaccagaaggccgtgcccacccaggagacccacgtgtggtacagaaccttcatgatggagtaccccagcggcctgcagaccctgcacgagttcaagaccctgctgggcctgcagggcctgaaccagaaggccaacaagcacatcgaccaggtgtacaacaccttcgacaccaacaaggacggcttcgtggacttcctggagttcatcgccgccgtgaacctgatcatgcaggagaagatggagcagaagctgaagtggtacttcaagctgtacgacgccgacggcaacggcagcatcgacaagaacgagctgctggacatgttcatggccgtgcaggccctgaacggccagcagaccctgagccccgaggagttcatcaacctggtgttccacaagatcgacatcaacaacgacggcaacggcgccaccctgtactggatcaccttccccaccaagggcatcgacttcagaagaatctaccagtggcacggcaagagaagcggcagccccggcgactgcctgcaggagctgagactgctgcagtgcgccgagagcaacctgtag

SEQ ID NO: 84005 - DNA, 348 bp, Artificial Sequence
  Description of Artificial Sequence: Synthetic coding sequence
atgaacgccttcctgctgagcgccctgtgcctgctgggcgcctgggccgccctggccggcggcgtgaccgtgcaggacggcaacttcagcttcagcctggagagcgtgaagaagctgaaggacctgcaggagccccaggagcccagagtgggcaagctgagaaacttcgcccccatccccggcgagcccgtggtgcccatcctgtgcagcaaccccaacttccccgaggagctgaagcccctgtgcaaggagcccaacgcccaggagatcctgcagagactggaggagatcgccgaggaccccggcacctgcgagatctgcgcctacgccgcctgcaccggctgctag

SEQ ID NO: 84006 - DNA, 339 bp, Artificial Sequence
  Description of Artificial Sequence: Synthetic coding sequence
atgggctgcagagccgccagcggcctgctgcccggcgtggccgtggtgctgctgctgctgctgcagagcacccagagcgtgtacatccagtaccagggcttcagagtgcagctggagagcatgaagaagctgagcgacctggaggcccagtgggcccccagccccagactgcaggcccagagcctgctgcccgccgtgtgccaccaccccgccctgccccaggacctgcagcccgtgtgcgccagccaggaggccagcagcatcttcaagaccctgagaaccatcgccaacgacgactgcgagctgtgcgtgaacgtggcctgcaccggctgcctgtag

SEQ ID NO: 84007 - DNA, 594 bp, Artificial Sequence
  Description of Artificial Sequence: Synthetic coding sequence
atgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgaggagatcaagaaggcccagagaaccggcgcctag

SEQ ID NO: 84008 - DNA, 594 bp, Artificial Sequence; identical to SEQ ID NO: 84007
  Description of Artificial Sequence: Synthetic coding sequence

SEQ ID NO: 84009 - DNA, 594 bp, Artificial Sequence; identical to SEQ ID NO: 84007
  Description of Artificial Sequence: Synthetic coding sequence

SEQ ID NO: 84010 - DNA, 600 bp, Artificial Sequence
  Description of Artificial Sequence: Synthetic coding sequence
atgagcggccccagacccgtggtgctgagcggccccagcggcgccggcaagagcaccctgctgaagagactgctgcaggagcacagcggcatcttcggcttcagcgtgagcagagagagcagagccctggtggagggctaccacgaggagcccgaggccagaagaggcgagagacagagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgaggagatcaagaaggcccagagaaccggcgcctag

SEQ ID NO: 84011 - DNA, 729 bp, Artificial Sequence
  Description of Artificial Sequence: Synthetic coding sequence
atgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctgagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgaggtgggccccagcctgtgcctgcccggccagggccccagaggcggcctgggcgccagacccctgctgagcatgagacccctgagaaagagcagaaagctgaagggccccgcccccgaggcctgctgcctgttcagcgcccccagagcccacaccggccccggccagcagcactag

SEQ ID NO: 84012 - DNA, 657 bp, Artificial Sequence
  Description of Artificial Sequence: Synthetic coding sequence
atgctgagaagacccctggccggcctggccgccgccgccctgggcagagccccccccgacggcatgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagccccgccggcctggagagctgccccaccgccgccgtgagaaccgccgccggccagagccccgcctgcctgatgtggagcagcctgaccaccgcctggaccagacccacccagagctag

SEQ ID NO: 84013 - DNA, 594 bp, Artificial Sequence; identical to SEQ ID NO: 84007
  Description of Artificial Sequence: Synthetic coding sequence

SEQ ID NO: 84014 - DNA, 726 bp, Artificial Sequence
  Description of Artificial Sequence: Synthetic coding sequence
atgctgagaagacccctggccggcctggccgccgccgccctgggcagagccccccccgacggcatgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagaaaccaggagagcagcaaggacagaagactgagactggccgtgtgcagcagacaccccggccccatccaggaccagggcagcagcatcgagccccccccctggcaggccatcagacagctgtgcgccctgggccagcacgtggagtggagaagatgctgcccctgcggctggaacatcctgggctag

SEQ ID NO: 84015 - DNA, 594 bp, Artificial Sequence; identical to SEQ ID NO: 84007
  Description of Artificial Sequence: Synthetic coding sequence

SEQ ID NO: 84016 - DNA, 657 bp, Artificial Sequence
  Description of Artificial Sequence: Synthetic coding sequence
atgctgagaagacccctggccggcctggccgccgccgccctgggcagagccccccccgacggcatgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgaggagatcaagaaggcccagagaaccggcgcctag

SEQ ID NO: 84017 - DNA, 762 bp, Artificial Sequence
  Description of Artificial Sequence: Synthetic coding sequence
atggccggcagccagaaggaggagatcatgcccccccagcagggcgtgcccttccaggagagcggctgctggggcagcatgggcgcccagagcagagagagaagcggcagagaccacagcggcacctggatctgcgccggcggcagccaggagaccttccacctgggcgcccccgtggagaccacctgcctggccggcatgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgagtag

SEQ ID NO: 84018 - DNA, 516 bp, Artificial Sequence
  Description of Artificial Sequence: Synthetic coding sequence
atgagcggccccagacccgtggtgctgagcggccccagcggcgccggcaagagcaccctgctgaagagactgctgcaggagcacagcggcatcttcggcttcagcgtgagcagagagagcaacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcgagatcaagaaggcccagagaaccggcgcctag

SEQ ID NO: 84019 - DNA, 819 bp, Artificial Sequence
  Description of Artificial Sequence: Synthetic coding sequence
atggccggcagccagaaggaggagatcatgcccccccagcagggcgtgcccttccaggagagcggctgctggggcagcatgggcgcccagagcagagagagaagcggcagagaccacagcggcacctggatctgcgccggcggcagccaggagaccttccacctgggcgcccccgtggagaccacctgcctggccgccagcctgctgacccccagacacgtgggcccccaggcctgcggcgccgagagagccttcggcagctgggaggagcaccccgccgaggaggccgcccccggcgcccagagacacctgtggctgcagagagtgccctaccacgaggagcccgaggccagaagaggcgagagacagagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagaaaccaggagagcagcaaggacagaagactgagactggccgtgtgcagcagacaccccggccccatccaggaccagggcagcagcatcgagccccccccctggcaggccatcagacagctgtgcgccctgggccagcacgtgtag

SEQ ID NO: 84020 - DNA, 654 bp, Artificial Sequence
  Description of Artificial Sequence: Synthetic coding sequence
atgctgagaagacccctggccggcctggccgccgccgccctgggcagagccccccccgacggcatgagcggccccagacccgtggtgctgagcggccccagcggcgccggcaagagcaccctgctgaagagactgctgcaggagcacagcggcatcttcggcttcagcgtgagccacaccaccagaaaccccagacccggcgaggagaacggcaaggactactacttcgtgaccagagaggtgatgcagagagacatcgccgccggcgacttcatcgagcacgccgagttcagcggcaacctgtacggcaccagcaaggtggccgtgcaggccgtgcaggccatgaacagaatctgcgtgctggacgtggacctgcagggcgtgagaaacatcaaggccaccgacctgagacccatctacatcagcgtgcagccccccagcctgcacgtgctggagcagagactgagacagagaaacaccgagaccgaggagagcctggtgaagagactggccgccgcccaggccgacatggagagcagcaaggagcccggcctgttcgacgtggtgatcatcaacgacagcctggaccaggcctacgccgagctgaaggaggccctgagcgaggagatcaagaaggcccagagaaccggctag

SEQ ID NO: 84021 - DNA, 915 bp, Artificial Sequence
  Description of Artificial Sequence: Synthetic coding sequence
atgaacagagccttcagcagaaagaaggacaagacctggatgcacacccccgaggccctgagcaagcacttcatcccctacaacgccaagttcctgggcagcaccgaggtggagcagcccaagggcaccgaggtggtgagagacgccgtgagaaagctgaagttcgccagacacatcaagaagagcgagggccagaagatccccaaggtggagctgcagatcagcatctacggcgtgaagatcctggagcccaagaccaaggaggtgcagcacaactgccagctgcacagaatcagcttctgcgccgacgacaagaccgacaagagaatcttcaccttcatctgcaaggacagcgagagcaacaagcacctgtgctacgtgttcgacagcgagaagtgcgccgaggagatcaccctgaccatcggccaggccttcgacctggcctacagaaagttcctggagagcggcggcaaggacgtggagaccagaaagcagatcgccggcctgcagaagagaatccaggacctggagaccgagaacatggagctgaagaacaaggtgcaggacctggagaaccagctgagaatcacccaggtgagcgccccccccgccggcagcatgacccccaagagccccagcaccgacatcttcgacatgatccccttcagccccatcagccaccagagcagcatgcccaccagaaacggcacccagcccccccccgtgcccagcagaagcaccgagatcaagagagacctgttcggcgccgagcccttcgaccccttcaactgcggcgccgccgacttcccccccgacatccagagcaagctggacgagatgcaggagggcttcaagatgggcctgaccctggagggcaccgtgttctgcctggaccccctggacagcagatgctag

SEQ ID NO: 84022 - DNA, 915 bp, Artificial Sequence; identical to SEQ ID NO: 84021
  Description of Artificial Sequence: Synthetic coding sequence

SEQ ID NO: 84023 - DNA, 915 bp, Artificial Sequence; identical to SEQ ID NO: 84021
  Description of Artificial Sequence: Synthetic coding sequence

SEQ ID NO: 84024 - DNA, 504 bp, Artificial Sequence
  Description of Artificial Sequence: Synthetic coding sequence
atgaacagagccttcagcagaaagaaggacaagacctggatgcacacccccgaggccctgagcaagcacttcatcccctacaacgccaagttcctgggcagcaccgaggtggagcagcccaagggcaccgaggtggtgagagacgccgtgagaaagctgaagttcgccagacacatcaagaagagcgagggccagaagatccccaaggtggagctgcagatcagcatctacggcgtgaagatcctggagcccaagaccaaggaggtgcagcacaactgccagctgcacagaatcagcttctgcgccgacgacaagaccgacaagagaatcttcaccttcatctgcaaggacagcgagagcaacaagcacctgtgctacgtgttcgacagcgagaagtgcgtgagcatccccgacgtggtgggctggttcgtgctgttctacaagcccggcatcgtgctgctgctggccctggccaagtacctgaagatgaacaacttcctgtag

SEQ ID NO: 84025 - DNA, 915 bp, Artificial Sequence; identical to SEQ ID NO: 84021
  Description of Artificial Sequence: Synthetic coding sequence

SEQ ID NO: 84026 - DNA, 207 bp, Artificial Sequence
  Description of Artificial Sequence: Synthetic coding sequence
atgaacagagccttcagcagaaagaaggacaagacctggatgcacacccccgaggccctgagcaagcacttcatcccctacaacgccaagttcctgggcagcaccgaggtggagcagcccaagggcaccgaggtggtgagagacgccgtgagaaagctgaagttcgccagacacatcaagaagagcgagggccagaagatcccctag

SEQ ID NO: 84027 - DNA, 504 bp, Artificial Sequence; identical to SEQ ID NO: 84024
  Description of Artificial Sequence: Synthetic coding sequence

SEQ ID NO: 84028 - DNA, 585 bp, Artificial Sequence
  Description of Artificial Sequence: Synthetic coding sequence
atgaccgagaacagcaccagcgcccccgccgccaagcccaagagagccaaggccagcaagaagagcaccgaccaccccaagtacagcgacatgatcgtggccgccatccaggccgagaagaacagagccggcagcagcagacagagcatccagaagtacatcaagagccactacaaggtgggcgagaacgccgacagccagatcaagctgagcatcaagagactggtgaccaccggcgtgctgaagcagaccaagggcgtgggcgccagcggcagcttcagactggccaagagcgacgagcccaagaagagcgtggccttcaagaagaccaagaaggagatcaagaaggtggccacccccaagaaggccagcaagcccaagaaggccgccagcaaggcccccaccaagaagcccaaggccacccccgtgaagaaggccaagaagaagctggccgccacccccaagaaggccaagaagcccaagaccgtgaaggccaagcccgtgaaggccagcaagcccaagaaggccaagcccgtgaagcccaaggccaagagcagcgccaagagagccggcaagaagaagtag

SEQ ID NO: 84029 - DNA, 534 bp, Artificial Sequence
  Description of Artificial Sequence: Synthetic coding sequence
atgaccgagaagagcaccgaccaccccaagtacagcgacatgatcgtggccgccatccaggccgagaagaacagagccggcagcagcagacagagcatccagaagtacatcaagagccactacaaggtgggcgagaacgccgacagccagatcaagctgagcatcaagagactggtgaccaccggcgtgctgaagcagaccaagggcgtgggcgccagcggcagcttcagactggccaagagcgacgagcccaagaagagcgtggccttcaagaagaccaagaaggagatcaagaaggtggccacccccaagaaggccagcaagcccaagaaggccgccagcaaggcccccaccaagaagcccaaggccacccccgtgaagaaggccaagaagaagctggccgccacccccaagaaggccaagaagcccaagaccgtgaaggccaagcccgtgaaggccagcaagcccaagaaggccaagcccgtgaagcccaaggccaagagcagcgccaagagagccggcaagaagaagtag

SEQ ID NO: 84030 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccagcaccggcggcgtgaagaagccccacagatacagacccggcaccgtggccctgagagagatcagaagataccagaagagcaccgagctgctgatcagaaagctgcccttccagagactggtgagagagatcgcccaggacttcaagaccgacctgagattccagagcgccgccatcggcgccctgcaggaggccagcgaggcctacctggtgggcctgttcgaggacaccaacctgtgcgccatccacgccaagagagtgaccatcatgcccaaggacatccagctggccagaagaatcagaggcgagagagcctag

SEQ ID NO: 84031 - DNA, 372 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccagcaccggcggcgtgaagaagccccacagatacagacccggcaccgtggccctgagagagatcagaagataccagaagagcaccgagctgctgatcagaaagctgcccttccagagactggtgagagagatcgcccaggacttcaagaccgacctgagattccagagcgccgccatcggcgccctgcaggtgaagtggtgggtgggcagactgagagtgtgcatccccgtggtgtaccaggagcagttccagatcgtggcctgcgcctacatcatctag

SEQ ID NO: 84032 - DNA, 411 bp, Artificial Sequence; identical to SEQ ID NO: 84030
  Description of Artificial Sequence: Synthetic coding sequence

SEQ ID NO: 84033 - DNA, 411 bp, Artificial Sequence; identical to SEQ ID NO: 84030
  Description of Artificial Sequence: Synthetic coding sequence

SEQ ID NO: 84034 - DNA, 411 bp, Artificial Sequence; identical to SEQ ID NO: 84030
  Description of Artificial Sequence: Synthetic coding sequence

SEQ ID NO: 84035 - DNA, 1047 bp, Artificial Sequence
  Description of Artificial Sequence: Synthetic coding sequence
atgcccgacgagctgaccgagcccggcagagccacccccgccagagccagcagcttcctgatcgagaacctgctggccgccgaggccaagggcgccggcagagccacccagggcgacggcagcagagaggacgaggaggaggacgacgacgaccccgaggacgaggacgccgagcaggccagaagaagaagactgcagagaagaagacagctgctggccggcaccggccccggcggcgaggccagagccagagccctgctgggccccggcgccctgggcctgggccccagacccccccccggccccggcccccccttcgccctgggctgcggcggcgccgccagatggtaccccagagcccacggcggctacggcggcggcctgagccccgacaccagcgacagagacagccccgagaccggcgaggagatgggcagagccgagggcgcctggcccagaggccccggccccggcgccgtgcagagagaggccgccgagctggccgccagaggccccgccgccggcaccgaggaggccagcgagctggccgaggtgcccgccgccgccggcgagaccagaggcggcgtgggcgtgggcggcggcagaaagaagaagaccagaaccgtgttcagcagaagccaggtgttccagctggagagcaccttcgacctgaagagatacctgagcagcgccgagagagccggcctggccgccagcctgcagctgaccgagacccaggtgaagatctggttccagaacagaagaaacaagtggaagagacagctggccgccgagctggaggccgccagcctgagcccccccggcgcccagagactggtgagagtgcccgtgctgtaccacgagagcccccccgccgccgccgccgccggcccccccgccaccctgcccttccccctggcccccgccgcccccgccccccccccccccctgctgggcttcagcggcgccctggcctaccccctggccgccttccccgccgccgccagcgtgcccttcctgagagcccagatgcccggcctggtgtag

SEQ ID NO: 84036 - DNA, 822 bp, Artificial Sequence
  Description of Artificial Sequence: Synthetic coding sequence
atgggcagcaaggaggacgccggcaagggctgccccgccgccggcggcgtgagcagcttcaccatccagagcatcctgggcggcggccccagcgaggcccccagagagcccgtgggctggcccgccagaaagagaagcctgagcgtgagcagcgaggaggaggagcccgacgacggctggaaggcccccgcctgcttctgccccgaccagcacggccccaaggagcagggccccaagcaccacccccccatccccttcccctgcctgggcacccccaagggcagcggcggcagcggccccggcggcctggagagaacccccttcctgagccccagccacagcgacttcaaggaggagaaggagagactgctgcccgccggcagccccagccccggcagcgagagacccagagacggcggcgccgagagacaggccggcgccgccaagaagaagaccagaaccgtgttcagcagaagccaggtgtaccagctggagagcaccttcgacatgaagagatacctgagcagcagcgagagagcctgcctggccagcagcctgcagctgaccgagacccaggtgaagacctggttccagaacagaagaaacaagtggaagagacagctgagcgccgagctggaggccgccaacatggcccacgccagcgcccagaccctggtgagcatgcccctggtgttcagagacagcagcctgctgagagtgcccgtgcccagaagcctggccttccccgcccccctgtactaccccggcagcaacctgagcgccctgcccctgtacaacctgtacaacaagctggactactag

SEQ ID NO: 84037 - DNA, 1074 bp, Artificial Sequence
  Description of Artificial Sequence: Synthetic coding sequence
atgcccgagcccggccccgacgccgccggcaccgccagcgcccagccccagcccccccccccccccccccccgcccccaaggagagccccttcagcatcaagaacctgctgaacggcgaccaccacagacccccccccaagccccagcccccccccagaaccctgttcgcccccgccagcgccgccgccgccgccgccgccgccgccgccgccgccgccaagggcgccctggagggcgccgccggcttcgccctgagccaggtgggcgacctggccttccccagattcgagatccccgcccagagattcgccctgcccgcccactacctggagagaagccccgcctggtggtacccctacaccctgacccccgccggcggccacctgcccagacccgaggccagcgagaaggccctgctgagagacagcagccccgccagcggcaccgacagagacagccccgagcccctgctgaaggccgaccccgaccacaaggagctggacagcaagagccccgacgagatcatcctggaggagagcgacagcgaggagagcaagaaggagggcgaggccgcccccggcgccgccggcgccagcgtgggcgccgccgccgccacccccggcgccgaggactggaagaagggcgccgagagccccgagaagaagcccgcctgcagaaagaagaagaccagaaccgtgttcagcagaagccaggtgttccagctggagagcaccttcgacatgaagagatacctgagcagcagcgagagagccggcctggccgccagcctgcacctgaccgagacccaggtgaagatctggttccagaacagaagaaacaagtggaagagacagctggccgccgagctggaggccgccaacctgagccacgccgccgcccagagaatcgtgagagtgcccatcctgtaccacgagaacagcgccgccgagggcgccgccgccgccgccgccggcgcccccgtgcccgtgagccagcccctgctgaccttcccccaccccgtgtactacagccaccccgtggtgagcagcgtgcccctgctgagacccgtgtag

SEQ ID NO: 84038 - DNA, 3405 bp, Artificial Sequence
  Description of Artificial Sequence: Synthetic coding sequence
atggagagcacccccagcttcctgaagggcacccccacctgggagaagaccgcccccgagaacggcatcgtgagacaggagcccggcagcccccccagagacggcctgcaccacggccccctgtgcctgggcgagcccgcccccttctggagaggcgtgctgagcacccccgacagctggctgccccccggcttcccccagggccccaaggacatgctgcccctggtggagggcgagggcccccagaacggcgagagaaaggtgaactggctgggcagcaaggagggcctgagatggaaggaggccatgctgacccaccccctggccttctgcggccccgcctgcccccccagatgcggccccctgatgcccgagcacagcggcggccacctgaagagcgaccccgtggccttcagaccctggcactgccccttcctgctggagaccaagatcctggagagagcccccttctgggtgcccacctgcctgcccccctacctggtgagcggcctgccccccgagcacccctgcgactggcccctgaccccccacccctgggtgtacagcggcggccagcccaaggtgcccagcgccttcagcctgggcagcaagggcttctactacaaggaccccagcatccccagactggccaaggagcccctggccgccgccgagcccggcctgttcggcctgaacagcggcggccacctgcagagagccggcgaggccgagagacccagcctgcaccagagagacggcgagatgggcgccggcagacagcagaacccctgccccctgttcctgggccagcccgacaccgtgccctggaccagctggcccgcctgcccccccggcctggtgcacaccctgggcaacgtgtgggccggccccggcgacggcaacctgggctaccagctgggcccccccgccacccccagatgccccagccccgagccccccgtgacccagagaggctgctgcagcagctacccccccaccaagggcggcggcctgggcccctgcggcaagtgccaggagggcctggagggcggcgccagcggcgccagcgagcccagcgaggaggtgaacaaggccagcggccccagagcctgcccccccagccaccacaccaagctgaagaagacctggctgaccagacacagcgagcagttcgagtgccccagaggctgccccgaggtggaggagagacccgtggccagactgagagccctgaagagagccggcagccccgaggtgcagggcgccatgggcagccccgcccccaagagaccccccgaccccttccccggcaccgccgagcagggcgccggcggctggcaggaggtgagagacaccagcatcggcaacaaggacgtggacagcggccagcacgacgagcagaagggcccccaggacggccaggccagcctgcaggaccccggcctgcaggacatcccctgcctggccctgcccgccaagctggcccagtgccagagctgcgcccaggccgccggcgagggcggcggccacgcctgccacagccagcaggtgagaagaagccccctgggcggcgagctgcagcaggaggaggacaccgccaccaacagcagcagcgaggagggccccggcagcggccccgacagcagactgagcaccggcctggccaagcacctgctgagcggcctgggcgacagactgtgcagactgctgagaagagagagagaggccctggcctgggcccagagagagggccagggccccgccgtgaccgaggacagccccggcatccccagatgctgcagcagatgccaccacggcctgttcaacacccactggagatgccccagatgcagccacagactgtgcgtggcctgcggcagagtggccggcaccggcagagccagagagaaggccggcttccaggagcagagcgccgaggagtgcacccaggaggccggccacgccgcctgcagcctgatgctgacccagttcgtgagcagccaggccctggccgagctgagcaccgccatgcaccaggtgtgggtgaagttcgacatcagaggccactgcccctgccaggccgacgccagagtgtgggcccccggcgacgccggccagcagaaggagagcacccagaagaccccccccaccccccagcccagctgcaacggcgacacccacagaaccaagagcatcaaggaggagacccccgacagcgccgagacccccgccgaggacagagccggcagaggccccctgccctgccccagcctgtgcgagctgctggccagcaccgccgtgaagctgtgcctgggccacgagagaatccacatggccttcgcccccgtgacccccgccctgcccagcgacgacagaatcaccaacatcctggacagcatcatcgcccaggtggtggagagaaagatccaggagaaggccctgggccccggcctgagagccggccccggcctgagaaagggcctgggcctgcccctgagccccgtgagacccagactgcccccccccggcgccctgctgtggctgcaggagccccagccctgccccagaagaggcttccacctgttccaggagcactggagacagggccagcccgtgctggtgagcggcatccagagaaccctgcagggcaacctgtggggcaccgaggccctgggcgccctgggcggccaggtgcaggccctgagccccctgggccccccccagcccagcagcctgggcagcaccaccttctgggagggcttcagctggcccgagctgagacccaagagcgacgagggcagcgtgctgctgctgcacagagccctgggcgacgaggacaccagcagagtggagaacctggccgccagcctgcccctgcccgagtactgcgccctgcacggcaagctgaacctggccagctacctgccccccggcctggccctgagacccctggagccccagctgtgggccgcctacggcgtgagcccccacagaggccacctgggcaccaagaacctgtgcgtggaggtggccgacctggtgagcatcctggtgcacgccgacacccccctgcccgcctggcacagagcccagaaggacttcctgagcggcctggacggcgagggcctgtggagccccggcagccaggtgagcaccgtgtggcacgtgttcagagcccaggacgcccagagaatcagaagattcctgcagatggtgcagggcctggtgagcaccgtgagcgtgacccagcacttcctgagccccgagaccagcgccctgagcgcccagctgtgccaccagggccccagcctgccccccgactgccacctgctgtacgcccagatggactgggccgtgttccaggccgtgaaggtggccgtgggcaccctgcaggaggccaagtag

SEQ ID NO: 84039 - DNA, 3570 bp, Artificial Sequence
  Description of Artificial Sequence: Synthetic coding sequence
atggagagcacccccagcttcctgaagggcacccccacctgggagaagaccgcccccgagaacggcatcgtgagacaggagcccggcagcccccccagagacggcctgcaccacggccccctgtgcctgggcgagcccgcccccttctggagaggcgtgctgagcacccccgacagctggctgccccccggcttcccccagggccccaaggacatgctgcccctggtggagggcgagggcccccagaacggcgagagaaaggtgaactggctgggcagcaaggagggcctgagatggaaggaggccatgctgacccaccccctggccttctgcggccccgcctgcccccccagatgcggccccctgatgcccgagcacagcggcggccacctgaagagcgaccccgtggccttcagaccctggcactgccccttcctgctggagaccaagatcctggagagagcccccttctgggtgcccacctgcctgcccccctacctggtgagcggcctgccccccgagcacccctgcgactggcccctgaccccccacccctgggtgtacagcggcggccagcccaaggtgcccagcgccttcagcctgggcagcaagggcttctactacaaggaccccagcatccccagactggccaaggagcccctggccgccgccgagcccggcctgttcggcctgaacagcggcggccacctgcagagagccggcgaggccgagagacccagcctgcaccagagagacggcgagatgggcgccggcagacagcagaacccctgccccctgttcctgggccagcccgacaccgtgccctggaccagctggcccgcctgcccccccggcctggtgcacaccctgggcaacgtgtgggccggccccggcgacggcaacctgggctaccagctgggcccccccgccacccccagatgccccagccccgagccccccgtgacccagagaggctgctgcagcagctacccccccaccaagggcggcggcctgggcccctgcggcaagtgccaggagggcctggagggcggcgccagcggcgccagcgagcccagcgaggaggtgaacaaggccagcggccccagagcctgcccccccagccaccacaccaagctgaagaagacctggctgaccagacacagcgagcagttcgagtgccccagaggctgccccgaggtggaggagagacccgtggccagactgagagccctgaagagagccggcagccccgaggtgcagggcgccatgggcagccccgcccccaagagaccccccgaccccttccccggcaccgccgagcagggcgccggcggctggcaggaggtgagagacaccagcatcggcaacaaggacgtggacagcggccagcacgacgagcagaagggcccccaggacggccaggccagcctgcaggaccccggcctgcaggacatcccctgcctggccctgcccgccaagctggcccagtgccagagctgcgcccaggccgccggcgagggcggcggccacgcctgccacagccagcaggtgagaagaagccccctgggcggcgagctgcagcaggaggaggacaccgccaccaacagcagcagcgaggagggccccggcagcggccccgacagcagactgagcaccggcctggccaagcacctgctgagcggcctgggcgacagactgtgcagactgctgagaagagagagagaggccctggcctgggcccagagagagggccagggccccgccgtgaccgaggacagccccggcatccccagatgctgcagcagatgccaccacggcctgttcaacacccactggagatgccccagatgcagccacagactgtgcgtggcctgcggcagagtggccggcaccggcagagccagagagaaggccggcttccaggagcagagcgccgaggagtgcacccaggaggccggccacgccgcctgcagcctgatgctgacccagttcgtgagcagccaggccctggccgagctgagcaccgccatgcaccaggtgtgggtgaagttcgacatcagaggccactgcccctgccaggccgacgccagagtgtgggcccccggcgacgccggccagcagaaggagagcacccagaagaccccccccaccccccagcccagctgcaacggcgacacccacagaaccaagagcatcaaggaggagacccccgacagcgccgagacccccgccgaggacagagccggcagaggccccctgccctgccccagcctgtgcgagctgctggccagcaccgccgtgaagctgtgcctgggccacgagagaatccacatggccttcgcccccgtgacccccgccctgcccagcgacgacagaatcaccaacatcctggacagcatcatcgcccaggtggtggagagaaagatccaggagaaggccctgggccccggcctgagagccggccccggcctgagaaagggcctgggcctgcccctgagccccgtgagacccagactgcccccccccggcgccctgctgtggctgcaggagccccagccctgccccagaagaggcttccacctgttccaggagcactggagacagggccagcccgtgctggtgagcggcatccagagaaccctgcagggcaacctgtggggcaccgaggccctgggcgccctgggcggccaggtgcaggccctgagccccctgggccccccccagcccagcagcctgggcagcaccaccttctgggagggcttcagctggcccgagctgagacccaagagcgacgagggcagcgtgctgctgctgcacagagccctgggcgacgaggacaccagcagagtggagaacctggccgccagcctgcccctgcccgagtactgcgccctgcacggcaagctgaacctggccagctacctgccccccggcctggccctgagacccctggagccccagctgtgggccgcctacggcgtgagcccccacagaggccacctgggcaccaagaacctgtgcgtggaggtggccgacctggtgagcatcctggtgcacgccgacacccccctgcccgcctggcacagagcccagaaggacttcctgagcggcctggacggcgagggcctgtggagccccggcagccaggtgagcaccgtgtggcacgtgttcagagcccaggacgcccagagaatcagaagattcctgcagatggtgtgccccgccggcgccggcgccctggagcccggcgcccccggcagctgctacctggacgccggcctgagaagaagactgagagaggagtggggcgtgagctgctggaccctgctgcaggcccccggcgaggccgtgctggtgcccgccggcgccccccaccaggtgcagggcctggtgagcaccgtgagcgtgacccagcacttcctgagccccgagaccagcgccctgagcgcccagctgtgccaccagggccccagcctgccccccgactgccacctgctgtacgcccagatggactgggccgtgttccaggccgtgaaggtggccgtgggcaccctgcaggaggccaagtag

SEQ ID NO: 84040 - DNA, 1410 bp, Artificial Sequence
  Description of Artificial Sequence: Synthetic coding sequence
atggccagccccagagagctgacccagaaccccctgaagaagatctggatgccctacagcaacggcagacccgccctgcacgcctgccagagaggcgtgtgcatgaccaactgccccaccctgatcgtgatggtgggcctgcccgccagaggcaagacctacatcagcaagaagctgaccagatacctgaactggatcggcgtgcccaccagagagttcaacgtgggccagtacagaagagacgtggtgaagacctacaagagcttcgagttcttcctgcccgacaacgaggagggcctgaagatcagaaagcagtgcgccctggccgccctgagagacgtgagaagattcctgagcgaggagggcggccacgtggccgtgttcgacgccaccaacaccaccagagagagaagagccaccatcttcaacttcggcgagcagaacggctacaagaccttcttcgtggagagcatctgcgtggaccccgaggtgatcgccgccaacatcgtgcaggtgaagctgggcagccccgactacgtgaacagagacagcgacgaggccaccgaggacttcatgagaagaatcgagtgctacgagaacagctacgagagcctggacgaggacctggacagagacctgagctacatcaagatcatggacgtgggccagagctacgtggtgaacagagtggccgaccacatccagagcagaatcgtgtactacctgatgaacatccacgtgacccccagaagcatctacctgtgcagacacggcgagagcgagctgaacctgaagggcagaatcggcggcgaccccggcctgagccccagaggcagagagttcgccaagagcctggcccagttcatcagcgaccagaacatcaaggacctgaaggtgtggaccagccagatgaagagaaccatccagaccgccgaggccctgggcgtgccctacgagcagtggaaggtgctgaacgagatcgacgccggcgtgtgcgaggagatgacctacgaggagatccaggacaactaccccctggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaaggccgccgagcagctgccctacctgaagtgccccctgcacaccgtgctgaagctgacccccgtggcctacggctgcaaggtggagagcatcttcctgaacgtggccgccgtgaacacccacagagacagaccccagaacgtggacatcagcagaccccccgaggaggccctggtgaccgtgcccgcccaccagtag

SEQ ID NO: 84041 - DNA, 522 bp, Artificial Sequence
  Description of Artificial Sequence: Synthetic coding sequence
atgggcctgcccagaagagccggcgacgccgccgagctgagaaagagcctgaagcccctgctggagaagagaagaagagccagaatcaaccagagcctgagccagctgaagggcctgatcctgcccctgctgggcagagagaacagcaactgcagcaagctggagaaggccgacgtgctggagatgaccgtgagattcctgcaggagctgcccgccagcagctggcccaccgccgcccccctgccctgcgacagctacagagagggctacagcgcctgcgtggccagactggccagagtgctgcccgcctgcagagtgctggagcccgccgtgagcgccagactgctggagcacctgtggagaagagccgccagcgccaccctggacggcggcagagccggcgacagcagcggccccagcgcccccgcccccgcccccgccagcgcccccgagcccgccagcgcccccgtgcccagcccccccagccccccctgcggccccggcctgtggagaccctggtag

SEQ ID NO: 84042 - DNA, 231 bp, Artificial Sequence
  Description of Artificial Sequence: Synthetic coding sequence
atgggcctgcccagaagagccggcgacgccgccgagctgagaaagagcctgaagcccctgctggagaagagaagaagagccagaatcaaccagagcctgagccagctgaagggcctgatcctgcccctgctgggcagagaggacgccagcggctggcacacctggctgcccctgcacgcccagaactgcttcctgctgtacatccaggcccccgagcagccccccgcctag

SEQ ID NO: 84043 - DNA, 231 bp, Artificial Sequence; identical to SEQ ID NO: 84042
  Description of Artificial Sequence: Synthetic coding sequence

SEQ ID NO: 84044 - DNA, 561 bp, Artificial Sequence
  Description of Artificial Sequence: Synthetic coding sequence
atggagaagaagagaagagccagaatcaacgtgagcctggagcagctgaagagcctgctggagaagcactacagccaccagatcagaaagagaaagctggagaaggccgacatcctggagctgagcgtgaagtacatgagaagcctgcagaacagcctgcagggcctgtggcccgtgcccagaggcgccgagcagcccagcggcttcagaagctgcctgcccggcgtgagccagctgctgagaagaggcgacgaggtgggcagcggcctgagatgccccctggtgcccgagagcgccgccggcagcaccatggacagcgccggcctgggccaggaggcccccgccctgttcagaccctgcacccccgccgtgtgggcccccgcccccgccgccggcggccccagaagccccccccccctgctgctgctgcccgagagcctgcccggcagcagcgccagcgtgccccccccccagcccgccagcagcagatgcgccgagagccccggcctgggcctgagagtgtggagaccctggggcagccccggcgacgacctgaactag

SEQ ID NO: 84045 - DNA, 666 bp, Artificial Sequence
  Description of Artificial Sequence: Synthetic coding sequence
atggccgccgacacccccggcaagcccagcgccagccccatggccggcgcccccgccagcgccagcagaacccccgacaagcccagaagcgccgccgagcacagaaagagcagcaagcccgtgatggagaagagaagaagagccagaatcaacgagagcctggcccagctgaagaccctgatcctggacgccctgagaaaggagagcagcagacacagcaagctggagaaggccgacatcctggagatgaccgtgagacacctgagaagcctgagaagagtgcaggtgaccgccgccctgagcgccgaccccgccgtgctgggcaagtacagagccggcttccacgagtgcctggccgaggtgaacagattcctggccggctgcgagggcgtgcccgccgacgtgagaagcagactgctgggccacctggccgcctgcctgagacagctgggccccagcagaagacccgccagcctgagccccgccgcccccgccgaggcccccgcccccgaggtgtacgccggcagacccctgctgcccagcctgggcggccccttccccctgctggccccccccctgctgcccggcctgaccagagccctgcccgccgcccccagagccggcccccagggccccggcggcccctggagaccctggctgagatag

SEQ ID NO: 84046 - DNA, 744 bp, Artificial Sequence
  Description of Artificial Sequence: Synthetic coding sequence
atggccgccgacacccccggcaagcccagcgccagccccatggccggcgcccccgccagcgccagcagaacccccgacaagcccagaagcgccgccgagcacagaaaggtgggcagcagacccggcgtgagaggcgccaccggcggcagagagggcagaggcacccagcccgtgcccgacccccagagcagcaagcccgtgatggagaagagaagaagagccagaatcaacgagagcctggcccagctgaagaccctgatcctggacgccctgagaaaggagagcagcagacacagcaagctggagaaggccgacatcctggagatgaccgtgagacacctgagaagcctgagaagagtgcaggtgaccgccgccctgagcgccgaccccgccgtgctgggcaagtacagagccggcttccacgagtgcctggccgaggtgaacagattcctggccggctgcgagggcgtgcccgccgacgtgagaagcagactgctgggccacctggccgcctgcctgagacagctgggccccagcagaagacccgccagcctgagccccgccgcccccgccgaggcccccgcccccgaggtgtacgccggcagacccctgctgcccagcctgggcggccccttccccctgctggccccccccctgctgcccggcctgaccagagccctgcccgccgcccccagagccggcccccagggccccggcggcccctggagaccctggctgagatag

SEQ ID NO: 84047 - DNA, 501 bp, Artificial Sequence
  Description of Artificial Sequence: Synthetic coding sequence
atggcccccagcaccgtggccgtggagctgctgagccccaaggagaagaacagactgagaaagcccgtggtggagaagatgagaagagacagaatcaacagcagcatcgagcagctgaagctgctgctggagcaggagttcgccagacaccagcccaacagcaagctggagaaggccgacatcctggagatggccgtgagctacctgaagcacagcaaggccttcgtggccgccgccggccccaagagcctgcaccaggactacagcgagggctacagctggtgcctgcaggaggccgtgcagttcctgaccctgcacgccgccagcgacacccagatgaagctgctgtaccacttccagagaccccccgccgcccccgccgcccccgccaaggagcccaaggcccccggcgccgcccccccccccgccctgagcgccaaggccaccgccgccgccgccgccgcccaccagcccgcctgcggcctgtggagaccctggtag

SEQ ID NO: 84048 - DNA, 675 bp, Artificial Sequence
  Description of Artificial Sequence: Synthetic coding sequence
atggccccccccgccgcccccggcagagacagagtgggcagagaggacgaggacggctgggagaccagaggcgacagaaaggccagaaagcccctggtggagaagaagagaagagccagaatcaacgagagcctgcaggagctgagactgctgctggccggcgccgaggtgcaggccaagctggagaacgccgaggtgctggagctgaccgtgagaagagtgcagggcgtgctgagaggcagagccagagagagagagcagctgcaggccgaggccagcgagagattcgccgccggctacatccagtgcatgcacgaggtgcacaccttcgtgagcacctgccaggccatcgacgccaccgtggccgccgagctgctgaaccacctgctggagagcatgcccctgagagagggcagcagcttccaggacctgctgggcgacgccctggccggcccccccagagcccccggcagaagcggctggcccgccggcggcgcccccggcagccccatccccagcccccccggccccggcgacgacctgtgcagcgacctggaggaggcccccgaggccgagctgagccaggcccccgccgagggccccgacctggtgcccgccgccctgggcagcctgaccaccgcccagatcgccagaagcgtgtggagaccctggtag

SEQ ID NO: 84049 - DNA, 645 bp, Artificial Sequence
  Description of Artificial Sequence: Synthetic coding sequence
atggccccccccgccgcccccggcagagacagagtgggcagagaggacgaggacggctgggagaccagaggcgacagaaaggccagaaagcccctggtggagaagaagagaagagccagaatcaacgagagcctgcaggagctgagactgctgctggccggcgccgaggtgcaggccaagctggagaacgccgaggtgctggagctgaccgtgagaagagtgcagggcgtgctgagaggcagagccagaggcgagtggagaagaggcggcagaggcagaagacccagagcccccgtgacccccgccagaagaagaaccagcctgcccgcccccctgagctgcagaagaagaggcctgccccccgagcagggcgccccccccagactgctgggcgagcccagacccagaggccccggcggcctgggccacgccgtggccgcccacagagccggcagaggcagcctgccccccaccctgggccccagagccagagccgccgccggcggcagcgagagagccctgagatgcagactgcaccccgtgcacgccagaggcgcccacgtgagagtgcacgtgcccggccacagaagatacagaagatgcagagcccccgagcccagcgccagagtgcacgccgccgcctag

SEQ ID NO: 84050 - DNA, 669 bp, Artificial Sequence
  Description of Artificial Sequence: Synthetic coding sequence
atggccccccccgccgcccccggcagagacagagtgggcagagaggacgaggacggctgggagaccagaggcgacagaaaggccagaaagcccctggtggagaagaagagaagagccagaatcaacgagagcctgcaggagctgagactgctgctggccggcgccgaggccaagctggagaacgccgaggtgctggagctgaccgtgagaagagtgcagggcgtgctgagaggcagagccagagagagagagcagctgcaggccgaggccagcgagagattcgccgccggctacatccagtgcatgcacgaggtgcacaccttcgtgagcacctgccaggccatcgacgccaccgtggccgccgagctgctgaaccacctgctggagagcatgcccctgagagagggcagcagcttccaggacctgctgggcgacgccctggccggcccccccagagcccccggcagaagcggctggcccgccggcggcgcccccggcagccccatccccagcccccccggccccggcgacgacctgtgcagcgacctggaggaggcccccgaggccgagctgagccaggcccccgccgagggccccgacctggtgcccgccgccctgggcagcctgaccaccgcccagatcgccagaagcgtgtggagaccctggtag

SEQ ID NO: 84051 - DNA, 678 bp, Artificial Sequence
  Description of Artificial Sequence: Synthetic coding sequence
atggtgaccagagacagagccgagaacagagacggccccaagatgctgaagcccctggtggagaagagaagaagagacagaatcaacagaagcctggaggagctgagactgctgctgctggagagaaccagagaccagaacctgagaaaccccaagctggagaaggccgagatcctggagttcgccgtgggctacctgagagagagaagcagagtggagccccccggcgtgcccagaagccccgtgcaggacgccgaggccctggccagctgctacctgagcggcttcagagagtgcctgctgagactggccgccttcgcccacgacgccagccccgccgccagagcccagctgttcagcgccctgcacggctacctgagacccaagccccccagacccaagcccgtggaccccagaccccccgcccccagacccagcctggaccccgccgcccccgccctgggccccgccctgcaccagagaccccccgtgcaccagggccaccccagccccagatgcgcctggagccccagcctgtgcagccccagagccggcgacagcggcgcccccgcccccctgaccggcctgctgcccccccccccccccccccacagacaggacggcgcccccaaggcccccctgccccccccccccgccttctggagaccctggccctag

SEQ ID NO: 84052 - DNA, 693 bp, Artificial Sequence
  Description of Artificial Sequence: Synthetic coding sequence
atggtgaccagagacagagccgagaacagagacggccccaagatgctgaagcccctggtggagaagagaagaagagacagaatcaacagaagcctggaggagctgagactgctgctgctggagagaaccagagaccagaacctgagaaaccccaagctggagaaggccgagatcctggagttcgccgtgggctacctgagagagagaagcagagtggagccccccgccgccgccgcccccggcgtgcccagaagccccgtgcaggacgccgaggccctggccagctgctacctgagcggcttcagagagtgcctgctgagactggccgccttcgcccacgacgccagccccgccgccagagcccagctgttcagcgccctgcacggctacctgagacccaagccccccagacccaagcccgtggaccccagaccccccgcccccagacccagcctggaccccgccgcccccgccctgggccccgccctgcaccagagaccccccgtgcaccagggccaccccagccccagatgcgcctggagccccagcctgtgcagccccagagccggcgacagcggcgcccccgcccccctgaccggcctgctgcccccccccccccccccccacagacaggacggcgcccccaaggcccccctgccccccccccccgccttctggagaccctggccctag

SEQ ID NO: 84053 - DNA, 1014 bp, Artificial Sequence
  Description of Artificial Sequence: Synthetic coding sequence
atgaagagaccctgcgaggagaccaccagcgagagcgacatggacgagaccatcgacgtgggcagcgagaacaactacagcggccagagcaccagcagcgtgatcagactgaacagccccaccaccaccagccagatcatggccagaaagaagagaagaggcatcatcgagaagagaagaagagacagaatcaacaacagcctgagcgagctgagaagactggtgcccaccgccttcgagaagcagggcagcgccaagctggagaaggccgagatcctgcagatgaccgtggaccacctgaagatgctgcaggccaccggcggcaagggctacttcgacgcccacgccctggccatggacttcatgagcatcggcttcagagagtgcctgaccgaggtggccagatacctgagcagcgtggagggcctggacagcagcgaccccctgagagtgagactggtgagccacctgagcacctgcgccacccagagagaggccgccgccatgaccagcagcatggcccaccaccaccaccccctgcacccccaccactgggccgccgccttccaccacctgcccgccgccctgctgcagcccaacggcctgcacgccagcgagagcaccccctgcagactgagcaccaccagcgaggtgccccccgcccacggcagcgccctgctgaccgccaccttcgcccacgccgacagcgccctgagaatgcccagcaccggcagcgtggccccctgcgtgccccccctgagcaccagcctgctgagcctgagcgccaccgtgcacgccgccgccgccgccgccaccgccgccgcccacagcttccccctgagcttcgccggcgccttccccatgctgccccccaacgccgccgccgccgtggccgccgccaccgccatcagcccccccctgagcgtgagcgccaccagcagcccccagcagaccagcagcggcaccaacaacaagccctacagaccctggggcaccgaggtgggcgccttctag

SEQ ID NO: 84054 - DNA, 876 bp, Artificial Sequence
  Description of Artificial Sequence: Synthetic coding sequence
atggccagaaagaagagaagaggcatcatcgagaagagaagaagagacagaatcaacaacagcctgagcgagctgagaagactggtgcccaccgccttcgagaagcagggcagcgccaagctggagaaggccgagatcctgcagatgaccgtggaccacctgaagatgctgcaggccaccggcggcaagggctacttcgacgcccacgccctggccatggacttcatgagcatcggcttcagagagtgcctgaccgaggtggccagatacctgagcagcgtggagggcctggacagcagcgaccccctgagagtgagactggtgagccacctgagcacctgcgccacccagagagaggccgccgccatgaccagcagcatggcccaccaccaccaccccctgcacccccaccactgggccgccgccttccaccacctgcccgccgccctgctgcagcccaacggcctgcacgccagcgagagcaccccctgcagactgagcaccaccagcgaggtgccccccgcccacggcagcgccctgctgaccgccaccttcgcccacgccgacagcgccctgagaatgcccagcaccggcagcgtggccccctgcgtgccccccctgagcaccagcctgctgagcctgagcgccaccgtgcacgccgccgccgccgccgccaccgccgccgcccacagcttccccctgagcttcgccggcgccttccccatgctgccccccaacgccgccgccgccgtggccgccgccaccgccatcagcccccccctgagcgtgagcgccaccagcagcccccagcagaccagcagcggcaccaacaacaagccctacagaccctggggcaccgaggtgggcgccttctag

SEQ ID NO: 84055 - DNA, 1221 bp, Artificial Sequence
  Description of Artificial Sequence: Synthetic coding sequence
atgagcgccctgggcgccgtgatcgccctgctgctgtggggccagctgttcgccgtggacagcggcaacgacgtgaccgacatcgccgacgacggctgccccaagccccccgagatcgcccacggctacgtggagcacagcgtgagataccagtgcaagaactactacaagctgagaaccgagggcgacggcgtgtacaccctgaacgacaagaagcagtggatcaacaaggccgtgggcgacaagctgcccgagtgcgaggccgacgacggctgccccaagccccccgagatcgcccacggctacgtggagcacagcgtgagataccagtgcaagaactactacaagctgagaaccgagggcgacggcgtgtacaccctgaacaacgagaagcagtggatcaacaaggccgtgggcgacaagctgcccgagtgcgaggccgtgtgcggcaagcccaagaaccccgccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactacagccaggtggacatcggcctgatcaagctgaagcagaaggtgagcgtgaacgagagagtgatgcccatctgcctgcccagcaaggactacgccgaggtgggcagagtgggctacgtgagcggctggggcagaaacgccaacttcaagttcaccgaccacctgaagtacgtgatgctgcccgtggccgaccaggaccagtgcatcagacactacgagggcagcaccgtgcccgagaagaagacccccaagagccccgtgggcgtgcagcccatcctgaacgagcacaccttctgcgccggcatgagcaagtaccaggaggacacctgctacggcgacgccggcagcgccttcgccgtgcacgacctggaggaggacacctggtacgccaccggcatcctgagcttcgacaagagctgcgccgtggccgagtacggcgtgtacgtgaaggtgaccagcatccaggactgggtgcagaagaccatcgccgagaactag

SEQ ID NO: 84056 - DNA, 1149 bp, Artificial Sequence
  Description of Artificial Sequence: Synthetic coding sequence
gtgtacgcctgcgtgtgcgtgtgcgtgtacatgcacgtgtgcgtggacgcctgcatgtgctgcgaggccggcagactggccttccacagcagcctgagcagcctgtgcagcgccctgggcgccgtgatcgccctgctgctgtggggccagctgttcgccgtggacagcggcaacgacgtgaccgacatcgccgacgacggctgccccaagccccccgagatcgcccacggctacgtggagcacagcgtgagataccagtgcaagaactactacaagctgagaaccgagggcgacggcgtgtacaccctgaacgacaagaagcagtggatcaacaaggccgtgggcgacaagctgcccgagtgcgaggccgtgtgcggcaagcccaagaaccccgccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactacagccaggtggacatcggcctgatcaagctgaagcagaaggtgagcgtgaacgagagagtgatgcccatctgcctgcccagcaaggactacgccgaggtgggcagagtgggctacgtgagcggctggggcagaaacgccaacttcaagttcaccgaccacctgaagtacgtgatgctgcccgtggccgaccaggaccagtgcatcagacactacgagggcagcaccgtgcccgagaagaagacccccaagagccccgtgggcgtgcagcccatcctgaacgagcacaccttctgcgccggcatgagcaagtaccaggaggacacctgctacggcgacgccggcagcgccttcgccgtgcacgacctggaggaggacacctggtacgccaccggcatcctgagcttcgacaagagctgcgccgtggccgagtacggcgtgtacgtgaaggtgaccagcatccaggactgggtgcagaagaccatcgccgagaactag

SEQ ID NO: 84057 - DNA, 1044 bp, Artificial Sequence
  Description of Artificial Sequence: Synthetic coding sequence
atgagcgccctgggcgccgtgatcgccctgctgctgtggggccagctgttcgccgtggacagcggcaacgacgtgaccgacatcgccgacgacggctgccccaagccccccgagatcgcccacggctacgtggagcacagcgtgagataccagtgcaagaactactacaagctgagaaccgagggcgacggcgtgtacaccctgaacaacgagaagcagtggatcaacaaggccgtgggcgacaagctgcccgagtgcgaggccgtgtgcggcaagcccaagaaccccgccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactacagccaggtggacatcggcctgatcaagctgaagcagaaggtgagcgtgaacgagagagtgatgcccatctgcctgcccagcaaggactacgccgaggtgggcagagtgggctacgtgagcggctggggcagaaacgccaacttcaagttcaccgaccacctgaagtacgtgatgctgcccgtggccgaccaggaccagtgcatcagacactacgagggcagcaccgtgcccgagaagaagacccccaagagccccgtgggcgtgcagcccatcctgaacgagcacaccttctgcgccggcatgagcaagtaccaggaggacacctgctacggcgacgccggcagcgccttcgccgtgcacgacctggaggaggacacctggtacgccaccggcatcctgagcttcgacaagagctgcgccgtggccgagtacggcgtgtacgtgaaggtgaccagcatccaggactgggtgcagaagaccatcgccgagaactag

SEQ ID NO: 84058 - DNA, 846 bp, Artificial Sequence
  Description of Artificial Sequence: Synthetic coding sequence
atgagcagaatcagccagatgaccgccgccagaagcccccccagactgcacatggccatgtggagcaccagattcgccaccagcgtgagaaccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactacagccaggtggacatcggcctgatcaagctgaagcagaaggtgagcgtgaacgagagagtgatgcccatctgcctgcccagcaaggactacgccgaggtgggcagagtgggctacgtgagcggctggggcagaaacgccaacttcaagttcaccgaccacctgaagtacgtgatgctgcccgtggccgaccaggaccagtgcatcagacactacgagggcagcaccgtgcccgagaagaagacccccaagagccccgtgggcgtgcagcccatcctgaacgagcacaccttctgcgccggcatgagcaagtaccaggaggacacctgctacggcgacgccggcagcgccttcgccgtgcacgacctggaggaggacacctggtacgccaccggcatcctgagcttcgacaagagctgcgccgtggccgagtacggcgtgtacgtgaaggtgaccagcatccaggactgggtgcagaagaccatcgccgagaactag

SEQ ID NO: 84059 - DNA, 552 bp, Artificial Sequence
  Description of Artificial Sequence: Synthetic coding sequence
atgagcgccgccagagagagccacccccacggcgtgaagagaagcgccagccccgacgacgacctgggcagcagcaactgggaggccgccgacctgggcaacgaggagagaaagcagaagttcctgagactgatgggcgccggcaagaaggagcacaccggcagactggtgatcggcgaccacaagagcaccagccacttcagaaccggcgaggaggacaagaagatcaacgaggagctggagagccagtaccagcagagcatggacagcaagctgagcggcagatacagaagacactgcggcctgggcttcagcgaggtggaggaccacgacggcgagggcgacgtggccggcgacgacgacgacgacgacgacgacagccccgaccccgagagccccgacgacagcgagagcgacagcgagagcgagaaggaggagagcgccgaggagctgcaggccgccgagcaccccgacgaggtggaggaccccaagaacaagaaggacgccaagagcaactacaagatgatgttcgtgaagagcagcggcagctag

SEQ ID NO: 84060 - DNA, 1047 bp, Artificial Sequence
  Description of Artificial Sequence: Synthetic coding sequence
atgagcgacctgggcgccgtgatcagcctgctgctgtggggcagacagctgttcgccctgtacagcggcaacgacgtgaccgacatcagcgacgacagattccccaagccccccgagatcgccaacggctacgtggagcacctgttcagataccagtgcaagaactactacagactgagaaccgagggcgacggcgtgtacaccctgaacgacaagaagcagtggatcaacaaggccgtgggcgacaagctgcccgagtgcgaggccgtgtgcggcaagcccaagaaccccgccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactaccaccaggtggacatcggcctgatcaagctgaagcagaaggtgctggtgaacgagagagtgatgcccatctgcctgcccagcaagaactacgccgaggtgggcagagtgggctacgtgagcggctggggccagagcgacaacttcaagctgaccgaccacctgaagtacgtgatgctgcccgtggccgaccagtacgactgcatcacccactacgagggcagcacctgccccaagtggaaggcccccaagagccccgtgggcgtgcagcccatcctgaacgagcacaccttctgcgtgggcatgagcaagtaccaggaggacacctgctacggcgacgccggcagcgccttcgccgtgcacgacctggaggaggacacctggtacgccgccggcatcctgagcttcgacaagagctgcgccgtggccgagtacggcgtgtacgtgaaggtgaccagcatccagcactgggtgcagaagaccatcgccgagaactag

SEQ ID NO: 84061 - DNA, 1047 bp, Artificial Sequence; identical to SEQ ID NO: 84060
  Description of Artificial Sequence: Synthetic coding sequence

SEQ ID NO: 84062 - DNA, 615 bp, Artificial Sequence
  Description of Artificial Sequence: Synthetic coding sequence
atggccgccgccaacccctgggaccccgccagcgcccccaacggcgccggcctggtgctgggccacttcatcgccagcggcatggtgaaccagaagaacctggagatcgagctgctgaagctggagaaggacaccgccgacgtggtgcaccccttcttcctggcccagaagtgccacaccctgcagagcatgaacaaccacctggaggccgtgctgaaggagaagagaagcctgagacagagactgctgaagcccatgtgccaggagaacctgcccatcgaggccgtgtaccacagatacatggtgcacctgctggagctggccgtgaccttcatcgagagactggagacccacctggagaccatcagaaacatcccccacctggccgccaacctgaagaagatgaaccaggccctggccaagatggacatcctggtgaccgagaccgaggagctggccgagaacatcctgaagtggagaaagcagcagaacgaggtgagcagctgcatccccaagatcctggccgaggagagctacctgtacaagcacgacatcatcatgccccccctgcccttcaccagcaaggtgcacgtgcagaccatcaacgccaagtag

SEQ ID NO: 84063 - DNA, 837 bp, Artificial Sequence
  Description of Artificial Sequence: Synthetic coding sequence
atggagccccaggaggagagagagacccaggtggccgcctggctgaagaagatcttcggcgaccaccccatcccccagtacgaggtgaaccccagaaccaccgagatcctgcaccacctgagcgagagaaacagagtgagagacagagacgtgtacctggtgatcgaggacctgaagcagaaggccagcgagtacgagagcgaggccaagtacctgcaggacctgctgatggagagcgtgaacttcagccccgccaacctgagcagcaccggcagcagatacctgaacgccctggtggacagcgccgtggccctggagaccaaggacaccagcctggccagcttcatccccgccgtgaacgacctgaccagcgacctgttcagaaccaagagcaagagcgaggagatcaagatcgagctggagaagctggagaagaacctgaccgccaccctggtgctggagaagtgcctgcaggaggacgtgaagaaggccgagctgcacctgagcaccgagagagccaaggtggacaacagaagacagaacatggacttcctgaaggccaagagcgaggagttcagattcggcatcaaggccgccgaggagcagctgagcgccagaggcatggacgccagcctgagccaccagagcctggtggccctgagcgagaagctggccagactgaagcagcagaccatccccctgaagaagaagctggagagctacctggacctgatgcccaaccccagcctggcccaggtgaagatcgaggaggccaagagagagctggacagcatcgaggccgagctgaccagaagagtggacatgatggagctgtag

SEQ ID NO: 84064 - DNA, 708 bp, Artificial Sequence
  Description of Artificial Sequence: Synthetic coding sequence
atggccgccgccaacccctgggaccccgccagcgcccccaacggcgccggcctggtgctgggccacttcatcgccagcggcatggtgaaccaggagatgctgaacatgagcaagaagaccgtgagctgcttcgtgaacttcaccagactgcagcagatcaccaacatccaggccgagatctaccagaagaacctggagatcgagctgctgaagctggagaaggacaccgccgacgtggtgcaccccttcttcctggcccagaagtgccacaccctgcagagcatgaacaaccacctggaggccgtgctgaaggagaagagaagcctgagacagagactgctgaagcccatgtgccaggagaacctgcccatcgaggccgtgtaccacagatacatggtgcacctgctggagctggccgtgaccttcatcgagagactggagacccacctggagaccatcagaaacatcccccacctggccgccaacctgaagaagatgaaccaggccctggccaagatggacatcctggtgaccgagaccgaggagctggccgagaacatcctgaagtggagaaagcagcagaacgaggtgagcagctgcatccccaagatcctggccgaggagagctacctgtacaagcacgacatcatcatgccccccctgcccttcaccagcaaggtgcacgtgcagaccatcaacgccaagtag

SEQ ID NO: 84065 - DNA, 615 bp, Artificial Sequence; identical to SEQ ID NO: 84062
  Description of Artificial Sequence: Synthetic coding sequence

SEQ ID NO: 84066 - DNA, 1812 bp, Artificial Sequence
  Description of Artificial Sequence: Synthetic coding sequence
atgagctgcggcaacgagttcgtggagaccctgaagaagatcggctaccccaaggccgacaacctgaacggcgaggacttcgactggctgttcgagggcgtggaggacgagagcttcctgaagtggttctgcggcaacgtgaacgagcagaacgtgctgagcgagagagagctggaggccttcagcatcctgcagaagagcggcaagcccatcctggagggcgccgccctggacgaggccctgaagacctgcaagaccagcgacctgaagacccccagactggacgacaaggagctggagaagctggaggacgaggtgcagaccctgctgaagctgaagaacctgaagatccagagaagaaacaagtgccagctgatggccagcgtgaccagccacaagagcctgagactgaacgccaaggaggaggaggccaccaagaagctgaagcagagccagggcatcctgaacgccatgatcaccaagatcagcaacgagctgcaggccctgaccgacgaggtgacccagctgatgatgttcttcagacacagcaacctgggccagggcaccaaccccctggtgttcctgagccagttcagcctggagaagtacctgagccaggaggagcagagcaccgccgccctgaccctgtacaccaagaagcagttcttccagggcatccacgaggtggtggagagcagcaacgaggacaacttccagctgctggacatccagacccccagcatctgcgacaaccaggagatcctggaggagagaagactggagatggccagactgcagctggcctacatctgcgcccagcaccagctgatccacctgaaggccagcaacagcagcatgaagagcagcatcaagtgggccgaggagagcctgcacagcctgaccagcaaggccgtggacaaggagaacctggacgccaagatcagcagcctgaccagcgagatcatgaagctggagaaggaggtgacccagatcaaggacagaagcctgcccgccgtggtgagagagaacgcccagctgctgaacatgcccgtggtgaagggcgacttcgacctgcagatcgccaagcaggactactacaccgccagacaggagctggtgctgaaccagctgatcaagcagaaggccagcttcgagctgctgcagctgagctacgagatcgagctgagaaagcacagagacatctacagacagctggagaacctggtgcaggagctgagccagagcaacatgatgctgtacaagcagctggagatgctgaccgaccccagcgtgagccagcagatcaaccccagaaacaccatcgacaccaaggactacagcacccacagactgtaccaggtgctggagggcgagaacaagaagaaggagctgttcctgacccacggcaacctggaggaggtggccgagaagctgaagcagaacatcagcctggtgcaggaccagctggccgtgagcgcccaggagcacagcttcttcctgagcaagagaaacaaggacgtggacatgctgtgcgacaccctgtaccagggcggcaaccagctgctgctgagcgaccaggagctgaccgagcagttccacaaggtggagagccagctgaacaagctgaaccacctgctgaccgacatcctggccgacgtgaagaccaagagaaagaccctggccaacaacaagctgcaccagatggagagagagttctacgtgtacttcctgaaggacgaggactacctgaaggacatcgtggagaacctggagacccagagcaagatcaaggccgtgagcctggaggactag

SEQ ID NO: 84067 - DNA, 1812 bp, Artificial Sequence; identical to SEQ ID NO: 84066
  Description of Artificial Sequence: Synthetic coding sequence

SEQ ID NO: 84068 - DNA, 33 bp, Artificial Sequence
  Description of Artificial Sequence: Synthetic coding sequence
atgagctgcggcaacgagttcgtggagacctag

SEQ ID NO: 84069 - DNA, 102 bp, Artificial Sequence
  Description of Artificial Sequence: Synthetic coding sequence
atgagctgcggcaacgagttcgtggagaccctgaagaagatcggctaccccaaggccgacaacctgaacggcgaggacttcgactggctgttcgagggctag

SEQ ID NO: 84070 - DNA, 456 bp, Artificial Sequence
  Description of Artificial Sequence: Synthetic coding sequence
atgggcaagagacccaacctgctggccctgcagctgagcgacagcaccctggccgacatcatcgccagactgcaggccggccagaagctgagcggcagcagccccttcagcagcgccttcaacagcctgagcctggacaaggagagcggcctgctgatgttcaagggcgacaagaagcccagagtgtgggtggtgcccacccagctgagaagagacctgatcttcagcgtgcacgacatccccctgggcgcccaccagagacccgaggagacctacaagaagctgagactgctgggctggtggcccggcatgcaggagcacgtgaaggactactgcagaagctgcctgttctgcatccccagaaacctgatcggcagcgagctgaaggtgatcgagagcccccccgccagcgtgctgagaggccagggcgtgtgcaacagaagcggcaccagatag

SEQ ID NO: 84071 - DNA, 957 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaaggacttcgtgtggatgagagccagactgcagcaggaggtggaggagcagctgaagaagaagtgcttcaccctgctgtgctactacgaccccaacagcgacgccgacagcgagaccgtgaaggccgccaaggtgtggaagctggccgaggtgctggtgggcgagcagcagcagtgccaggacgccaagagccagcagaaggagcagatgctgctgctggagaagaagagcgccgcctacagccaggtgctgctgagatgcctgaccctgctgcagagactgctgcaggagcacagactgaagacccagagcgagctggacagaatcaacgcccagtacctggaggtgaagtgcggcgccatgatcctgaagctgagaatggaggagctgaagatcctgagcgacacctacaccgtggagaaggtggaggtgcacagactgatcagagacagactggagggcgccatccacctgcaggagcaggacatggagaacagcagacaggtgctgaacagctacgaggtgctgggcgaggagttcgacagactggtgaaggagtacaccgtgctgaagcaggccaccgagaacaagagatgggccctgcaggagttcagcaaggtgtacagatag

SEQ ID NO: 84072 - DNA, 714 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaaggtgctgctgagatgcctgaccctgctgcagagactgctgcaggagcacagactgaagacccagagcgagctggacagaatcaacgcccagtacctggaggtgaagtgcggcgccatgatcctgaagctgagaatggaggagctgaagatcctgagcgacacctacaccgtggagaaggtggaggtgcacagactgatcagagacagactggagggcgccatccacctgcaggagcaggacatggagaacagcagacaggtgctgaacagctacgaggtgctgggcgaggagttcgacagactggtgaaggagtacaccgtgctgaagcaggccaccgagaacaagagatgggccctgcaggagttcagcaaggtgtacagatag

SEQ ID NO: 84073 - DNA, 714 bp, Artificial Sequence; identical to SEQ ID NO: 84072
  Description of Artificial Sequence: Synthetic coding sequence

SEQ ID NO: 84074 - DNA, 720 bp, Artificial Sequence
  Description of Artificial Sequence: Synthetic coding sequence
atgagactgctgggccccagccaggagagagagatcccccccctgctgggcctggagaaggccgacctgctggagctgatgcccctgagcgaggacttcgtgtggatgagagccagactgcagcaggaggtggaggagcagctgaagaagaagtgcttcaccctgctgtgctactacgaccccaacagcgacgccgacagcgagaccgtgaaggccgccaaggtgtggaagctggccgaggtgctggtgggcgagcagcagcagtgccaggacgccaagagccagcagaaggagcagatgctgctgctggagaagaagagcgccgcctacagccaggtgctgctgagatgcctgaccctgctgcagagactgctgcaggagcacagactgaagacccagagcgagctggacagaatcaacgcccagtacctggaggtgaagtgcggcgccatgatcctgaagctgagaatggaggagctgaagatcctgagcgacacctacaccgtggagaaggtggaggtgcacagactgatcagagacagactggagggcgccatccacctgcaggagcaggacatggagaacagcagacaggtgctgaacagctacgaggtgctgggcgaggagttcgacagactggtgaaggagtacaccgtgctgaagcaggccaccgagaacaagagatgggccctgcaggagttcagcaaggtgtacagatag

SEQ ID NO: 84075 - DNA, 1092 bp, Artificial Sequence; identical to SEQ ID NO: 75767
  Description of Artificial Sequence: Synthetic coding sequence

SEQ ID NO: 84076 - DNA, 54 bp, Artificial Sequence
  Description of Artificial Sequence: Synthetic coding sequence
atgagactgctgggccccagccaggagagagagatcccccccctgctgggctag

SEQ ID NO: 84077 - DNA, 564 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaagttccacgagaccctggagcagagactgctggtgaccgagctgatgagactgctgggccccagccaggagagagagatcccccccctgctgggcctggagaaggccgacctgctggagctgatgcccctgagcgaggacttcgtgtggatgagagccagactgcagcaggaggtggaggagcagctgaagaagaagtgcttcaccctgctgtgctactacgaccccaacagctag

SEQ ID NO: 84078 - DNA, 840 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaagttccacgagaccctggagcagagactgctggtgaccgagctgatgagactgctgggccccagccaggagagagagatcccccccctgctgggcctggagaaggccgacctgctggagctgatgcccctgagcgaggacttcgtgtggatgagagccagactgcagcaggaggtggaggagcagctgaagaagaagtgcttcaccctgctgtgctactacgaccccaacagcgacgccgacagcgagaccgtgaaggccgccaaggtgtggaagctggccgaggtgctggtgggcgagcagcagcagtgccaggacgccaagagccagcagaaggagcagatgctgctgctggagaagaagagcgccgcctacagccaggtgctgctgagatgcctgaccctgctgcagagactgctgcaggagcacagactgaagacccagagcgagctggacagaatcaacgcccagtacctggaggtgaagtgcggcgccatgatcctgaagctgtag

SEQ ID NO: 84079 - DNA, 957 bp, Artificial Sequence; identical to SEQ ID NO: 84071
  Description of Artificial Sequence: Synthetic coding sequence

SEQ ID NO: 84080 - DNA, 957 bp, Artificial Sequence; identical to SEQ ID NO: 84071
  Description of Artificial Sequence: Synthetic coding sequence

SEQ ID NO: 84081 - DNA, 483 bp, Artificial Sequence
  Description of Artificial Sequence: Synthetic coding sequence
atggccagcggcgacttctgcagccccggcgagggcatggagatcctgcagcaggtgtgcagcaagcagctgcccccctgcaacctgagcaaggaggacctgctgcagaacccctacttcagcaagctgctgctgaacctgagccagcacgtggacgagagcggcctgagcctgaccctggccaaggagcaggcccaggcctggaaggaggtgagactgcacaagaccacctggctgagaagcgagatcctgcacagagtgatccaggagctgctggtggactactacgtgaagatccaggacaccaacgtgaccagcgaggacaagaagttccacgagaccctggagcagagactgctggtgaccgagctgatgagactgctgggccccagccaggagagagagatcccccccctgctgggcctggagaaggccgacctgctggagctgatgcccctgagcgaggacttcgtgtggatgtag

SEQ ID NO: 84082 - DNA, 1902 bp, Artificial Sequence
  Description of Artificial Sequence: Synthetic coding sequence
atggagctggcccaggaggccagagagctgggctgctgggccgtggaggagatgggcgtgcccgtggccgccagagcccccgagagcaccctgagaagactgtgcctgggccagggcgccgacatctgggcctacatcctgcagcacgtgcacagccagagaaccgtgaagaagatcagaggcaacctgctgtggtacggccaccaggacagcccccaggtgagaagaaagctggagctggaggccgccgtgaccagactgagagccgagatccaggagctggaccagagcctggagctgatggagagagacaccgaggcccaggacaccgccatggagcaggccagacagcacacccaggacacccagagaagagccctgctgctgagagcccaggccggcgccatgagaagacagcagcacaccctgagagaccccatgcagagactgcagaaccagctgagaagactgcaggacatggagagaaaggccaaggtggacgtgaccttcggcagcctgaccagcgccgccctgggcctggagcccgtggtgctgagagacgtgagaaccgcctgcaccctgagagcccagttcctgcagaacctgctgctgccccaggccaagagaggcagcctgcccaccccccacgacgaccacttcggcaccagctaccagcagtggctgagcagcgtggagaccctgctgaccaaccacccccccggccacgtgctggccgccctggagcacctggccgccgagagagaggccgagatcagaagcctgtgcagcggcgacggcctgggcgacaccgagatcagcagaccccaggcccccgaccagagcgacagcagccagaccctgcccagcatggtgcacctgatccaggagggctggagaaccgtgggcgtgctggtgagccagagaagcaccctgctgaaggagagacaggtgctgacccagagactgcagggcctggtggaggaggtggagagaagagtgctgggcagcagcgagagacaggtgctgatcctgggcctgagaagatgctgcctgtggaccgagctgaaggccctgcacgaccagagccaggagctgcaggacgccgccggccacagacagctgctgctgagagagctgcaggccaagcagcagagaatcctgcactggagacagctggtggaggagacccaggagcaggtgagactgctgatcaagggcaacagcgccagcaagaccagactgtgcagaagccccggcgaggtgctggccctggtgcagagaaaggtggtgcccaccttcgaggccgtggccccccagagcagagagctgctgagatgcctggaggaggaggtgagacacctgccccacatcctgctgggcaccctgctgagacacagacccggcgagctgaagcccctgcccaccgtgctgcccagcatccaccagctgcaccccgccagccccagaggcagcagcttcatcgccctgagccacaagctgggcctgccccccggcaaggccagcgagctgctgctgcccgccgccgccagcctgagacaggacctgctgctgctgcaggaccagagaagcctgtggtgctgggacctgctgcacatgaagaccagcctgccccccggcctgcccacccaggagctgctgcagatccaggccagccaggagaagcagcagaaggagaacctgggccaggccctgaagagactggagaagctgctgaagcaggccctggagagaatccccgagctgcagggcatcgtgggcgactggtgggagcagcccggccaggccgccctgagcgaggagctgtgccagggcctgagcctgccccagtggagactgagatgggtgcaggcccagggcgccctgcagaagctgtgcagctag

SEQ ID NO: 84083 - DNA, 873 bp, Artificial Sequence
  Description of Artificial Sequence: Synthetic coding sequence
atggagctggcccaggaggccagagagctgggctgctgggccgtggaggagatgggcgtgcccgtggccgccagagcccccgagagcaccctgagaagactgtgcctgggccagggcgccgacatctgggcctacatcctgcagcacgtgcacagccagagaaccgtgaagaagatcagaggcaacctgctgtggtacggccaccaggacagcccccaggtgagaagaaagctggagctggaggccgccgtgaccagactgagagccgagatccaggagctggaccagagcctggagctgatggagagagacaccgaggcccaggacaccgccatggagcaggccagacagcacacccaggacacccagagaagagccctgctgctgagagcccaggccggcgccatgagaagacagcagcacaccctgagagaccccatgcagagactgcagaaccagctgagaagactgcaggacatggagagaaaggccaaggtggacgtgaccttcggcagcctgaccagcgccgccctgggcctggagcccgtggtgctgagagacgtgagaaccgcctgcaccctgagagcccagttcctgcagaacctgctgctgccccaggccaagagaggcagcctgcccaccccccacgacgaccacttcggcaccagctaccagcagtggctgagcagcgtggagaccctgctgaccaaccacccccccggccacgtgctggccgccctggagcacctggccgccgagagagaggccgagatcagaagcctgtgcagcggcgacggcctgggcgacaccgagatcagcagaagagccggcggcctgtgggtgtgctggagccccagcggcgcccccagctag

SEQ ID NO: 84084 - DNA, 2409 bp, Artificial Sequence
  Description of Artificial Sequence: Synthetic coding sequence
atgaagtacatcaagagcaacagcaagaacagcagccaccacttcgtggagaccttcaacatcaagccccaggacctgcacaagtgcatcgccagatgccacttcgccagaagcagattcctgcagatcctgcagagacaggactgcgtgacccagaagtaccaggagaacgcccagctgagcgtgaagcaggtgagaaacctgagaagcgagtgcatcggcctggagaaccagatcaagaagatggagccctacgacgaccacagcaacatggaggagaagatccagaaggtgagaagcctgtgggccagcgtgaacgagaccctgatgttcctggagaaggagagagaggtggtgagcagcgtgctgagcctggtgaaccagtacgccctggacggcaccaacgtggccatcaacatccccagactgctgctggacaagatcgagaagcagatgttccagctgcacatcggcaacgtgtacgaggccggcaagctgaacctgctgaccgtgatccagctgctgaacgaggtgctgaaggtgatgaagtacgagagatgccaggccgaccaggccagactgaccgtggacctgcactacctggagaaggagaccaagttccagaaggagagactgagcgacctgaagcacatgagatacagaatcaaggacgacctgaccaccatcagacacagcgtggtggagaagcagggcgagtggcacaagaagtggaaggagttcctgggcctgagccccttcagcctgatcaagggctggacccccagcgtggacctgctgccccccatgagccccctgagcttcgaccccgccagcgaggaggtgtacgccaagagcatcctgtgccagtaccccgccagcctgcccgacgcccacaagcagcacaaccaggagaacggctgcagaggcgacagcgacaccctgggcgccctgcacgacctggccaacagccccgccagcttcctgagccagagcgtgagcagcagcgacagaaacagcgtgaccgtgctggagaaggacaccaagatgggcacccccaaggagaagaacgaggccatcagcaagaagatccccgagttcgaggtggagaacagccccctgagcgacgtggccaagaacaccgagagcagcgccttcggcggcagcctgcccgccaagaagagcgaccccttccagaaggagcaggaccacctggtggaggaggtggccagagccgtgctgagcgacagcccccagctgagcgagggcaaggagatcaagctggaggagctgatcgacagcctgggcagcaaccccttcctgaccagaaaccagatccccagaacccccgagaacctgatcaccgagatcagaagcagctggagaaaggccatcgagatggaggagaacagaaccaaggagcccatccagatggacgccgagcacagagaggtgctgcccgagagcctgcccgtgctgcacaaccagagagagttcagcatggccgacttcctgctggagaccaccgtgagcgacttcggccagagccacctgaccgaggagaaggtgatcagcgactgcgagtgcgtgccccagaagcacgtgctgaccagccacatcgacgagccccccacccagaaccagagcgacctgctgaacaagaaggtgatctgcaagcaggacctggagtgcctggccttcaccaagctgagcgagaccagcagaatggagaccttcagccccgccgtgggcaacagaatcgacgtgatgggcggcagcgaggaggagttcatgaagatcctggaccacctggaggtgagctgcaacaagcccagcaccaacaagaccatgctgtggaacagcttccagatcagcagcggcatcagcagcaagagcttcaaggacaacgacttcggcatcctgcacgagaccctgcccgaggaggtgggccacctgagcttcaacagcagcagcagcagcgaggccaacttcaagctggagcccaacagccccatgcacggcggcaccctgctggaggacgtggtgggcggcagacagaccacccccgagagcgacttcaacctgcaggccctgagaagcagatacgaggccctgaagaagagcctgagcaagaagagagaggagagctacctgagcaacagccagacccccgagagacacaagcccgagctgagccccaccccccagaacgtgcagaccgacgacaccctgaacttcctggacacctgcgacctgcacaccgagcacatcaagcccagcctgagaaccagcatcggcgagagaaagagaagcctgagccccctgatcaagttcagccccgtggagcagagactgagaaccaccatcgcctgcagcctgggcgagctgcccaacctgaagggcaaggtgtag

SEQ ID NO: 84085 - DNA, 2868 bp, Artificial Sequence
  Description of Artificial Sequence: Synthetic coding sequence
atgagcagcgccagcgtgaccgccttcgagaaggagcacctgtggatgtacctgcaggccctgggcttcgagcccggccccgccaccatcgcctgcggcaagatcgtgagccacacccacctgggcgtgaacatgttcgacaagctgaacagagacgccttccacatcatcagctacttcctgttccaggtgctggaccagagcctgaccaaggaggtgttcaagttctgctggccccccttcgaccagaagagcgacaccgagttcagaaagcactgctgcgagtggatcaagagaatcagcggcgagtgcggcagcagcttcccccaggtggtgggcagcctgttcctgagccccggcggccccaagttcatccacctgatgtaccacttcgccagattcgtggccatgaagtacatcaagagcaacagcaagaacagcagccaccacttcgtggagaccttcaacatcaagccccaggacctgcacaagtgcatcgccagatgccacttcgccagaagcagattcctgcagatcctgcagagacaggactgcgtgacccagaagtaccaggagaacgcccagctgagcgtgaagcaggtgagaaacctgagaagcgagtgcatcggcctggagaaccagatcaagaagatggagccctacgacgaccacagcaacatggaggagaagatccagaaggtgagaagcctgtgggccagcgtgaacgagaccctgatgttcctggagaaggagagagaggtggtgagcagcgtgctgagcctggtgaaccagtacgccctggacggcaccaacgtggccatcaacatccccagactgctgctggacaagatcgagaagcagatgttccagctgcacatcggcaacgtgtacgaggccggcaagctgaacctgctgaccgtgatccagctgctgaacgaggtgctgaaggtgatgaagtacgagagatgccaggccgaccaggccagactgaccgtggacctgcactacctggagaaggagaccaagttccagaaggagagactgagcgacctgaagcacatgagatacagaatcaaggacgacctgaccaccatcagacacagcgtggtggagaagcagggcgagtggcacaagaagtggaaggagttcctgggcctgagccccttcagcctgatcaagggctggacccccagcgtggacctgctgccccccatgagccccctgagcttcgaccccgccagcgaggaggtgtacgccaagagcatcctgtgccagtaccccgccagcctgcccgacgcccacaagcagcacaaccaggagaacggctgcagaggcgacagcgacaccctgggcgccctgcacgacctggccaacagccccgccagcttcctgagccagagcgtgagcagcagcgacagaaacagcgtgaccgtgctggagaaggacaccaagatgggcacccccaaggagaagaacgaggccatcagcaagaagatccccgagttcgaggtggagaacagccccctgagcgacgtggccaagaacaccgagagcagcgccttcggcggcagcctgcccgccaagaagagcgaccccttccagaaggagcaggaccacctggtggaggaggtggccagagccgtgctgagcgacagcccccagctgagcgagggcaaggagatcaagctggaggagctgatcgacagcctgggcagcaaccccttcctgaccagaaaccagatccccagaacccccgagaacctgatcaccgagatcagaagcagctggagaaaggccatcgagatggaggagaacagaaccaaggagcccatccagatggacgccgagcacagagaggtgctgcccgagagcctgcccgtgctgcacaaccagagagagttcagcatggccgacttcctgctggagaccaccgtgagcgacttcggccagagccacctgaccgaggagaaggtgatcagcgactgcgagtgcgtgccccagaagcacgtgctgaccagccacatcgacgagccccccacccagaaccagagcgacctgctgaacaagaaggtgatctgcaagcaggacctggagtgcctggccttcaccaagctgagcgagaccagcagaatggagaccttcagccccgccgtgggcaacagaatcgacgtgatgggcggcagcgaggaggagttcatgaagatcctggaccacctggaggtgagctgcaacaagcccagcaccaacaagaccatgctgtggaacagcttccagatcagcagcggcatcagcagcaagagcttcaaggacaacgacttcggcatcctgcacgagaccctgcccgaggaggtgggccacctgagcttcaacagcagcagcagcagcgaggccaacttcaagctggagcccaacagccccatgcacggcggcaccctgctggaggacgtggtgggcggcagacagaccacccccgagagcgacttcaacctgcaggccctgagaagcagatacgaggccctgaagaagagcctgagcaagaagagagaggagagctacctgagcaacagccagacccccgagagacacaagcccgagctgagccccaccccccagaacgtgcagaccgacgacaccctgaacttcctggacacctgcgacctgcacaccgagcacatcaagcccagcctgagaaccagcatcggcgagagaaagagaagcctgagccccctgatcaagttcagccccgtggagcagagactgagaaccaccatcgcctgcagcctgggcgagctgcccaacctgaaggaggaggacatcctgaacaagagcctggacgccaaggagccccccagcgacctgaccagatag

SEQ ID NO: 84086 - DNA, 552 bp, Artificial Sequence
  Description of Artificial Sequence: Synthetic coding sequence
atgggcacccccaaggagaagaacgaggccatcagcaagaagatccccgagttcgaggtggagaacagccccctgagcgacgtggccaagaacaccgagagcagcgccttcggcggcagcctgcccgccaagaagagcgaccccttccagaaggagcaggaccacctggtggaggaggtggccagagccgtgctgagcgacagcccccagctgagcgagggcaaggagatcaagctggaggagctgatcgacagcctgggcagcaaccccttcctgaccagaaaccagatccccagaacccccgagaacctgatcaccgagatcagaagcagctggagaaaggccatcgagatggaggagaacagaaccaaggagcccatccagatggacgccgagcacagagaggtgctgcccgagagcctgcccgtgctgcacaaccagagagagttcagcatggccgacttcctgctggagaccaccgtgagcgacttcggccagagccacctgaccgaggagaaggtgatcagcgactgcgagtgcgtgccccagtag

SEQ ID NO: 84087 - DNA, 1077 bp, Artificial Sequence
  Description of Artificial Sequence: Synthetic coding sequence
atggccggccaggacgccggctgcggcagaggcggcgacgactacagcgaggacgagggcgacagcagcgtgagcagagccgccgtggaggtgttcggcaagctgaaggacctgaactgccccttcctggagggcctgtacatcaccgagcccaagaccatccaggagctgctgtgcagccccagcgagtacagactggagatcctggagtggatgtgcaccagagtgtggcccagcctgcaggacagattcagcagcctgaagggcgtgcccaccgaggtgaagatccaggagatgaccaagctgggccacgagctgatgctgtgcgcccccgacgaccaggagctgctgaagggctgcgcctgcgcccagaagcagctgcacttcatggaccagctgctggacaccatcagaagcctgaccatcggctgcagcagctgcagcagcctgatggagcacttcgaggacaccagagagaagaacgaggccctgctgggcgagctgttcagcagcccccacctgcagatgctgctgaaccccgagtgcgacccctggcccctggacatgcagcccctgctgaacaagcagagcgacgactggcagtgggccagcgccagcgccaagagcgaggaggaggagaagctggccgagctggccagacagctgcaggagagcgccgccaagctgcacgccctgagaaccgagtacttcgcccagcacgagcagggcgccgccgccggcgccgccgacatcagcaccctggaccagaagctgagactggtgaccagcgacttccaccagctgatcctggccttcctgcaggtgtacgacgacgagctgggcgagtgctgccagagacccggccccgacctgcacccctgcggccccatcatccaggccacccaccagaacctgaccagctacagccagctgctgcaggtggtgatggccgtggccgacaccagcgccaaggccgtggagaccgtgaagaagcagcagggcgagcagatctgctggggcggcagcagcagcgtgatgagcctggccaccaagatgaacgagctgatggagaagtag

SEQ ID NO: 84088 - DNA, 1284 bp, Artificial Sequence
  Description of Artificial Sequence: Synthetic coding sequence
atgggcggcgccagactgggcgccagaaacatggccggccaggacgccggctgcggcagaggcggcgacgactacagcgaggacgagggcgacagcagcgtgagcagagccgccgtggaggtgttcggcaagctgaaggacctgaactgccccttcctggagggcctgtacatcaccgagcccaagaccatccaggagctgctgtgcagccccagcgagtacagactggagatcctggagtggatgtgcaccagagtgtggcccagcctgcaggacagattcagcagcctgaagggcgtgcccaccgaggtgaagatccaggagatgaccaagctgggccacgagctgatgctgtgcgcccccgacgaccaggagctgctgaagggctgcgcctgcgcccagaagcagctgcacttcatggaccagctgctggacaccatcagaagcctgaccatcggctgcagcagctgcagcagcctgatggagcacttcgaggacaccagagagaagaacgaggccctgctgggcgagctgttcagcagcccccacctgcagatgctgctgaaccccgagtgcgacccctggcccctggacatgcagcccctgctgaacaagcagagcgacgactggcagtgggccagcgccagcgccaagagcgaggaggaggagaagctggccgagctggccagacagctgcaggagagcgccgccaagctgcacgccctgagaaccgagtacttcgcccagcacgagcagggcgccgccgccggcgccgccgacatcagcaccctggaccagaagctgagactggtgaccagcgacttccaccagctgatcctggccttcctgcaggtgtacgacgacgagctgggcgagtgctgccagagacccggccccgacctgcacccctgcggccccatcatccaggccacccaccagaacctgaccagctacagccagatccccagaggccagcccaagaagcccgccctggtgaccatgaccaccgtgcccacctgcgccaccctgcccctggcccagggcttcagagacgtgcacttcggcttcctgagcgagagactgagagccttccagcccctgaccggctggagctgcgagacccccagaagcggcatgctgctgcaggtggtgatggccgtggccgacaccagcgccaaggccgtggagaccgtgaagaagcagcagggcgagcagatctgctggggcggcagcagcagcgtgatgagcctggccaccaagatgaacgagctgatggagaagtag

SEQ ID NO: 84089 - DNA, 1107 bp, Artificial Sequence
  Description of Artificial Sequence: Synthetic coding sequence
atgggcggcgccagactgggcgccagaaacatggccggccaggacgccggctgcggcagaggcggcgacgactacagcgaggacgagggcgacagcagcgtgagcagagccgccgtggaggtgttcggcaagctgaaggacctgaactgccccttcctggagggcctgtacatcaccgagcccaagaccatccaggagctgctgtgcagccccagcgagtacagactggagatcctggagtggatgtgcaccagagtgtggcccagcctgcaggacagattcagcagcctgaagggcgtgcccaccgaggtgaagatccaggagatgaccaagctgggccacgagctgatgctgtgcgcccccgacgaccaggagctgctgaagggctgcgcctgcgcccagaagcagctgcacttcatggaccagctgctggacaccatcagaagcctgaccatcggctgcagcagctgcagcagcctgatggagcacttcgaggacaccagagagaagaacgaggccctgctgggcgagctgttcagcagcccccacctgcagatgctgctgaaccccgagtgcgacccctggcccctggacatgcagcccctgctgaacaagcagagcgacgactggcagtgggccagcgccagcgccaagagcgaggaggaggagaagctggccgagctggccagacagctgcaggagagcgccgccaagctgcacgccctgagaaccgagtacttcgcccagcacgagcagggcgccgccgccggcgccgccgacatcagcaccctggaccagaagctgagactggtgaccagcgacttccaccagctgatcctggccttcctgcaggtgtacgacgacgagctgggcgagtgctgccagagacccggccccgacctgcacccctgcggccccatcatccaggccacccaccagaacctgaccagctacagccagctgctgcaggtggtgatggccgtggccgacaccagcgccaaggccgtggagaccgtgaagaagcagcagggcgagcagatctgctggggcggcagcagcagcgtgatgagcctggccaccaagatgaacgagctgatggagaagtag

SEQ ID NO: 84090 - DNA, 411 bp, Artificial Sequence
  Description of Artificial Sequence: Synthetic coding sequence
atggaccagctgctggacaccatcagaagcctgaccatcggctgcagcagctgcagcagcctgatggagcacttcgaggacaccagagagaagaacgaggccctgctgggcgagctgttcagcagcccccacctgcagatgctgctgaaccccgagtgcgacccctggcccctggacatgcagcccctgctgaacaagcagagcgacgactggcagtgggccagcgccagcgccaagagcgaggaggaggagaagctggccgagctggccagacagctgcaggagagcgccgccaagctgcacgccctgagaaccgagagcaccaccaccagctgggccagcgccgccagcgcccaggccctgaccagcaccagagccgcccccagcagcagacccagaaccagaatctag

SEQ ID NO: 84091 - DNA, 516 bp, Artificial Sequence
  Description of Artificial Sequence: Synthetic coding sequence
atggtgaagagaagaagaagccccgccctgggcgaggagagattcagccccagcagcatcctgcaccccagactgcccctggtgctgctgggcaccagagtgcccctgagcggcggcggccccggcgagcccgaccagggcagaagcgcccccagctggaagagcctggccagcacccaccaccacagcagacccgccgccggcgccacccccgccagacccgccacccagagccagctgggccccttcgccccccccctgcccggcgtgagacccgcccccttccccgccgtggaggtgttcggcaagctgaaggacctgaactgccccttcctggagggcctgtacatcaccgagcccaagaccatccaggagctgctgtgcagccccagcgagtacagactggagatcctggagtggatgtgcaccagagtgtggcccagcctgcaggacagattcagcagcctgaagggcgtgcccaccgaggtgaagatccagggcctgctggccggctag

SEQ ID NO: 84092 - DNA, 1233 bp, Artificial Sequence
  Description of Artificial Sequence: Synthetic coding sequence
atggccgacagcagcggcagaggcgccggcaagcccgccaccggccccaccaacagcagcagcgccaagaagaaggacaagagagtgcagggcggcagagtgatcgagagcagatacctgcagtacgagaagaagaccacccagaaggcccccgccggcgacggcagccagaccagaggcaagatgagcgagggcggcagaaagagcagcctgctgcagaagagcaaggccgacagcagcggcgtgggcaagggcgacctgcagagcaccctgctggagggccacggcaccgccccccccgacctggacctgagcgccatcaacgacaagagcatcgtgaagaagaccccccagctggccaagaccatcagcaagaagcccgagagcaccagcttcagcgcccccagaaagaagagccccgacctgagcgaggccatggagatgatggagagccagaccctgctgctgaccctgctgagcgtgaagatggagaacaacctggccgagttcgagagaagagccgagaagaacctgctgatcatgtgcaaggagaaggagaagctgcagaagaaggcccacgagctgaagagaagactgctgctgagccagagaaagagagagctggccgacgtgctggacgcccagatcgagatgctgagccccttcgaggccgtggccaccagattcaaggagcagtacagaaccttcgccaccgccctggacaccaccagacacgagctgcccgtgagaagcatccacctggagggcgacggccagcagctgctggacgccctgcagcacgagctggtgaccacccagagactgctgggcgagctggacgtgggcgacagcgaggagaacgtgcaggtgctggacctgctgagcgagctgaaggacgtgaccgccaagaaggacctggagctgagaagaagcttcgcccaggtgctggagctgagcgccgaggccagcaaggaggccgccctggccaaccaggaggtgtgggaggagacccagggcatggccccccccagcagatggtacttcaaccaggacagcgcctgcagagagagcggcggcgcccccaagaacacccccctgagcgaggacgacaaccccggcgccagcagcgcccccgcccaggccaccttcatcagccccagcgaggacttcagcagcagcagccaggccgaggtgccccccagcctgagcagaagcggcagagacctgagctag

SEQ ID NO: 84093 - DNA, 1230 bp, Artificial Sequence
  Description of Artificial Sequence: Synthetic coding sequence
atggccgacagcagcggcagaggcgccggcaagcccgccaccggccccaccaacagcagcagcgccaagaagaaggacaagagagtgcagggcggcagagtgatcgagagcagatacctgcagtacgagaagaagaccacccagaaggcccccgccggcgacggcagccagaccagaggcaagatgagcgagggcggcagaaagagcagcctgctgcagaagagcaaggacagcagcggcgtgggcaagggcgacctgcagagcaccctgctggagggccacggcaccgccccccccgacctggacctgagcgccatcaacgacaagagcatcgtgaagaagaccccccagctggccaagaccatcagcaagaagcccgagagcaccagcttcagcgcccccagaaagaagagccccgacctgagcgaggccatggagatgatggagagccagaccctgctgctgaccctgctgagcgtgaagatggagaacaacctggccgagttcgagagaagagccgagaagaacctgctgatcatgtgcaaggagaaggagaagctgcagaagaaggcccacgagctgaagagaagactgctgctgagccagagaaagagagagctggccgacgtgctggacgcccagatcgagatgctgagccccttcgaggccgtggccaccagattcaaggagcagtacagaaccttcgccaccgccctggacaccaccagacacgagctgcccgtgagaagcatccacctggagggcgacggccagcagctgctggacgccctgcagcacgagctggtgaccacccagagactgctgggcgagctggacgtgggcgacagcgaggagaacgtgcaggtgctggacctgctgagcgagctgaaggacgtgaccgccaagaaggacctggagctgagaagaagcttcgcccaggtgctggagctgagcgccgaggccagcaaggaggccgccctggccaaccaggaggtgtgggaggagacccagggcatggccccccccagcagatggtacttcaaccaggacagcgcctgcagagagagcggcggcgcccccaagaacacccccctgagcgaggacgacaaccccggcgccagcagcgcccccgcccaggccaccttcatcagccccagcgaggacttcagcagcagcagccaggccgaggtgccccccagcctgagcagaagcggcagagacctgagctag

SEQ ID NO: 84094 - DNA, 1899 bp, Artificial Sequence
  Description of Artificial Sequence: Synthetic coding sequence
atggccagacacagaaacgtgagaggctacaactacgacgaggacttcgaggacgacgacctgtacggccagagcgtggaggacgactactgcatcagccccagcaccgccgcccagttcatctacagcagaagagacaagcccagcgtggagcccgtggaggagtacgactacgaggacctgaaggagagcagcaacagcgtgagcaaccaccagctgagcggcttcgaccaggccagactgtacagctgcctggaccacatgagagaggtgctgggcgacgccgtgcccgacgagatcctgatcgaggccgtgctgaagaacaagttcgacgtgcagaaggccctgagcggcgtgctggagcaggacagagtgcagagcctgaaggacaagaacgaggccaccgtgagcaccggcaagatcgccaagggcgtgctgttcagcagcagcgaggtgagcgccgacaacgtgcagagcagctacccccagagcgccaaccacctggactacagcagcaagcccttcgacttcgccagcagcgtgggcaagtacggcctgagccacaacagcagcgtgcccacccactgcctgctgcacagaaagaagaagctggacaccagaaagagcgagaagaagctggagagctgcaagctgaccaaggagctgagcctggccaacctgatccacgacatgagcagagacagctgcgagagccagcccagcgtgagactgagcagcaccgacagcctggagagcctgctgagcaagaacctggacgccgacctgctgagaccccacgccagcgagtgcatcagcaaggacgacagcgccttcaaggagatccccgacctgaagaccatcatcatcaagggcaccacccccaacaacagcctgtacatccagaacaacagcctgagcgacttccagaacatccccgtgcaggacagcctgggcagcagcaacaaccccctgtacctgaccagcagcctggagaacatgaccgtggacaacctgaacgccagcaaggagaccgaggtgggcaacgtgagcctggtggagcagagcgccaagaaccacaccttcaagaacgacaacctgcagttcagccagtgcgagagccccagcctgaccgagctgttccaggagcacaaggagaacaacatcagccagtgcttcaccctgagcgacctgtgcaaccagagcagcgccagcttcaccgacctgagcctgggcagcttccccctgagccagctggccaacagatgccagagcagccccggcatcagcgagctgaccggcagcctgagcagcctggccttccacaaggccagccccaccagagacctggagaacctgagcctgagcgagctgatcgccgagaccatcgacgtggacaacagccagatcaagaaggagagcttcgaggtgagcctgagcgaggtgagaagccccggcatcgacagcaacatcgacctgagcgtgctgatcaagaaccccgacttcgtgcccaagcccgtggtggaccccagcatcgcccccagcagcagaaccaaggtgctgagcagcaagctgggcaagaacagcaacttcgccaaggacaacaagaagaacaacaagggcagcctgaccagaaagccccccttcagcctgagctggaccaaggccctggccgccagacccagcgccttcgccagcaccctgtgcctgagataccccctgaagagctgcaagagaagaaccctggacctgtacaagaccttcctgtacagcagacaggtgcaggacgtgaaggacaaggagatcagccccctggtggccatcacccccttcgacttcaagagcgccagccccgacgacatcgtgaaggccaaccagaagaaggccttcaccagagagtag

SEQ ID NO: 84095 - DNA, 1563 bp, Artificial Sequence
  Description of Artificial Sequence: Synthetic coding sequence
atgaccgtgagcggcaagaagcagaccatgggcttcgaggtgcccggcgtgagcagcgaggagaacggccacagcttccacaccccccagaagggcccccccatcgaggacgccatcgccagcagcgacgtgctggagaccgccagcaagagcgccaaccccccccacaccatccaggccagcgaggagcagagcagcacccccgcccccgtgaagaagagcggcaagctgagacagcagatcgacgtgaaggccgagctggagaagagacagggcggcaagcagctgctgaacctggtggtgatcggccacgtggacgccggcaagagcaccctgatgggccacatgctgtacctgctgggcaacatcaacaagagaaccatgcacaagtacgagcaggagagcaagaaggccggcaaggccagcttcgcctacgcctgggtgctggacgagaccggcgaggagagagagagaggcgtgaccatggacgtgggcatgaccaagttcgagaccaccaccaaggtgatcaccctgatggacgcccccggccacaaggacttcatccccaacatgatcaccggcgccgcccaggccgacgtggccgtgctggtggtggacgccagcagaggcgagttcgaggccggcttcgagaccggcggccagaccagagagcacggcctgctggtgagaagcctgggcgtgacccagctggccgtggccgtgaacaagatggaccaggtgaactggcagcaggagagattccaggagatcaccggcaagctgggccacttcctgaagcaggccggcttcaaggagagcgacgtgggcttcatccccaccagcggcctgagcggcgagaacctgatcaccagaagccagagcagcgagctgaccaagtggtacaagggcctgtgcctgctggagcagatcgacagcttcaagcccccccagagaagcatcgacaagcccttcagactgtgcgtgagcgacgtgttcaaggaccagggcagcggcttctgcatcaccggcaagatcgaggccggctacatccagaccggcgacagactgctggccatgccccccaacgagacctgcaccgtgaagggcatcaccctgcacgacgagcccgtggactgggccgccgccggcgaccacgtgagcctgaccctggtgggcatggacatcatcaagatcaacgtgggctgcatcttctgcggccccaaggtgcccatcaaggcctgcaccagattcagagccagaatcctgatcttcaacatcgagatccccatcaccaagggcttccccgtgctgctgcactaccagaccgtgagcgagcccgccgtgatcaagagactgatcagcgtgctgaacaagagcaccggcgaggtgaccaagaagaagcccaagttcctgaccaagggccagaacgccctggtggagctgcagacccagagacccatcgccctggagctgtacaaggacttcaaggagctgggcagattcatgctgagatacggcggcagcaccatcgccgccggcgtggtgaccgagatcaaggagtag

SEQ ID NO: 84096 - DNA, 1929 bp, Artificial Sequence
  Description of Artificial Sequence: Synthetic coding sequence
atggccagacacagaaacgtgagaggctacaactacgacgaggacttcgaggacgacgacctgtacggccagagcgtggaggacgactactgcatcagccccagcaccgccagactgtacagctgcctggaccacatgagagaggtgctgggcgacgccgtgcccgacgagatcctgatcgaggccgtgctgaagaacaagttcgacgtgcagaaggccctgagcggcgtgctggagcaggacagagtgcagagcctgaaggacaagaacgaggccaccgtgagcaccggcaagatcgccaagggcaagcccgtggacagccagaccagcagaagcgagagcgagatcgtgcccaaggtggccaagatgaccgtgagcggcaagaagcagaccatgggcttcgaggtgcccggcgtgagcagcgaggagaacggccacagcttccacaccccccagaagggcccccccatcgaggacgccatcgccagcagcgacgtgctggagaccgccagcaagagcgccaaccccccccacaccatccaggccagcgaggagcagagcagcacccccgcccccgtgaagaagagcggcaagctgagacagcagatcgacgtgaaggccgagctggagaagagacagggcggcaagcagctgctgaacctggtggtgatcggccacgtggacgccggcaagagcaccctgatgggccacatgctgtacctgctgggcaacatcaacaagagaaccatgcacaagtacgagcaggagagcaagaaggccggcaaggccagcttcgcctacgcctgggtgctggacgagaccggcgaggagagagagagaggcgtgaccatggacgtgggcatgaccaagttcgagaccaccaccaaggtgatcaccctgatggacgcccccggccacaaggacttcatccccaacatgatcaccggcgccgcccaggccgacgtggccgtgctggtggtggacgccagcagaggcgagttcgaggccggcttcgagaccggcggccagaccagagagcacggcctgctggtgagaagcctgggcgtgacccagctggccgtggccgtgaacaagatggaccaggtgaactggcagcaggagagattccaggagatcaccggcaagctgggccacttcctgaagcaggccggcttcaaggagagcgacgtgggcttcatccccaccagcggcctgagcggcgagaacctgatcaccagaagccagagcagcgagctgaccaagtggtacaagggcctgtgcctgctggagcagatcgacagcttcaagcccccccagagaagcatcgacaagcccttcagactgtgcgtgagcgacgtgttcaaggaccagggcagcggcttctgcatcaccggcaagatcgaggccggctacatccagaccggcgacagactgctggccatgccccccaacgagacctgcaccgtgaagggcatcaccctgcacgacgagcccgtggactgggccgccgccggcgaccacgtgagcctgaccctggtgggcatggacatcatcaagatcaacgtgggctgcatcttctgcggccccaaggtgcccatcaaggcctgcaccagattcagagccagaatcctgatcttcaacatcgagatccccatcaccaagggcttccccgtgctgctgcactaccagaccgtgagcgagcccgccgtgatcaagagactgatcagcgtgctgaacaagagcaccggcgaggtgaccaagaagaagcccaagttcctgaccaagggccagaacgccctggtggagctgcagacccagagacccatcgccctggagctgtacaaggacttcaaggagctgggcagattcatgctgagatacggcggcagcaccatcgccgccggcgtggtgaccgagatcaaggagtag

SEQ ID NO: 84097 - DNA, 2055 bp, Artificial Sequence
  Description of Artificial Sequence: Synthetic coding sequence
atggccagacacagaaacgtgagaggctacaactacgacgaggacttcgaggacgacgacctgtacggccagagcgtggaggacgactactgcatcagccccagcaccgccgcccagttcatctacagcagaagagacaagcccagcgtggagcccgtggaggagtacgactacgaggacctgaaggagagcagcaacagcgtgagcaaccaccagctgagcggcttcgaccaggccagactgtacagctgcctggaccacatgagagaggtgctgggcgacgccgtgcccgacgagatcctgatcgaggccgtgctgaagaacaagttcgacgtgcagaaggccctgagcggcgtgctggagcaggacagagtgcagagcctgaaggacaagaacgaggccaccgtgagcaccggcaagatcgccaagggcaagcccgtggacagccagaccagcagaagcgagagcgagatcgtgcccaaggtggccaagatgaccgtgagcggcaagaagcagaccatgggcttcgaggtgcccggcgtgagcagcgaggagaacggccacagcttccacaccccccagaagggcccccccatcgaggacgccatcgccagcagcgacgtgctggagaccgccagcaagagcgccaaccccccccacaccatccaggccagcgaggagcagagcagcacccccgcccccgtgaagaagagcggcaagctgagacagcagatcgacgtgaaggccgagctggagaagagacagggcggcaagcagctgctgaacctggtggtgatcggccacgtggacgccggcaagagcaccctgatgggccacatgctgtacctgctgggcaacatcaacaagagaaccatgcacaagtacgagcaggagagcaagaaggccggcaaggccagcttcgcctacgcctgggtgctggacgagaccggcgaggagagagagagaggcgtgaccatggacgtgggcatgaccaagttcgagaccaccaccaaggtgatcaccctgatggacgcccccggccacaaggacttcatccccaacatgatcaccggcgccgcccaggccgacgtggccgtgctggtggtggacgccagcagaggcgagttcgaggccggcttcgagaccggcggccagaccagagagcacggcctgctggtgagaagcctgggcgtgacccagctggccgtggccgtgaacaagatggaccaggtgaactggcagcaggagagattccaggagatcaccggcaagctgggccacttcctgaagcaggccggcttcaaggagagcgacgtgggcttcatccccaccagcggcctgagcggcgagaacctgatcaccagaagccagagcagcgagctgaccaagtggtacaagggcctgtgcctgctggagcagatcgacagcttcaagcccccccagagaagcatcgacaagcccttcagactgtgcgtgagcgacgtgttcaaggaccagggcagcggcttctgcatcaccggcaagatcgaggccggctacatccagaccggcgacagactgctggccatgccccccaacgagacctgcaccgtgaagggcatcaccctgcacgacgagcccgtggactgggccgccgccggcgaccacgtgagcctgaccctggtgggcatggacatcatcaagatcaacgtgggctgcatcttctgcggccccaaggtgcccatcaaggcctgcaccagattcagagccagaatcctgatcttcaacatcgagatccccatcaccaagggcttccccgtgctgctgcactaccagaccgtgagcgagcccgccgtgatcaagagactgatcagcgtgctgaacaagagcaccggcgaggtgaccaagaagaagcccaagttcctgaccaagggccagaacgccctggtggagctgcagacccagagacccatcgccctggagctgtacaaggacttcaaggagctgggcagattcatgctgagatacggcggcagcaccatcgccgccggcgtggtgaccgagatcaaggagtag

SEQ ID NO: 84098 - DNA, 1227 bp, Artificial Sequence
  Description of Artificial Sequence: Synthetic coding sequence
atgggccacatgctgtacctgctgggcaacatcaacaagagaaccatgcacaagtacgagcaggagagcaagaaggccggcaaggccagcttcgcctacgcctgggtgctggacgagaccggcgaggagagagagagaggcgtgaccatggacgtgggcatgaccaagttcgagaccaccaccaaggtgatcaccctgatggacgcccccggccacaaggacttcatccccaacatgatcaccggcgccgcccaggccgacgtggccgtgctggtggtggacgccagcagaggcgagttcgaggccggcttcgagaccggcggccagaccagagagcacggcctgctggtgagaagcctgggcgtgacccagctggccgtggccgtgaacaagatggaccaggtgaactggcagcaggagagattccaggagatcaccggcaagctgggccacttcctgaagcaggccggcttcaaggagagcgacgtgggcttcatccccaccagcggcctgagcggcgagaacctgatcaccagaagccagagcagcgagctgaccaagtggtacaagggcctgtgcctgctggagcagatcgacagcttcaagcccccccagagaagcatcgacaagcccttcagactgtgcgtgagcgacgtgttcaaggaccagggcagcggcttctgcatcaccggcaagatcgaggccggctacatccagaccggcgacagactgctggccatgccccccaacgagacctgcaccgtgaagggcatcaccctgcacgacgagcccgtggactgggccgccgccggcgaccacgtgagcctgaccctggtgggcatggacatcatcaagatcaacgtgggctgcatcttctgcggccccaaggtgcccatcaaggcctgcaccagattcagagccagaatcctgatcttcaacatcgagatccccatcaccaagggcttccccgtgctgctgcactaccagaccgtgagcgagcccgccgtgatcaagagactgatcagcgtgctgaacaagagcaccggcgaggtgaccaagaagaagcccaagttcctgaccaagggccagaacgccctggtggagctgcagacccagagacccatcgccctggagctgtacaaggacttcaaggagctgggcagattcatgctgagatacggcggcagcaccatcgccgccggcgtggtgaccgagatcaaggagtag

SEQ ID NO: 84099 - DNA, 840 bp, Artificial Sequence
  Description of Artificial Sequence: Synthetic coding sequence
atgagcctgttcgacctgttcagaggcttcttcggcttccccggccccagaagccacagagaccccttcttcggcggcatgaccagagacgaggacgacgacgaggaggaggaggaggagggcggcagctggggcagaggcaaccccagattccacagcccccagcacccccccgaggagttcggcttcggcttcagcttcagccccggcggcggcatcagattccacgacaacttcggcttcgacgacctggtgagagacttcaacagcatcttcagcgacatgggcgcctggaccctgcccagccacccccccgagctgcccggccccgagagcgagacccccggcgagagactgagagagggccagaccctgagagacagcatgctgaagtaccccgacagccaccagcccagaatcttcggcggcgtgctggagagcgacgccagaagcgagagcccccagcccgcccccgactggggcagccagagacccttccacagattcgacgacgtgtggcccatggacccccaccccagaaccagagaggacaacgacctggacagccaggtgagccaggagggcctgggccccgtgctgcagccccagcccaagagctacttcaagagcatcagcgtgaccaagatcaccaagcccgacggcatcgtggaggagagaagaaccgtggtggacagcgagggcagaaccgagaccaccgtgaccagacacgaggccgacagcagccccagaggcgaccccgagagccccagaccccccgccctggacgacgccttcagcatcctggacctgttcctgggcagatggttcagaagcagatag

SEQ ID NO: 84100 - DNA, 696 bp, Artificial Sequence
  Description of Artificial Sequence: Synthetic coding sequence
atgagcctgttcgacctgttcagaggcttcttcggcttccccggccccagaagcttcagccccggcggcggcatcagattccacgacaacttcggcttcgacgacctggtgagagacttcaacagcatcttcagcgacatgggcgcctggaccctgcccagccacccccccgagctgcccggccccgagagcgagacccccggcgagagactgagagagggccagaccctgagagacagcatgctgaagtaccccgacagccaccagcccagaatcttcggcggcgtgctggagagcgacgccagaagcgagagcccccagcccgcccccgactggggcagccagagacccttccacagattcgacgacgtgtggcccatggacccccaccccagaaccagagaggacaacgacctggacagccaggtgagccaggagggcctgggccccgtgctgcagccccagcccaagagctacttcaagagcatcagcgtgaccaagatcaccaagcccgacggcatcgtggaggagagaagaaccgtggtggacagcgagggcagaaccgagaccaccgtgaccagacacgaggccgacagcagccccagaggcgaccccgagagccccagaccccccgccctggacgacgccttcagcatcctggacctgttcctgggcagatggttcagaagcagatag

SEQ ID NO: 84101 - DNA, 864 bp, Artificial Sequence
  Description of Artificial Sequence: Synthetic coding sequence
atgagcctgttcgacctgttcagaggcttcttcggcttccccggccccagaagccacagagaccccttcttcggcggcatgaccagagacgaggacgacgacgaggaggaggaggaggagggcggcagctggggcagaggcaaccccagattccacagcccccagcacccccccgaggagttcggcttcggcttcagcttcagccccggcggcggcatcagattccacgacaacttcggcttcgacgacctggtgagagacttcaacagcatcttcagcgacatgggcgcctggaccctgcccagccacccccccgccaacacctgccacctgagcgccgagctgcccggccccgagagcgagacccccggcgagagactgagagagggccagaccctgagagacagcatgctgaagtaccccgacagccaccagcccagaatcttcggcggcgtgctggagagcgacgccagaagcgagagcccccagcccgcccccgactggggcagccagagacccttccacagattcgacgacgtgtggcccatggacccccaccccagaaccagagaggacaacgacctggacagccaggtgagccaggagggcctgggccccgtgctgcagccccagcccaagagctacttcaagagcatcagcgtgaccaagatcaccaagcccgacggcatcgtggaggagagaagaaccgtggtggacagcgagggcagaaccgagaccaccgtgaccagacacgaggccgacagcagccccagaggcgaccccgagagccccagaccccccgccctggacgacgccttcagcatcctggacctgttcctgggcagatggttcagaagcagatag

SEQ ID NO: 84102 - DNA, 1179 bp, Artificial Sequence
  Description of Artificial Sequence: Synthetic coding sequence
atgcagagccccgccgtgctggtgaccagcagaagactgcagaacgcccacaccggcctggacctgaccgtgccccagcaccaggaggtgagaggcaagatgatgagcggccacgtggagtaccagatcctggtggtgaccagactggccgccttcaagagcgccaagcacagacccgaggacgtggtgcagttcctggtgagcaagaagtacagcgagatcgaggagttctaccagaagctgagcagcagatacgccgccgccagcctgccccccctgcccagaaaggtgctgttcgtgggcgagagcgacatcagagagagaagagccgtgttcaacgagatcctgagatgcgtgagcaaggacgccgagctggccggcagccccgagctgctggagttcctgggcaccagaagccccggcgccgccggcctgaccagcagagacagcagcgtgctggacggcaccgacagccagaccggcaacgacgaggaggccttcgacttcttcgaggagcaggaccaggtggccgaggagggcccccccgtgcagagcctgaagggcgaggacgccgaggagagcctggaggaggaggaggccctggaccccctgggcatcatgagaagcaagaagcccaagaagcaccccaaggtggccgtgaaggccaagcccagccccagactgaccatcttcgacgaggaggtggaccccgacgagggcctgttcggccccggcagaaagctgagcccccaggaccccagcgaggacgtgagcagcgtggaccccctgaagctgttcgacgaccccgacctgggcggcgccatccccctgggcgacagcctgctgctgcccgccgcctgcgagagcggcggccccacccccagcctgagccacagagacgccagcaaggagctgttcagagtggaggaggacctggaccagatcctgaacctgggcgccgagcccaagcccaagccccagctgaagcccaagccccccgtggccgccaagcccgtgatccccagaaagcccgccgtgccccccaaggccggccccgccgaggccgtggccggccagcagaagccccaggagcagatccaggccatggacgagatggacatcctgcagtacatccaggaccacgacacccccgcccaggccgcccccagcctgttctag

SEQ ID NO: 84103 - DNA, 654 bp, Artificial Sequence
  Description of Artificial Sequence: Synthetic coding sequence
atgagcctggtgggcggcttcccccaccaccccgtggtgcaccacgagggctaccccttcgccgccgccgccgccgccgccgccgccgccgccgccagcagatgcagccacgaggagaacccctacttccacggctggctgatcggccaccccgagatgagcccccccgactacagcatggccctgagctacagccccgagtacgccagcggcgccgccggcctggaccacagccactacggcggcgtgccccccggcgccggcccccccggcctgggcggccccagacccgtgaagagaagaggcaccgccaacagaaaggagagaagaagaacccagagcatcaacagcgccttcgccgagctgagagagtgcatccccaacgtgcccgccgacaccaagctgagcaagatcaagaccctgagactggccaccagctacatcgcctacctgatggacctgctggccaaggacgaccagaacggcgaggccgaggccttcaaggccgagatcaagaagaccgacgtgaaggaggagaagagaaagaaggagctgaacgagatcctgaagagcaccgtgagcagcaacgacaagaagaccaagggcagaaccggctggccccagcacgtgtgggccctggagctgaagcagtag

SEQ ID NO: 84104 - DNA, 561 bp, Artificial Sequence
  Description of Artificial Sequence: Synthetic coding sequence
atgagcctggtgggcggcttcccccaccaccccgtggtgcaccacgagggctaccccttcgccgccgccgccgccgccgccgccgccgccgccgccagcagatgcagccacgaggagaacccctacttccacggctggctgatcggccaccccgagatgagcccccccgactacagcatggccctgagctacagccccgagtacgccagcggcaccgccaacagaaaggagagaagaagaacccagagcatcaacagcgccttcgccgagctgagagagtgcatccccaacgtgcccgccgacaccaagctgagcaagatcaagaccctgagactggccaccagctacatcgcctacctgatggacctgctggccaaggacgaccagaacggcgaggccgaggccttcaaggccgagatcaagaagaccgacgtgaaggaggagaagagaaagaaggagctgaacgagatcctgaagagcaccgtgagcagcaacgacaagaagaccaagggcagaaccggctggccccagcacgtgtgggccctggagctgaagcagtag

SEQ ID NO: 84105 - DNA, 498 bp, Artificial Sequence
  Description of Artificial Sequence: Synthetic coding sequence
atgagcccccccgactacagcatggccctgagctacagccccgagtacgccagcggcgccgccggcctggaccacagccactacggcggcgtgccccccggcgccggcccccccggcctgggcggccccagacccgtgaagagaagaggcaccgccaacagaaaggagagaagaagaacccagagcatcaacagcgccttcgccgagctgagagagtgcatccccaacgtgcccgccgacaccaagctgagcaagatcaagaccctgagactggccaccagctacatcgcctacctgatggacctgctggccaaggacgaccagaacggcgaggccgaggccttcaaggccgagatcaagaagaccgacgtgaaggaggagaagagaaagaaggagctgaacgagatcctgaagagcaccgtgagcagcaacgacaagaagaccaagggcagaaccggctggccccagcacgtgtgggccctggagctgaagcagtag

SEQ ID NO: 84106 - DNA, 2577 bp, Artificial Sequence
  Description of Artificial Sequence: Synthetic coding sequence
atgagcgtggtgggcctggacgtgggcagccagagctgctacatcgccgtggccagagccggcggcatcgagaccatcgccaacgagttcagcgacagatgcacccccagcgtgatcagcttcggcagcaagaacagaaccatcggcgtggccgccaagaaccagcagatcacccacgccaacaacaccgtgagcaacttcaagagattccacggcagagccttcaacgaccccttcatccagaaggagaaggagaacctgagctacgacctggtgcccctgaagaacggcggcgtgggcatcaaggtgatgtacatgggcgaggagcacctgttcagcgtggagcagatcaccgccatgctgctgaccaagctgaaggagaccgccgagaacagcctgaagaagcccgtgaccgactgcgtgatcagcgtgcccagcttcttcaccgacgccgagagaagaagcgtgctggacgccgcccagatcgtgggcctgaactgcctgagactgatgaacgacatgaccgccgtggccctgaactacggcatctacaagcaggacctgcccagcctggacgagaagcccagaatcgtggtgttcgtggacatgggccacagcgccttccaggtgagcgcctgcgccttcaacaagggcaagctgaaggtgctgggcaccgccttcgaccccttcctgggcggcaagaacttcgacgagaagctggtggagcacttctgcgccgagttcaagaccaagtacaagctggacgccaagagcaagatcagagccctgctgagactgtaccaggagtgcgagaagctgaagaagctgatgagcagcaacagcaccgacctgcccctgaacatcgagtgcttcatgaacgacaaggacgtgagcggcaagatgaacagaagccagttcgaggagctgtgcgccgagctgctgcagaagatcgaggtgcccctgtacagcctgctggagcagacccacctgaaggtggaggacgtgagcgccgtggagatcgtgggcggcgccaccagaatccccgccgtgaaggagagaatcgccaagttcttcggcaaggacatcagcaccaccctgaacgccgacgaggccgtggccagaggctgcgccctgcagtgcgccatcctgagccccgccttcaaggtgagagagttcagcgtgaccgacgccgtgcccttccccatcagcctgatctggaaccacgacagcgaggacaccgagggcgtgcacgaggtgttcagcagaaaccacgccgcccccttcagcaaggtgctgaccttcctgagaagaggccccttcgagctggaggccttctacagcgacccccagggcgtgccctaccccgaggccaagatcggcagattcgtggtgcagaacgtgagcgcccagaaggacggcgagaagagcagagtgaaggtgaaggtgagagtgaacacccacggcatcttcaccatcagcaccgccagcatggtggagaaggtgcccaccgaggagaacgagatgagcagcgaggccgacatggagtgcctgaaccagagaccccccgagaaccccgacaccgacaagaacgtgcagcaggacaacagcgaggccggcacccagccccaggtgcagaccgacgcccagcagaccagccagagcccccccagccccgagctgaccagcgaggagaacaagatccccgacgccgacaaggccaacgagaagaaggtggaccagccccccgaggccaagaagcccaagatcaaggtggtgaacgtggagctgcccatcgaggccaacctggtgtggcagctgggcaaggacctgctgaacatgtacatcgagaccgagggcaagatgatcatgcaggacaagctggagaaggagagaaacgacgccaagaacgccgtggaggagtacgtgtacgagttcagagacaagctgtgcggcccctacgagaagttcatctgcgagcaggaccaccagaacttcctgagactgctgaccgagaccgaggactggctgtacgaggagggcgaggaccaggccaagcaggcctacgtggacaagctggaggagctgatgaagatcggcacccccgtgaaggtgagattccaggaggccgaggagagacccaagatgttcgaggagctgggccagagactgcagcactacgccaagatcgccgccgacttcagaaacaaggacgagaagtacaaccacatcgacgagagcgagatgaagaaggtggagaagagcgtgaacgaggtgatggagtggatgaacaacgtgatgaacgcccaggccaagaagagcctggaccaggaccccgtggtgagagcccaggagatcaagaccaagatcaaggagctgaacaacacctgcgagcccgtggtgacccagcccaagcccaagatcgagagccccaagctggagagaacccccaacggccccaacatcgacaagaaggaggaggacctggaggacaagaacaacttcggcgccgagcccccccaccagaacggcgagtgctaccccaacgagaagaacagcgtgaacatggacctggactag

SEQ ID NO: 84107 - DNA, 414 bp, Artificial Sequence
  Description of Artificial Sequence: Synthetic coding sequence
atgttcgaggagctgggccagagactgcagcactacgccaagatcgccgccgacttcagaaacaaggacgagaagtacaaccacatcgacgagagcgagatgaagaaggtggagaagagcgtgaacgaggtgatggagtggatgaacaacgtgatgaacgcccaggccaagaagagcctggaccaggaccccgtggtgagagcccaggagatcaagaccaagatcaaggagctgaacaacacctgcgagcccgtggtgacccagcccaagcccaagatcgagagccccaagctggagagaacccccaacggccccaacatcgacaagaaggaggaggacctggaggacaagaacaacttcggcgccgagcccccccaccagaacgacagctgcggcatcgtgaacagctactag

SEQ ID NO: 84108 - DNA, 2034 bp, Artificial Sequence
  Description of Artificial Sequence: Synthetic coding sequence
atgtacatgggcgaggagcacctgttcagcgtggagcagatcaccgccatgctgctgaccaagctgaaggagaccgccgagaacagcctgaagaagcccgtgaccgactgcgtgatcagcgtgctgggcaccgccttcgaccccttcctgggcggcaagaacttcgacgagaagctggtggagcacttctgcgccgagttcaagaccaagtacaagctggacgccaagagcaagatcagagccctgctgagactgtaccaggagtgcgagaagctgaagaagctgatgagcagcaacagcaccgacctgcccctgaacatcgagtgcttcatgaacgacaaggacgtgagcggcaagatgaacagaagccagttcgaggagctgtgcgccgagctgctgcagaagatcgaggtgcccctgtacagcctgctggagcagacccacctgaaggtggaggacgtgagcgccgtggagatcgtgggcggcgccaccagaatccccgccgtgaaggagagaatcgccaagttcttcggcaaggacatcagcaccaccctgaacgccgacgaggccgtggccagaggctgcgccctgcagtgcgccatcctgagccccgccttcaaggtgagagagttcagcgtgaccgacgccgtgcccttccccatcagcctgatctggaaccacgacagcgaggacaccgagggcgtgcacgaggtgttcagcagaaaccacgccgcccccttcagcaaggtgctgaccttcctgagaagaggccccttcgagctggaggccttctacagcgacccccagggcgtgccctaccccgaggccaagatcggcagattcgtggtgcagaacgtgagcgcccagaaggacggcgagaagagcagagtgaaggtgaaggtgagagtgaacacccacggcatcttcaccatcagcaccgccagcatggtggagaaggtgcccaccgaggagaacgagatgagcagcgaggccgacatggagtgcctgaaccagagaccccccgagaaccccgacaccgacaagaacgtgcagcaggacaacagcgaggccggcacccagccccaggtgcagaccgacgcccagcagaccagccagagcccccccagccccgagctgaccagcgaggagaacaagatccccgacgccgacaaggccaacgagaagaaggtggaccagccccccgaggccaagaagcccaagatcaaggtggtgaacgtggagctgcccatcgaggccaacctggtgtggcagctgggcaaggacctgctgaacatgtacatcgagaccgagggcaagatgatcatgcaggacaagctggagaaggagagaaacgacgccaagaacgccgtggaggagtacgtgtacgagttcagagacaagctgtgcggcccctacgagaagttcatctgcgagcaggaccaccagaacttcctgagactgctgaccgagaccgaggactggctgtacgaggagggcgaggaccaggccaagcaggcctacgtggacaagctggaggagctgatgaagatcggcacccccgtgaaggtgagattccaggaggccgaggagagacccaagatgttcgaggagctgggccagagactgcagcactacgccaagatcgccgccgacttcagaaacaaggacgagaagtacaaccacatcgacgagagcgagatgaagaaggtggagaagagcgtgaacgaggtgatggagtggatgaacaacgtgatgaacgcccaggccaagaagagcctggaccaggaccccgtggtgagagcccaggagatcaagaccaagatcaaggagctgaacaacacctgcgagcccgtggtgacccagcccaagcccaagatcgagagccccaagctggagagaacccccaacggccccaacatcgacaagaaggaggaggacctggaggacaagaacaacttcggcgccgagcccccccaccagaacggcgagtgctaccccaacgagaagaacagcgtgaacatggacctggactag

SEQ ID NO: 84109 - DNA, 1920 bp, Artificial Sequence
  Description of Artificial Sequence: Synthetic coding sequence
atggccagagagagaccctgcagatgccacggcaacggcggcagaagccccggcaccggctgccccctgggcagaatcttccccgagggcagcagaagaagaaagagaaagtggcacgtggagggccccgtggaggcccccagaaacggccagacccccagagccggcgccgagagaggccagggcagaaagagaagacaggagaagcaggccggcggcatcgagaccatcgccaacgagttcagcgacagatgcacccccagcgtgatcagcttcggcagcaagaacagaaccatcggcgtggccgccaagaaccagcagatcacccacgccaacaacaccgtgagcaacttcaagagattccacggcagagccttcaacgaccccttcatccagaaggagaaggagaacctgagctacgacctggtgcccctgaagaacggcggcgtgggcatcaaggtgatgtacatgggcgaggagcacctgttcagcgtggagcagatcaccgccatgctgctgaccaagctgaaggagaccgccgagaacagcctgaagaagcccgtgaccgactgcgtgatcagcgtgcccagcttcttcaccgacgccgagagaagaagcgtgctggacgccgcccagatcgtgggcctgaactgcctgagactgatgaacgacatgaccgccgtggccctgaactacggcatctacaagcaggacctgcccagcctggacgagaagcccagaatcgtggtgttcgtggacatgggccacagcgccttccaggtgagcgcctgcgccttcaacaagggcaagctgaaggtgctgggcaccgccttcgaccccttcctgggcggcaagaacttcgacgagaagctggtggagcacttctgcgccgagttcaagaccaagtacaagctggacgccaagagcaagatcagagccctgctgagactgtaccaggagtgcgagaagctgaagaagctgatgagcagcaacagcaccgacctgcccctgaacatcgagtgcttcatgaacgacaaggacgtgagcggcaagatgaacagaagccagttcgaggagctgtgcgccgagctgctgcagaagatcgaggtgcccctgtacagcctgctggagcagacccacctgaaggtggaggacgtgagcgccgtggagatcgtgggcggcgccaccagaatccccgccgtgaaggagagaatcgccaagttcttcggcaaggacatcagcaccaccctgaacgccgacgaggccgtggccagaggctgcgccctgcagtgcgccatcctgagccccgccttcaaggtgagagagttcagcgtgaccgacgccgtgcccttccccatcagcctgatctggaaccacgacagcgaggacaccgagggcgtgcacgaggtgttcagcagaaaccacgccgcccccttcagcaaggtgctgaccttcctgagaagaggccccttcgagctggaggccttctacagcgacccccagggcgtgccctaccccgaggccaagatcggcagattcgtggtgcagaacgtgagcgcccagaaggacggcgagaagagcagagtgaaggtgaaggtgagagtgaacacccacggcatcttcaccatcagcaccgccagcatggtggagaaggtgcccaccgaggagaacgagatgagcagcgaggccgacatggagtgcctgaaccagagaccccccgagaaccccgacaccgacaagaacgtgcagcaggacaacagcgaggccggcacccagccccaggtgcagaccgacgcccagcagaccagccagagcccccccagccccgagctgaccagcgaggagaacaagatccccgacgccgacaagcagatgaagaagaagctgaccagcctgcagaagctgaagagccccaagtag

SEQ ID NO: 84110 - DNA, 2583 bp, Artificial Sequence
  Description of Artificial Sequence: Synthetic coding sequence
atggccaccgccgccgtgctgagaggccccgccgcccactgggtggagagcttccagaaggccagagaggagggcagcggcagcggcacctggagaggcagatggagaagaagaagcgtgatcagcttcggcagcaagaacagaaccatcggcgtggccgccaagaaccagcagatcacccacgccaacaacaccgtgagcaacttcaagagattccacggcagagccttcaacgaccccttcatccagaaggagaaggagaacctgagctacgacctggtgcccctgaagaacggcggcgtgggcatcaaggtgatgtacatgggcgaggagcacctgttcagcgtggagcagatcaccgccatgctgctgaccaagctgaaggagaccgccgagaacagcctgaagaagcccgtgaccgactgcgtgatcagcgtgcccagcttcttcaccgacgccgagagaagaagcgtgctggacgccgcccagatcgtgggcctgaactgcctgagactgatgaacgacatgaccgccgtggccctgaactacggcatctacaagcaggacctgcccagcctggacgagaagcccagaatcgtggtgttcgtggacatgggccacagcgccttccaggtgagcgcctgcgccttcaacaagggcaagctgaaggtgctgggcaccgccttcgaccccttcctgggcggcaagaacttcgacgagaagctggtggagcacttctgcgccgagttcaagaccaagtacaagctggacgccaagagcaagatcagagccctgctgagactgtaccaggagtgcgagaagctgaagaagctgatgagcagcaacagcaccgacctgcccctgaacatcgagtgcttcatgaacgacaaggacgtgagcggcaagatgaacagaagccagttcgaggagctgtgcgccgagctgctgcagaagatcgaggtgcccctgtacagcctgctggagcagacccacctgaaggtggaggacgtgagcgccgtggagatcgtgggcggcgccaccagaatccccgccgtgaaggagagaatcgccaagttcttcggcaaggacatcagcaccaccctgaacgccgacgaggccgtggccagaggctgcgccctgcagtgcgccatcctgagccccgccttcaaggtgagagagttcagcgtgaccgacgccgtgcccttccccatcagcctgatctggaaccacgacagcgaggacaccgagggcgtgcacgaggtgttcagcagaaaccacgccgcccccttcagcaaggtgctgaccttcctgagaagaggccccttcgagctggaggccttctacagcgacccccagggcgtgccctaccccgaggccaagatcggcagattcgtggtgcagaacgtgagcgcccagaaggacggcgagaagagcagagtgaaggtgaaggtgagagtgaacacccacggcatcttcaccatcagcaccgccagcatggtggagaaggtgcccaccgaggagaacgagatgagcagcgaggccgacatggagtgcctgaaccagagaccccccgagaaccccgacaccgacaagaacgtgcagcaggacaacagcgaggccggcacccagccccaggtgcagaccgacgcccagcagaccagccagagcccccccagccccgagctgaccagcgaggagaacaagatccccgacgccgacaaggccaacgagaagaaggtggaccagccccccgaggccaagaagcccaagatcaaggtggtgaacgtggagctgcccatcgaggccaacctggtgtggcagctgggcaaggacctgctgaacatgtacatcgagaccgagggcaagatgatcatgcaggacaagctggagaaggagagaaacgacgccaagaacgccgtggaggagtacgtgtacgagttcagagacaagctgtgcggcccctacgagaagttcatctgcgagcaggaccaccagaacttcctgagactgctgaccgagaccgaggactggctgtacgaggagggcgaggaccaggccaagcaggcctacgtggacaagctggaggagctgatgaagatcggcacccccgtgaaggtgagattccaggaggccgaggagagacccaagatgttcgaggagctgggccagagactgcagcactacgccaagatcgccgccgacttcagaaacaaggacgagaagtacaaccacatcgacgagagcgagatgaagaaggtggagaagagcgtgaacgaggtgatggagtggatgaacaacgtgatgaacgcccaggccaagaagagcctggaccaggaccccgtggtgagagcccaggagatcaagaccaagatcaaggagctgaacaacacctgcgagcccgtggtgacccagcccaagcccaagatcgagagccccaagctggagagaacccccaacggccccaacatcgacaagaaggaggaggacctggaggacaagaacaacttcggcgccgagcccccccaccagaacggcgagtgctaccccaacgagaagaacagcgtgaacatggacctggactag

SEQ ID NO: 84111 - DNA, 582 bp, Artificial Sequence
  Description of Artificial Sequence: Synthetic coding sequence
atggacagcaccctggccgtgcagcagtacatccagcagaacatcagagccgactgcagcaacatcgacaagatcctggagccccccgagggccaggacgagggcgtgtggaagtacgagcacctgagacagttctgcctggagctgaacggcctggccgtgaagctgcagagcgagtgccaccccgacacctgcacccagatgaccgccaccgagcagtggatcttcctgtgcgccgcccacaagacccccaaggagtgccccgccatcgactacaccagacacaccctggacggcgccgcctgcctgctgaacagcaacaagtacttccccagcagagtgagcatcaaggagagcagcgtggccaagctgggcagcgtgtgcagaagaatctacagaatcttcagccacgcctacttccaccacagacagatcttcgacgagtacgagaacgagaccttcctgtgccacagattcaccaagttcgtgatgaagtacaacctgatgagcaaggacaacctgatcgtgcccatcctggaggaggaggtgcagaacagcgtgagcggcgagagcgaggcctag

SEQ ID NO: 84112 - DNA, 306 bp, Artificial Sequence
  Description of Artificial Sequence: Synthetic coding sequence
atggccggccaggccttcagaaagttcctgcccctgttcgacagagtgctggtggagagaagcgccgccgagaccgtgaccaagggcggcatcatgctgcccgagaagagccagggcaaggtgctgcaggccaccgtggtggccgtgggcagcggcagcaagggcaagggcggcgagatccagcccgtgagcgtgaaggtgggcgacaaggtgctgctgcccgagtacggcggcaccaaggtggtgctggacgacaaggtgtgcaagctgaacaacagcaagaagaagagcgacatctgcaactag

SEQ ID NO: 84113 - DNA, 144 bp, Artificial Sequence
  Description of Artificial Sequence: Synthetic coding sequence
atgggcggcgagatccagcccgtgagcgtgaaggtgggcgacaaggtgctgctgcccgagtacggcggcaccaaggtggtgctggacgacaaggactacttcctgttcagagacggcgacatcctgggcaagtacgtggactag

SEQ ID NO: 84114 - DNA, 591 bp, Artificial Sequence
  Description of Artificial Sequence: Synthetic coding sequence
atggccgacggccagatgcccttcagctgccactaccccagcagactgagaagagaccccttcagagacagccccctgagcagcagactgctggacgacggcttcggcatggaccccttccccgacgacctgaccgccagctggcccgactgggccctgcccagactgagcagcgcctggcccggcaccctgagaagcggcatggtgcccagaggccccaccgccaccgccagattcggcgtgcccgccgagggcagaacccccccccccttccccggcgagccctggaaggtgtgcgtgaacgtgcacagcttcaagcccgaggagctgatggtgaagaccaaggacggctacgtggaggtgagcggcaagcacgaggagaagcagcaggagggcggcatcgtgagcaagaacttcaccaagaagatccagctgcccgccgaggtggaccccgtgaccgtgttcgccagcctgagccccgagggcctgctgatcatcgaggccccccaggtgcccccctacagcaccttcggcgagagcagcttcaacaacgagctgccccaggacagccaggaggtgacctgcacctag

SEQ ID NO: 84115 - DNA, 453 bp, Artificial Sequence
  Description of Artificial Sequence: Synthetic coding sequence
atggccaagatcatcctgagacacctgatcgagatccccgtgagataccaggaggagttcgaggccagaggcctggaggactgcagactggaccacgccctgtacgccctgcccggccccaccatcgtggacctgagaaagaccagagccgcccagagcccccccgtggacagcgccgccgagaccccccccagagagggcaagagccacttccagatcctgctggacgtggtgcagttcctgcccgaggacatcatcatccagaccttcgagggctggctgctgatcaaggcccagcacggcaccagaatggacgagcacggcttcatcagcagaagcttcaccagacagtacaagctgcccgacggcgtggagatcaaggacctgagcgccgtgctgtgccacgacggcatcctggtggtggaggtgaaggaccccgtgggcaccaagtag

SEQ ID NO: 84116 - DNA, 513 bp, Artificial Sequence
  Description of Artificial Sequence: Synthetic coding sequence
atgagccacagaaccagcagcaccttcagagccgagagaagcttccacagcagcagcagcagcagcagcagcagcaccagcagcagcgccagcagagccctgcccgcccaggacccccccatggagaaggccctgagcatgttcagcgacgacttcggcagcttcatgagaccccacagcgagcccctggccttccccgccagacccggcggcgccggcaacatcaagaccctgggcgacgcctacgagttcgccgtggacgtgagagacttcagccccgaggacatcatcgtgaccaccagcaacaaccacatcgaggtgagagccgagaagctggccgccgacggcaccgtgatgaacaccttcgcccacaagtgccagctgcccgaggacgtggaccccaccagcgtgaccagcgccctgagagaggacggcagcctgaccatcagagccagaagacacccccacaccgagcacgtgcagcagaccttcagaaccgagatcaagatctag

SEQ ID NO: 84117 - DNA, 792 bp, Artificial Sequence
  Description of Artificial Sequence: Synthetic coding sequence
atgagcggctgcgagctgagccccctgggcctgagagtgggcctgagcgccggccccgcccacggcagaagattccccgcccccagcggcccctggagaggcctgaacctggccagcagacagggcgccggccccaagcccagagacagcagaccctacaaggccgccgccgtgggcgcctggcacgccagacccgaggcctgcgcccacaccctgagctgccccgccctggccagactgggcagagccagaagaagaccctggatgagccacagaaccagcagcaccttcagagccgagagaagcttccacagcagcagcagcagcagcagcagcagcaccagcagcagcgccagcagagccctgcccgcccaggacccccccatggagaaggccctgagcatgttcagcgacgacttcggcagcttcatgagaccccacagcgagcccctggccttccccgccgcccaccccaccgccagacccggcggcgccggcaacatcaagaccctgggcgacgcctacgagttcgccgtggacgtgagagacttcagccccgaggacatcatcgtgaccaccagcaacaaccacatcgaggtgagagccgagaagctggccgccgacggcaccgtgatgaacaccttcgcccacaagtgccagctgcccgaggacgtggaccccaccagcgtgaccagcgccctgagagaggacggcagcctgaccatcagagccagaagacacccccacaccgagcacgtgcagcagaccttcagaaccgagatcaagatctag

SEQ ID NO: 84118 - DNA, 528 bp, Artificial Sequence
  Description of Artificial Sequence: Synthetic coding sequence
atgagccacagaaccagcagcaccttcagagccgagagaagcttccacagcagcagcagcagcagcagcagcagcaccagcagcagcgccagcagagccctgcccgcccaggacccccccatggagaaggccctgagcatgttcagcgacgacttcggcagcttcatgagaccccacagcgagcccctggccttccccgccgcccaccccaccgccagacccggcggcgccggcaacatcaagaccctgggcgacgcctacgagttcgccgtggacgtgagagacttcagccccgaggacatcatcgtgaccaccagcaacaaccacatcgaggtgagagccgagaagctggccgccgacggcaccgtgatgaacaccttcgcccacaagtgccagctgcccgaggacgtggaccccaccagcgtgaccagcgccctgagagaggacggcagcctgaccatcagagccagaagacacccccacaccgagcacgtgcagcagaccttcagaaccgagatcaagatctag

SEQ ID NO: 84119 - DNA, 207 bp, Artificial Sequence
  Description of Artificial Sequence: Synthetic coding sequence
atgagccacagaaccagcagcaccttcagagccgagagaagcttccacagcagcagcagcagcagcagcagcagcaccagcagcagcgccagcagagccctgcccgcccaggacccccccatggagaaggccctgagcatgttcagcgacgacttcggcagcttcatgagaccccacagcgagcccctggccttccccggcaagtag

SEQ ID NO: 84120 - DNA, 1722 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagcatcgacctgaaggacaagtacaagaacatcggcgccaagctggtgcaggacgtggccaacaacaccaacgaggaggccggcgacggcaccaccaccgccaccgtgctggccagaagcatcgccaaggagggcttcgagaagatcagcaagggcgccaaccccgtggagatcagaagaggcgtgatgctggccgtggacgccgtgatcgccgagctgaagaagcagagcaagcccgtgaccacccccgaggagatcgcccaggtggccaccatcagcgccaacggcgacaaggagatcggcaacatcatcagcgacgccatgaagaaggtgggcagaaagggcgtgatcaccgtgaaggacggcaagaccctgaacgacgagctggagatcatcgagggcatgaagttcgacagaggctacatcagcccctacttcatcaacaccagcaagggccagaagtgcgagttccaggacgcctacgtgctgctgagcgagaagaagatcagcagcatccagagcatcgtgcccgccctggagatcgccaacgcccacagaaagcccctggtgatcatcgccgaggacgtggacggcgaggccctgagcaccctggtgctgaacagactgaaggtgggcctgcaggtggtggccgtgaaggcccccggcttcggcgacaacagaaagaaccagctgaaggacatggccatcgccaccggcggcgccgtgttcggcgaggagggcctgaccctgaacctggaggacgtgcagccccacgacctgggcaaggtgggcgaggtgatcgtgaccaaggacgacgccatgctgctgaagggcaagggcgacaaggcccagatcgagaagagaatccaggagatcatcgagcagctggacgtgaccaccagcgagtacgagaaggagaagctgaacgagagactggccaagctgagcgacggcgtggccgtgctgaaggtgggcggcaccagcgacgtggaggtgaacgagaagaaggacagagtgaccgacgccctgaacgccaccagagccgccgtggaggagggcatcgtgctgggcggcggctgcgccctgctgagatgcatccccgccctggacagcctgacccccgccaacgaggaccagaagatcggcatcgagatcatcaagagaaccctgaagatccccgccatgaccatcgccaagaacgccggcgtggagggcagcctgatcgtggagaagatcatgcagagcagcagcgaggtgggctacgacgccatggccggcgacttcgtgaacatggtggagaagggcatcatcgaccccaccaaggtggtgagaaccgccctgctggacgccgccggcgtggccagcctgctgaccaccgccgaggtggtggtgaccgagatccccaaggaggagaaggaccccggcatgggcgccatgggcggcatgggcggcggcatgggcggcggcatgttctag

SEQ ID NO: 84121 - DNA, 1722 bp, Artificial Sequence; identical to SEQ ID NO: 84120
  Description of Artificial Sequence: Synthetic coding sequence

SEQ ID NO: 84122 - DNA, 177 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagtag

SEQ ID NO: 84123 - DNA, 285 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagcatcgacctgaaggacaagtacaagaacatcggctag

SEQ ID NO: 84124 - DNA, 705 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagcatcgacctgaaggacaagtacaagaacatcggcgccaagctggtgcaggacgtggccaacaacaccaacgaggaggccggcgacggcaccaccaccgccaccgtgctggccagaagcatcgccaaggagggcttcgagaagatcagcaagggcgccaaccccgtggagatcagaagaggcgtgatgctggccgtggacgccgtgatcgccgagctgaagaagcagagcaagcccgtgaccacccccgaggagatcgcccaggtggccaccatcagcgccaacggcgacaaggagatcggcaacatcatcagcgacgccatgaagaaggtgggcagaaagggcgtgatcaccgacggcaagaccctgaacgacgagctggagatcatcgagggcatgaagttcgacagaggctacatcagcccctacttcatcaacaccagcaagggcaagaactag

SEQ ID NO: 84125 - DNA, 252 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagctag

SEQ ID NO: 84126 - DNA, 666 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagcatcgacctgaaggacaagtacaagaacatcggcgccaagctggtgcaggacgtggccaacaacaccaacgaggaggccggcgacggcaccaccaccgccaccgtgctggccagaagcatcgccaaggagggcttcgagaagatcagcaagggcgccaaccccgtggagatcagaagaggcgtgatgctggccgtggacgccgtgatcgccgagctgaagaagcagagcaagcccgtgaccacccccgaggagatcgcccaggtggccaccatcagcgccaacggcgacaaggagatcggcaacatcatcagcgacgccatgaagaaggtgggcagaaagggcgtgatcaccgtgaaggacggcaagaccctgaacgacgagctggagatcatcgagggcatgaagttcgacagatag

SEQ ID NO: 84127 - DNA, 738 bp, Artificial Sequence
  Description of Artificial Sequence: Synthetic coding sequence
atgctggccgtggacgccgtgatcgccgagctgaagaagcagagcaagcccgtgaccacccccgaggagatcgcccaggtggccaccatcagcgccaacggcgacaaggagatcggcaacatcatcagcgacgccatgaagaaggtgggcagaaagggcgtgatcaccgtgaaggacggcaagaccctgaacgacgagctggagatcatcgagggcatgaagttcgacagaggctacatcagcccctacttcatcaacaccagcaagggccagaagtgcgagttccaggacgcctacgtgctgctgagcgagaagaagatcagcagcatccagagcatcgtgcccgccctggagatcgccaacgcccacagaaagcccctggtgatcatcgccgaggacgtggacggcgaggccctgagcaccctggtgctgaacagactgaaggtgggcctgcaggtggtggccgtgaaggcccccggcttcggcgacaacagaaagaaccagctgaaggacatggccatcgccaccggcggcgccgtgttcggcgaggagggcctgaccctgaacctggaggacgtgcagccccacgacctgggcaaggtgggcgaggtgatcgtgaccaaggacgacgccatgctgctgaagggcaagggcgacaaggcccagatcgagaagagaatccaggagatcatcgagcagctggacgtgaccaccagcgagtacgagaaggagaactag

SEQ ID NO: 84128 - DNA, 477 bp, Artificial Sequence
  Description of Artificial Sequence: Synthetic coding sequence
atgctgagactgcccaccgtgttcagacagatgagacccgtgagcagagtgctggccccccacctgaccagagcctacgccaaggacgtgaagttcggcgccgacgccagagccctgatgctgcagggcgtggacctgctggccgacgccgtggccgtgaccatgggccccaagggcagaaccgtgatcatcgagcagagctggggcagccccaaggtgaccaaggacggcgtgaccgtggccaagagcatcgacctgaaggacaagtacaagaacatcggcgccaagctggtgcaggacgtggccaacaacaccaacgaggaggccggcgacggcaccaccaccgccaccgtgctggccagaagcatcgccaaggagggcttcgagaagatcagcaagggcgccaaccccgtggagatcagaagaggcagaaacgtgtgctgccaccacagcgtgctgaacttcagcgtgctgtag

SEQ ID NO: 84129 - DNA, 2061 bp, Artificial Sequence
  Description of Artificial Sequence: Synthetic coding sequence
atgctggccgtgcccgagatgggcctgcagggcctgtacatcggcagcagccccgagagaagccccgtgcccagcccccccggcagccccagaacccaggagagctgcggcatcgcccccctgacccccagccagagccccaagcccgaggtgagagccccccagcaggccagcttcagcgtggtggtggccatcgacttcggcaccaccagcagcggctacgccttcagcttcgccagcgaccccgaggccatccacatgatgagaaagtgggagggcggcgaccccggcgtggcccaccagaagacccccacctgcctgctgctgacccccgagggcgccttccacagcttcggctacaccgccagagactactaccacgacctggaccccgaggaggccagagactggctgtacttcgagaagttcaagatgaagatccacagcgccaccgacctgaccctgaagacccagctggaggccgtgaacggcaagaccatgcccgccctggaggtgttcgcccacgccctgagattcttcagagagcacgccctgcaggagctgagagagcagagccccagcctgcccgagaaggacaccgtgagatgggtgctgaccgtgcccgccatctggaagcagcccgccaagcagttcatgagagaggccgcctacctggccggcctggtgagcagagagaacgccgagcagctgctgatcgccctggagcccgaggccgccagcgtgtactgcagaaagctgagactgcaccagctgctggacctgagcggcagagcccccggcggcggcagactgggcgagagaagaagcatcgacagcagcttcagacaggccagagagcagctgagaagaagcagacacagcagaaccttcctggtggagagcggcgtgggcgagctgtgggccgagatgcaggccggcgacagatacgtggtggccgactgcggcggcggcaccgtggacctgaccgtgcaccagctggagcagccccacggcaccctgaaggagctgtacaaggccagcggcggcccctacggcgccgtgggcgtggacctggccttcgagcagctgctgtgcagaatcttcggcgaggacttcatcgccaccttcaagagacagagacccgccgcctgggtggacctgaccatcgccttcgaggccagaaagagaaccgccggcccccacagagccggcgccctgaacatcagcctgcccttcagcttcatcgacttctacagaaagcagagaggccacaacgtggagaccgccctgagaagaagcagcgtgaacttcgtgaagtggagcagccagggcatgctgagaatgagctgcgaggccatgaacgagctgttccagcccaccgtgagcggcatcatccagcacatcgaggccctgctggccagacccgaggtgcagggcgtgaagctgctgttcctggtgggcggcttcgccgagagcgccgtgctgcagcacgccgtgcaggccgccctgggcgccagaggcctgagagtggtggtgccccacgacgtgggcctgaccatcctgaagggcgccgtgctgttcggccaggcccccggcgtggtgagagtgagaagaagccccctgacctacggcgtgggcgtgctgaacagattcgtgcccggcagacacccccccgagaagctgctggtgagagacggcagaagatggtgcaccgacgtgttcgagagattcgtggccgccgagcagagcgtggccctgggcgaggaggtgagaagaagctactgccccgccagacccggccagagaagagtgctgatcaacctgtactgctgcgccgccgaggacgccagattcatcaccgaccccggcgtgagaaagtgcggcgccctgagcctggagctggagcccgccgactgcggccaggacaccgccggcgccccccccggcagaagagagatcagagccgccatgcagttcggcgacaccgagatcaaggtgaccgccgtggacgtgagcaccaacagaagcgtgagagccagcatcgacttcctgagcaactag

SEQ ID NO: 84130 - DNA, 1803 bp, Artificial Sequence
  Description of Artificial Sequence: Synthetic coding sequence
atgatgagaaagtgggagggcggcgaccccggcgtggcccaccagaagacccccacctgcctgctgctgacccccgagggcgccttccacagcttcggctacaccgccagagactactaccacgacctggaccccgaggaggccagagactggctgtacttcgagaagttcaagatgaagatccacagcgccaccgacctgaccctgaagacccagctggaggccgtgaacggcaagaccatgcccgccctggaggtgttcgcccacgccctgagattcttcagagagcacgccctgcaggagctgagagagcagagccccagcctgcccgagaaggacaccgtgagatgggtgctgaccgtgcccgccatctggaagcagcccgccaagcagttcatgagagaggccgcctacctggccggcctggtgagcagagagaacgccgagcagctgctgatcgccctggagcccgaggccgccagcgtgtactgcagaaagctgagactgcaccagctgctggacctgagcggcagagcccccggcggcggcagactgggcgagagaagaagcatcgacagcagcttcagacaggccagagagcagctgagaagaagcagacacagcagaaccttcctggtggagagcggcgtgggcgagctgtgggccgagatgcaggccggcgacagatacgtggtggccgactgcggcggcggcaccgtggacctgaccgtgcaccagctggagcagccccacggcaccctgaaggagctgtacaaggccagcggcggcccctacggcgccgtgggcgtggacctggccttcgagcagctgctgtgcagaatcttcggcgaggacttcatcgccaccttcaagagacagagacccgccgcctgggtggacctgaccatcgccttcgaggccagaaagagaaccgccggcccccacagagccggcgccctgaacatcagcctgcccttcagcttcatcgacttctacagaaagcagagaggccacaacgtggagaccgccctgagaagaagcagcgtgaacttcgtgaagtggagcagccagggcatgctgagaatgagctgcgaggccatgaacgagctgttccagcccaccgtgagcggcatcatccagcacatcgaggccctgctggccagacccgaggtgcagggcgtgaagctgctgttcctggtgggcggcttcgccgagagcgccgtgctgcagcacgccgtgcaggccgccctgggcgccagaggcctgagagtggtggtgccccacgacgtgggcctgaccatcctgaagggcgccgtgctgttcggccaggcccccggcgtggtgagagtgagaagaagccccctgacctacggcgtgggcgtgctgaacagattcgtgcccggcagacacccccccgagaagctgctggtgagagacggcagaagatggtgcaccgacgtgttcgagagattcgtggccgccgagcagagcgtggccctgggcgaggaggtgagaagaagctactgccccgccagacccggccagagaagagtgctgatcaacctgtactgctgcgccgccgaggacgccagattcatcaccgaccccggcgtgagaaagtgcggcgccctgagcctggagctggagcccgccgactgcggccaggacaccgccggcgccccccccggcagaagagagatcagagccgccatgcagttcggcgacaccgagatcaaggtgaccgccgtggacgtgagcaccaacagaagcgtgagagccagcatcgacttcctgagcaactag

SEQ ID NO: 84131 - DNA, 1563 bp, Artificial Sequence
  Description of Artificial Sequence: Synthetic coding sequence
atgcccgccctggaggtgttcgcccacgccctgagattcttcagagagcacgccctgcaggagctgagagagcagagccccagcctgcccgagaaggacaccgtgagatgggtgctgaccgtgcccgccatctggaagcagcccgccaagcagttcatgagagaggccgcctacctggccggcctggtgagcagagagaacgccgagcagctgctgatcgccctggagcccgaggccgccagcgtgtactgcagaaagctgagactgcaccagctgctggacctgagcggcagagcccccggcggcggcagactgggcgagagaagaagcatcgacagcagcttcagacaggccagagagcagctgagaagaagcagacacagcagaaccttcctggtggagagcggcgtgggcgagctgtgggccgagatgcaggccggcgacagatacgtggtggccgactgcggcggcggcaccgtggacctgaccgtgcaccagctggagcagccccacggcaccctgaaggagctgtacaaggccagcggcggcccctacggcgccgtgggcgtggacctggccttcgagcagctgctgtgcagaatcttcggcgaggacttcatcgccaccttcaagagacagagacccgccgcctgggtggacctgaccatcgccttcgaggccagaaagagaaccgccggcccccacagagccggcgccctgaacatcagcctgcccttcagcttcatcgacttctacagaaagcagagaggccacaacgtggagaccgccctgagaagaagcagcgtgaacttcgtgaagtggagcagccagggcatgctgagaatgagctgcgaggccatgaacgagctgttccagcccaccgtgagcggcatcatccagcacatcgaggccctgctggccagacccgaggtgcagggcgtgaagctgctgttcctggtgggcggcttcgccgagagcgccgtgctgcagcacgccgtgcaggccgccctgggcgccagaggcctgagagtggtggtgccccacgacgtgggcctgaccatcctgaagggcgccgtgctgttcggccaggcccccggcgtggtgagagtgagaagaagccccctgacctacggcgtgggcgtgctgaacagattcgtgcccggcagacacccccccgagaagctgctggtgagagacggcagaagatggtgcaccgacgtgttcgagagattcgtggccgccgagcagagcgtggccctgggcgaggaggtgagaagaagctactgccccgccagacccggccagagaagagtgctgatcaacctgtactgctgcgccgccgaggacgccagattcatcaccgaccccggcgtgagaaagtgcggcgccctgagcctggagctggagcccgccgactgcggccaggacaccgccggcgccccccccggcagaagagagatcagagccgccatgcagttcggcgacaccgagatcaaggtgaccgccgtggacgtgagcaccaacagaagcgtgagagccagcatcgacttcctgagcaactag

SEQ ID NO: 84132 - DNA, 2028 bp, Artificial Sequence
  Description of Artificial Sequence: Synthetic coding sequence
atggccgacaaggaggccggcggcagcgacggccccagagagaccgcccccaccagcgcctacagcagccccgccagaagcctgggcgacaccggcatcacccccctgagccccagccacatcgtgaacgacaccgacagcaacgtgagcgagcagcagagcttcctggtggtggtggccgtggacttcggcaccaccagcagcggctacgcctacagcttcaccaaggagcccgagtgcatccacgtgatgagaagatgggagggcggcgaccccggcgtgagcaaccagaagacccccaccaccatcctgctgacccccgagagaaagttccacagcttcggctacgccgccagagacttctaccacgacctggaccccaacgaggccaagcagtggctgtacctggagaagttcaagatgaagctgcacaccaccggcgacctgaccatggacaccgacctgaccgccgccaacggcaagaaggtgaaggccctggagatcttcgcctacgccctgcagtacttcaaggagcaggccctgaaggagctgagcgaccaggccggcagcgagttcgagaacagcgacgtgagatgggtgatcaccgtgcccgccatctggaagcagcccgccaagcagttcatgagacaggccgcctaccaggccggcctggccagccccgagaacagcgagcagctgatcatcgccctggagcccgaggccgccagcatctactgcagaaagctgagactgcaccagatgatcgagctgagcagcaaggccgccgtgaacggctacagcggcagcgacaccgtgggcgccggcttcacccaggccaaggagcacatcagaagaaacagacagagcagaaccttcctggtggagaacgtgatcggcgagatctggagcgagctggaggagggcgacaagtacgtggtggtggacagcggcggcggcaccgtggacctgaccgtgcaccagatcagactgcccgagggccacctgaaggagctgtacaaggccaccggcggcccctacggcagcctgggcgtggactacgagttcgagaagctgctgtacaagatcttcggcgaggacttcatcgagcagttcaagatcaagagacccgccgcctgggtggacctgatgatcgccttcgagagcagaaagagagccgccgcccccgacagaaccaaccccctgaacatcaccctgcccttcagcttcatcgactactacaagaagttcagaggccacagcgtggagcacgccctgagaaagagcaacgtggacttcgtgaagtggagcagccagggcatgctgagaatgagccccgacgccatgaacgccctgttcaagcccaccatcgacagcatcatcgagcacctgagagacctgttccagaagcccgaggtgagcaccgtgaagttcctgttcctggtgggcggcttcgccgaggcccccctgctgcagcaggccgtgcaggccgccttcggcgaccagtgcagaatcatcatcccccaggacgtgggcctgaccatcctgaagggcgccgtgctgttcggcctggaccccgccgtgatcaaggtgagaagaagccccctgacctacggcgtgggcgtgctgaacagatacgtggagggcaagcacccccccgagaagctgctggtgaaggacggcaccagatggtgcaccgacgtgttcgacaagttcatcagcgccgaccagagcgtggccctgggcgagctggtgaagagaagctacacccccgccaagcccagccagctggtgatcgtgatcaacatctacagcagcgagcacgacaacgtgagcttcatcaccgaccccggcgtgaagaagtgcggcaccctgagactggacctgaccggcaccagcggcaccgccgtgcccgccagaagagagatccagaccctgatgcagttcggcgacaccgagatcaaggccaccgccatcgacatcgccaccagcaagagcgtgaaggtgggcatcgacttcctgaactactag

SEQ ID NO: 84133 - DNA, 819 bp, Artificial Sequence
  Description of Artificial Sequence: Synthetic coding sequence
atgagaagcctggacctggccagccagctgctgagaaaccagatcgtgaccgaccccgacaacctgatggaggacgccgcctgggccaagcactgcgaccagaacctggtggccagcgacgcccccggcgaggagggcaccggcatcctgaagagcaagagaacccaggccgccgaccaccagcccatcctgaagaccgtgaaggccagcgacgaggactgccagctgagaatcagcgacagaatcagagagaccagcgacctggaggacagctgggacgagagcagcggcgccggctgcagccagggcacccccagctacagcagcagccacagcctgttcagaggcgccgtggccccctgccagagcagccccatggccagactgggcgtgagcggcgagcccagcccctgcaccagcaccaacagaagcacccccggcgtggccagcaccccccagacccccgtgagcagcagcagagccggcttcgtgagcggcggcgacagacccctgaccagcgagcccccccccagatgggccagaagaagaagaagaagcgtggccagaaccatcgccgccgagctggccgagaacagaagactggccagagagctgagcaagagagaggaggagaagctggacagactgatcgccatcggcgaggaggccagcgcccagcaggacaccgccaacgagctgagaagagacgccgtgatcgccgtgagaagactggccaccgccgtggaggaggccaccggcgccttccagctgggcctggagaagctgctgcagagactgatcagcaacaccaagagctag

SEQ ID NO: 84134 - DNA, 1530 bp, Artificial Sequence
  Description of Artificial Sequence: Synthetic coding sequence
atggccgccatcggcgtgcacctgggctgcaccagcgcctgcgtggccgtgtacaaggacggcagagccggcgtggtggccaacgacgccggcgacagagtgacccccgccgtggtggcctacagcgagaacgaggagatcgtgggcctggccgccaagcagagcagaatcagaaacatcagcaacaccgtgatgaaggtgaagcagatcctgggcagaagcagcagcgacccccaggcccagaagtacatcgccgagagcaagtgcctggtgatcgagaagaacggcaagctgagatacgagatcgacaccggcgaggagaccaagttcgtgaaccccgaggacgtggccagactgatcttcagcaagatgaaggagaccgcccacagcgtgctgggcagcgacgccaacgacgtggtgatcaccgtgcccttcgacttcggcgagaagcagaagaacgccctgggcgaggccgccagagccgccggcttcaacgtgctgagactgatccacgagcccagcgccgccctgctggcctacggcatcggccaggacagccccaccggcaagagcaacatcctggtgttcaagctgggcggcaccagcctgagcctgagcgtgatggaggtgaacagcggcatctacagagtgctgagcaccaacaccgacgacaacatcggcggcgcccacttcaccgagaccctggcccagtacctggccagcgagttccagagaagcttcaagcacgacgtgagaggcaacgccagagccatgatgaagctgaccaacagcgccgaggtggccaagcacagcctgagcaccctgggcagcgccaactgcttcctggacagcctgtacgagggccaggacttcgactgcaacgtgagcagagccagattcgagctgctgtgcagccccctgttcaacaagtgcatcgaggccatcagaggcctgctggaccagaacggcttcaccgccgacgacatcaacaaggtggtgctgtgcggcggcagcagcagaatccccaagctgcagcagctgatcaaggacctgttccccgccgtggagctgctgaacagcatcccccccgacgaggtgatccccatcggcgccgccatcgaggccggcatcctgatcggcaaggagaacctgctggtggaggacagcctgatgatcgagtgcagcgccagagacatcctggtgaagggcgtggacgagagcggcgccagcagattcaccgtgctgttccccagcggcacccccctgcccgccagaagacagcacaccctgcaggcccccggcagcatcagcagcgtgtgcctggagctgtacgagagcgacggcaagaacagcgccaaggaggagaccaagttcgcccaggtggtgctgcaggacctggacaagaaggagaacggcctgagagacatcctggccgtgctgaccatgaagagagacggcagcctgcacgtgacctgcaccgaccaggagaccggcaagtgcgaggccatcagcatcgagatcgccagctag

SEQ ID NO: 84135 - DNA, 432 bp, Artificial Sequence
  Description of Artificial Sequence: Synthetic coding sequence
atggccgccatcggcgtgcacctgggctgcaccagcgcctgcgtggccgtgtacaaggacggcagagccggcgtggtggccaacgacgccggcgacagagtgacccccgccgtggtggcctacagcgagaacgaggagatcgtgggcctggccgccaagcagagcagaatcagaaacatcagcaacaccgtgatgaaggtgaagcagatcctgggcagaagagtgctgagcagagacccccagctgcagcagctgccccagcccttccagagatgcagctgcagcctgagcgagcagccccacggccagaccggctgcgtgagaggcgcccagcccctgcaccagcaccagccccagcacagctggggcagcctgcacaccgccgacagcagcctgctgttcgagagctggttctgcttctggtggggctag

SEQ ID NO: 84136 - DNA, 387 bp, Artificial Sequence
  Description of Artificial Sequence: Synthetic coding sequence
tgagcctgcgtggccgtgtacaaggacggcagagccggcgtggtggccaacgacgccggcgacagagtgacccccgccgtggtggcctacagcgagaacgaggagatcgtgggcctggccgccaagcagagcagaatcagaaacatcagcaacaccgtgatgaaggtgaagcagatcctgggcagaagcagcagcgacccccaggcccagaagtacatcgccgagagcaagtgcctggtgatcgagaagaacggcaagctgagatacgagatcgacaccggcgaggagaccaagttcgtgaaccccgaggacgtggccagactgatcttcagcaagatgaagggcgcctacagcccctggagccagagcaacagcgaggacggctag

SEQ ID NO: 84137 - DNA, 1926 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccctgaacccccagaacaccgtgttcgacgccaagagactgatcggcagaaagttcggcgaccccgtggtgcagagcgacatgaagcactggcccttccaggtgatcaacgacggcgacaagcccaaggtgcaggtgagctacaagggcgagaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84138 - DNA, 1431 bp, Artificial Sequence
  Description of Artificial Sequence: Synthetic coding sequence
atggccaaggccgccgccatcggcatcgacctgggcaccacctacagctgcgtgggcgtgttccagcacggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84139 - DNA, 1431 bp, Artificial Sequence; identical to SEQ ID NO: 84138
  Description of Artificial Sequence: Synthetic coding sequence

SEQ ID NO: 84140 - DNA, 1926 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccctgaacccccagaacaccgtgttcgacgccaagagactgatcggcagaaagttcggcgaccccgtggtgcagagcgacatgaagcactggcccttccaggtgatcaacgacggcgacaagcccaaggtgcaggtgagctacaagggcgacaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84141 - DNA, 1431 bp, Artificial Sequence; identical to SEQ ID NO: 84138
  Description of Artificial Sequence: Synthetic coding sequence

SEQ ID NO: 84142 - DNA, 1926 bp, Artificial Sequence; identical to SEQ ID NO: 84137
  Description of Artificial Sequence: Synthetic coding sequence

SEQ ID NO: 84143 - DNA, 1926 bp, Artificial Sequence; identical to SEQ ID NO: 84137
  Description of Artificial Sequence: Synthetic coding sequence

SEQ ID NO: 84144 - DNA, 699 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccccccccgccagccccagatgcagaagctgctgcagaaccagcagcaccggcgccacctag

SEQ ID NO: 84145 - DNA, 1926 bp, Artificial Sequence; identical to SEQ ID NO: 84137
  Description of Artificial Sequence: Synthetic coding sequence

SEQ ID NO: 84146 - DNA, 1431 bp, Artificial Sequence; identical to SEQ ID NO: 84138
  Description of Artificial Sequence: Synthetic coding sequence

SEQ ID NO: 84147 - DNA, 1431 bp, Artificial Sequence; identical to SEQ ID NO: 84138
  Description of Artificial Sequence: Synthetic coding sequence

SEQ ID NO: 84148 - DNA, 1653 bp, Artificial Sequence
  Description of Artificial Sequence: Synthetic coding sequence
atggccaaggccgccgccatcggcatcgacctgggcaccacctacagctgcgtgggcgtgttccagcacggcaaggtgcagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84149 - DNA, 1872 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccctgaaccccgtggtgcagagcgacatgaagcactggcccttccaggtgatcaacgacggcgacaagcccaaggtgcaggtgagctacaagggcgagaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84150 - DNA, 1653 bp, Artificial Sequence; identical to SEQ ID NO: 84148
  Description of Artificial Sequence: Synthetic coding sequence

SEQ ID NO: 84151 - DNA, 1653 bp, Artificial Sequence; identical to SEQ ID NO: 84148
  Description of Artificial Sequence: Synthetic coding sequence

SEQ ID NO: 84152 - DNA, 1653 bp, Artificial Sequence; identical to SEQ ID NO: 84148
  Description of Artificial Sequence: Synthetic coding sequence

SEQ ID NO: 84153 - DNA, 699 bp, Artificial Sequence; identical to SEQ ID NO: 84144
  Description of Artificial Sequence: Synthetic coding sequence

SEQ ID NO: 84154 - DNA, 1653 bp, Artificial Sequence; identical to SEQ ID NO: 84148
  Description of Artificial Sequence: Synthetic coding sequence

SEQ ID NO: 84155 - DNA, 699 bp, Artificial Sequence; identical to SEQ ID NO: 84144
  Description of Artificial Sequence: Synthetic coding sequence

SEQ ID NO: 84156 - DNA, 699 bp, Artificial Sequence; identical to SEQ ID NO: 84144
  Description of Artificial Sequence: Synthetic coding sequence

SEQ ID NO: 84157 - DNA, 699 bp, Artificial Sequence; identical to SEQ ID NO: 84144
  Description of Artificial Sequence: Synthetic coding sequence

SEQ ID NO: 84158 - DNA, 1926 bp, Artificial Sequence; identical to SEQ ID NO: 84137
  Description of Artificial Sequence: Synthetic coding sequence

SEQ ID NO: 84159 - DNA, 1926 bp, Artificial Sequence; identical to SEQ ID NO: 84137
  Description of Artificial Sequence: Synthetic coding sequence

SEQ ID NO: 84160 - DNA, 1926 bp, Artificial Sequence; identical to SEQ ID NO: 84137
  Description of Artificial Sequence: Synthetic coding sequence

SEQ ID NO: 84161 - DNA, 699 bp, Artificial Sequence; identical to SEQ ID NO: 84144
  Description of Artificial Sequence: Synthetic coding sequence

SEQ ID NO: 84162 - DNA, 1926 bp, Artificial Sequence; identical to SEQ ID NO: 84137
  Description of Artificial Sequence: Synthetic coding sequence

SEQ ID NO: 84163 - DNA, 1926 bp, Artificial Sequence; identical to SEQ ID NO: 84137
  Description of Artificial Sequence: Synthetic coding sequence

SEQ ID NO: 84164 - DNA, 2127 bp, Artificial Sequence
  Description of Artificial Sequence: Synthetic coding sequence
ctgagaagctgctgcgagggccccctgagactgagcagagtgacccccgccgtgcccagactgagcagagccaacctgtgcggctgcagacacagaagagtggagttccccgccttcagaagaaccgagctgctgagcagaatccccagcgccgtgagcagcccccagagccagagcggcgcccacagacagggcaccggcatggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccctgaacccccagaacaccgtgttcgacgccaagagactgatcggcagaaagttcggcgaccccgtggtgcagagcgacatgaagcactggcccttccaggtgatcaacgacggcgacaagcccaaggtgcaggtgagctacaagggcgagaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84165 - DNA, 1653 bp, Artificial Sequence; identical to SEQ ID NO: 84148
  Description of Artificial Sequence: Synthetic coding sequence

SEQ ID NO: 84166 - DNA, 1875 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccctgaacccccccgtggtgcagagcgacatgaagcactggcccttccaggtgatcaacgacggcgacaagcccaaggtgcaggtgagctacaagggcgagaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84167 - DNA, 1857 bp, Artificial Sequence
  Description of Artificial Sequence: Synthetic coding sequence
atggccaaggccgccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggtgcagagcgacatgaagcactggcccttccaggtgatcaacgacggcgacaagcccaaggtgcaggtgagctacaagggcgagaccaaggccttctaccccgaggagatcagcagcatggtgctgaccaagatgaaggagatcgccgaggcctacctgggctaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacagaaccggcaagggcgagagaaacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgaaccacttcgtggaggagttcaagagaaagcacaagaaggacatcagccagaacaagagagccgtgagaagactgagaaccgcctgcgagagagccaagagaaccctgagcagcagcacccaggccagcctggagatcgacagcctgttcgagggcatcgacttctacaccagcatcaccagagccagattcgaggagctgtgcagcgacctgttcagaagcaccctggagcccgtggagaaggccctgagagacgccaagctggacaaggcccagatccacgacctggtgctggtgggcggcagcaccagaatccccaaggtgcagaagctgctgcaggacttcttcaacggcagagacctgaacaagagcatcaaccccgacgaggccgtggcctacggcgccgccgtgcaggccgccatcctgatgggcgacaagagcgagaacgtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgaacgtgaccgccaccgacaagagcaccggcaaggccaacaagatcaccatcaccaacgacaagggcagactgagcaaggaggagatcgagagaatggtgcaggaggccgagaagtacaaggccgaggacgaggtgcagagagagagagtgagcgccaagaacgccctggagagctacgccttcaacatgaagagcgccgtggaggacgagggcctgaagggcaagatcagcgaggccgacaagaagaaggtgctggacaagtgccaggaggtgatcagctggctggacgccaacaccctggccgagaaggacgagttcgagcacaagagaaaggagctggagcaggtgtgcaaccccatcatcagcggcctgtaccagggcgccggcggccccggccccggcggcttcggcgcccagggccccaagggcggcagcggcagcggccccaccatcgaggaggtggactag

SEQ ID NO: 84168 - DNA, 1857 bp, Artificial Sequence; identical to SEQ ID NO: 84167
  Description of Artificial Sequence: Synthetic coding sequence

SEQ ID NO: 84169 - DNA, 1653 bp, Artificial Sequence; identical to SEQ ID NO: 84148
  Description of Artificial Sequence: Synthetic coding sequence

SEQ ID NO: 84170 - DNA, 1857 bp, Artificial Sequence; identical to SEQ ID NO: 84167
  Description of Artificial Sequence: Synthetic coding sequence

SEQ ID NO: 84171 - DNA, 1653 bp, Artificial Sequence; identical to SEQ ID NO: 84148
  Description of Artificial Sequence: Synthetic coding sequence

SEQ ID NO: 84172 - DNA, 1761 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccaccgacaagagcaccggcaaggtgaacaagatcaccatcaccaacgacaagggcagactgagcaaggaggagatcgagagaatggtgctggacgccgagaagtacaaggccgaggacgaggtgcagagagagaagatcgccgccaagaacgccctggagagctacgccttcaacatgaagagcgtggtgagcgacgagggcctgaagggcaagatcagcgagagcgacaagaacaagatcctggacaagtgcaacgagctgctgagctggctggaggtgaaccagctggccgagaaggacgagttcgaccacaagagaaaggagctggagcagatgtgcaaccccatcatcaccaagctgtaccagggcggctgcaccggccccgcctgcggcaccggctacgtgcccggcagacccgccaccggccccaccatcgaggaggtggactag

SEQ ID NO: 84173 - DNA, 1926 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccaccgacaagagcaccggcaaggtgaacaagatcaccatcaccaacgacaagggcagactgagcaaggaggagatcgagagaatggtgctggacgccgagaagtacaaggccgaggacgaggtgcagagagagaagatcgccgccaagaacgccctggagagctacgccttcaacatgaagagcgtggtgagcgacgagggcctgaagggcaagatcagcgagagcgacaagaacaagatcctggacaagtgcaacgagctgctgagctggctggaggtgaaccagctggccgagaaggacgagttcgaccacaagagaaaggagctggagcagatgtgcaaccccatcatcaccaagctgtaccagggcggctgcaccggccccgcctgcggcaccggctacgtgcccggcagacccgccaccggccccaccatcgaggaggtggactag

SEQ ID NO: 84174 - DNA, 1926 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccatggacaagagcaccggcaaggtgaacaagatcaccatcaccaacgacaagggcagactgagcaaggaggagatcgagagaatggtgctggacgccgagaagtacaaggccgaggacgaggtgcagagagagaagatcgccgccaagaacgccctggagagctacgccttcaacatgaagagcgtggtgagcgacgagggcctgaagggcaagatcagcgagagcgacaagaacaagatcctggacaagtgcaacgagctgctgagctggctggaggtgaaccagctggccgagaaggacgagttcgaccacaagagaaaggagctggagcagatgtgcaaccccatcatcaccaagctgtaccagggcggctgcaccggccccgcctgcggcaccggctacgtgcccggcagacccgccaccggccccaccatcgaggaggtggactag

SEQ ID NO: 84175 - DNA, 1926 bp, Artificial Sequence; identical to SEQ ID NO: 84173
  Description of Artificial Sequence: Synthetic coding sequence

SEQ ID NO: 84176 - DNA, 1926 bp, Artificial Sequence; identical to SEQ ID NO: 84173
  Description of Artificial Sequence: Synthetic coding sequence

SEQ ID NO: 84177 - DNA, 699 bp, Artificial Sequence
  Description of Artificial Sequence: Synthetic coding sequence
gccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaagggcgccccccccgccagccccagatgcagcggctgcttcagaaccaccagcatggacgtgatctag

SEQ ID NO: 84178 - DNA, 1926 bp, Artificial Sequence; identical to SEQ ID NO: 84174
  Description of Artificial Sequence: Synthetic coding sequence

SEQ ID NO: 84179 - DNA, 1599 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccatggacaagagcaccggcaaggtgaacaagatcaccatcaccaacgacaagggcagactgagcaaggaggagatcgagagaatggtgctggacgccgagaagtacaaggccgaggacgtgtag

SEQ ID NO: 84180 - DNA, 699 bp, Artificial Sequence; identical to SEQ ID NO: 84177
  Description of Artificial Sequence: Synthetic coding sequence

SEQ ID NO: 84181 - DNA, 1926 bp, Artificial Sequence; identical to SEQ ID NO: 84173
  Description of Artificial Sequence: Synthetic coding sequence

SEQ ID NO: 84182 - DNA, 1599 bp, Artificial Sequence; identical to SEQ ID NO: 84179
  Description of Artificial Sequence: Synthetic coding sequence

SEQ ID NO: 84183 - DNA, 1599 bp, Artificial Sequence
  Description of Artificial Sequence: Synthetic coding sequence
atggccaccgccaagggcatcgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaacccccagaacaccgtgttcgacgccaagagactgatcggcagaaagttcaacgaccccgtggtgcaggccgacatgaagctgtggcccttccaggtgatcaacgagggcggcaagcccaaggtgctggtgagctacaagggcgagaacaaggccttctaccccgaggagatcagcagcatggtgctgaccaagctgaaggagaccgccgaggccttcctgggccaccccgtgaccaacgccgtgatcaccgtgcccgcctacttcaacgacagccagagacaggccaccaaggacgccggcgtgatcgccggcctgaacgtgctgagaatcatcaacgagcccaccgccgccgccatcgcctacggcctggacaagggcggccagggcgagagacacgtgctgatcttcgacctgggcggcggcaccttcgacgtgagcatcctgaccatcgacgacggcatcttcgaggtgaaggccaccgccggcgacacccacctgggcggcgaggacttcgacaacagactggtgagccacttcgtggaggagttcaagagaaagcacaagaaggacatcagccagaacaagagagccgtgagaagactgagaaccgcctgcgagagagccaagagaaccctgagcagcagcacccaggccaacctggagatcgacagcctgtacgagggcatcgacttctacaccagcatcaccagagccagattcgaggagctgtgcgccgacctgttcagaggcaccctggagcccgtggagaaggccctgagagacgccaagatggacaaggccaagatccacgacatcgtgctggtgggcggcagcaccagaatccccaaggtgcagagactgctgcaggactacttcaacggcagagacctgaacaagagcatcaaccccgacgaggccgtggcctacggcgccgccgtgcaggccgccatcctgatgggcgacaagagcgagaaggtgcaggacctgctgctgctggacgtggcccccctgagcctgggcctggagaccgccggcggcgtgatgaccgccctgatcaagagaaacagcaccatccccaccaagcagacccagatcttcaccacctacagcgacaaccagcccggcgtgctgatccaggtgtacgagggcgagagagccatgaccaaggacaacaacctgctgggcagattcgacctgaccggcatcccccccgcccccagaggcgtgccccagatcgaggtgaccttcgacatcgacgccaacggcatcctgaacgtgaccgccaccgacaagagcaccggcaaggtgaacaagatcaccatcaccaacgacaagggcagactgagcaaggaggagatcgagagaatggtgctggacgccgagaagtacaaggccgaggacgtgtag

SEQ ID NO: 84184 - DNA, 1926 bp, Artificial Sequence; identical to SEQ ID NO: 84174
  Description of Artificial Sequence: Synthetic coding sequence

SEQ ID NO: 84185 - DNA, 699 bp, Artificial Sequence; identical to SEQ ID NO: 84177
  Description of Artificial Sequence: Synthetic coding sequence

SEQ ID NO: 84186 - DNA, 699 bp, Artificial Sequence; identical to SEQ ID NO: 84177
  Description of Artificial Sequence: Synthetic coding sequence

SEQ ID NO: 84187 - DNA, 1926 bp, Artificial Sequence; identical to SEQ ID NO: 84174
  Description of Artificial Sequence: Synthetic coding sequence

SEQ ID NO: 84188 - DNA, 1920 bp, Artificial Sequence
  Description of Artificial Sequence: Synthetic coding sequence
atgagcgccagaggccccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccatcttcgacgccaagagactgatcggcagaaagttcgaggacgccaccgtgcagagcgacatgaagcactggcccttcagagtggtgagcgagggcggcaagcccaaggtgcaggtggagtacaagggcgagaccaagaccttcttccccgaggagatcagcagcatggtgctgaccaagatgaaggagatcgccgaggcctacctgggcggcaaggtgcacagcgccgtgatcaccgtgcccgcctacttcaacgacagccagagacaggccaccaaggacgccggcaccatcaccggcctgaacgtgctgagaatcatcaacgagcccaccgccgccgccatcgcctacggcctggacaagaagggctgcgccggcggcgagaagaacgtgctgatcttcgacctgggcggcggcaccttcgacgtgagcatcctgaccatcgaggacggcatcttcgaggtgaagagcaccgccggcgacacccacctgggcggcgaggacttcgacaacagaatggtgagccacctggccgaggagttcaagagaaagcacaagaaggacatcggccccaacaagagagccgtgagaagactgagaaccgcctgcgagagagccaagagaaccctgagcagcagcacccaggccagcatcgagatcgacagcctgtacgagggcgtggacttctacaccagcatcaccagagccagattcgaggagctgaacgccgacctgttcagaggcaccctggagcccgtggagaaggccctgagagacgccaagctggacaagggccagatccaggagatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgatcggcgacaagagcgagaacgtgcaggacctgctgctgctggacgtgacccccctgagcctgggcatcgagaccgccggcggcgtgatgacccccctgatcaagagaaacaccaccatccccaccaagcagacccagaccttcaccacctacagcgacaaccagagcagcgtgctggtgcaggtgtacgagggcgagagagccatgaccaaggacaacaacctgctgggcaagttcgacctgaccggcatcccccccgcccccagaggcgtgccccagatcgaggtgaccttcgacatcgacgccaacggcatcctgaacgtgaccgccgccgacaagagcaccggcaaggagaacaagatcaccatcaccaacgacaagggcagactgagcaaggacgacatcgacagaatggtgcaggaggccgagagatacaagagcgaggacgaggccaacagagacagagtggccgccaagaacgccctggagagctacacctacaacatcaagcagaccgtggaggacgagaagctgagaggcaagatcagcgagcaggacaagaacaagatcctggacaagtgccaggaggtgatcaactggctggacagaaaccagatggccgagaaggacgagtacgagcacaagcagaaggagctggagagagtgtgcaaccccatcatcagcaagctgtaccagggcggccccggcggcggcagcggcggcggcggcagcggcgccagcggcggccccaccatcgaggaggtggactag

SEQ ID NO: 84189 - DNA, 1920 bp, Artificial Sequence; identical to SEQ ID NO: 84188
  Description of Artificial Sequence: Synthetic coding sequence

SEQ ID NO: 84190 - DNA, 1242 bp, Artificial Sequence
  Description of Artificial Sequence: Synthetic coding sequence
atgagcgccagaggccccgccatcggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccatcttcgacgccaagagactgatcggcagaaagttcgaggagctgaacgccgacctgttcagaggcaccctggagcccgtggagaaggccctgagagacgccaagctggacaagggccagatccaggagatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgatcggcgacaagagcgagaacgtgcaggacctgctgctgctggacgtgacccccctgagcctgggcatcgagaccgccggcggcgtgatgacccccctgatcaagagaaacaccaccatccccaccaagcagacccagaccttcaccacctacagcgacaaccagagcagcgtgctggtgcaggtgtacgagggcgagagagccatgaccaaggacaacaacctgctgggcaagttcgacctgaccggcatcccccccgcccccagaggcgtgccccagatcgaggtgaccttcgacatcgacgccaacggcatcctgaacgtgaccgccgccgacaagagcaccggcaaggagaacaagatcaccatcaccaacgacaagggcagactgagcaaggacgacatcgacagaatggtgcaggaggccgagagatacaagagcgaggacgaggccaacagagacagagtggccgccaagaacgccctggagagctacacctacaacatcaagcagaccgtggaggacgagaagctgagaggcaagatcagcgagcaggacaagaacaagatcctggacaagtgccaggaggtgatcaactggctggacagaaaccagatggccgagaaggacgagtacgagcacaagcagaaggagctggagagagtgtgcaaccccatcatcagcaagctgtaccagggcggccccggcggcggcagcggcggcggcggcagcggcgccagcggcggccccaccatcgaggaggtggactag

SEQ ID NO: 84191 - DNA, 2523 bp, Artificial Sequence
  Description of Artificial Sequence: Synthetic coding sequence
atgagcgtggtgggcatcgacctgggcttccagagctgctacgtggccgtggccagagccggcggcatcgagaccatcgccaacgagtacagcgacagatgcacccccgcctgcatcagcttcggccccaagaacagaagcatcggcgccgccgccaagagccaggtgatcagcaacgccaagaacaccgtgcagggcttcaagagattccacggcagagccttcagcgaccccttcgtggaggccgagaagagcaacctggcctacgacatcgtgcagctgcccaccggcctgaccggcatcaaggtgacctacatggaggaggagagaaacttcaccaccgagcaggtgaccgccatgctgctgagcaagctgaaggagaccgccgagagcgtgctgaagaagcccgtggtggactgcgtggtgagcgtgccctgcttctacaccgacgccgagagaagaagcgtgatggacgccacccagatcgccggcctgaactgcctgagactgatgaacgagaccaccgccgtggccctggcctacggcatctacaagcaggacctgcccgccctggaggagaagcccagaaacgtggtgttcgtggacatgggccacagcgcctaccaggtgagcgtgtgcgccttcaacagaggcaagctgaaggtgctggccaccgccttcgacaccaccctgggcggcagaaagttcgacgaggtgctggtgaaccacttctgcgaggagttcggcaagaagtacaagctggacatcaagagcaagatcagagccctgctgagactgagccaggagtgcgagaagctgaagaagctgatgagcgccaacgccagcgacctgcccctgagcatcgagtgcttcatgaacgacgtggacgtgagcggcaccatgaacagaggcaagttcctggagatgtgcaacgacctgctggccagagtggagccccccctgagaagcgtgctggagcagaccaagctgaagaaggaggacatctacgccgtggagatcgtgggcggcgccaccagaatccccgccgtgaaggagaagatcagcaagttcttcggcaaggagctgagcaccaccctgaacgccgacgaggccgtgaccagaggctgcgccctgcagtgcgccatcctgagccccgccttcaaggtgagagagttcagcatcaccgacgtggtgccctaccccatcagcctgagatggaacagccccgccgaggagggcagcagcgactgcgaggtgttcagcaagaaccacgccgcccccttcagcaaggtgctgaccttctacagaaaggagcccttcaccctggaggcctactacagcagcccccaggacctgccctaccccgaccccgccatcgcccagttcagcgtgcagaaggtgaccccccagagcgacggcagcagcagcaaggtgaaggtgaaggtgagagtgaacgtgcacggcatcttcagcgtgagcagcgccagcctggtggaggtgcacaagagcgaggagaacgaggagcccatggagaccgaccagaacgccaaggaggaggagaagatgcaggtggaccaggaggagccccacgtggaggagcagcagcagcagacccccgccgagaacaaggccgagagcgaggagatggagaccagccaggccggcagcaaggacaagaagatggaccagcccccccaggccaagaaggccaaggtgaagaccagcaccgtggacctgcccatcgagaaccagctgctgtggcagatcgacagagagatgctgaacctgtacatcgagaacgagggcaagatgatcatgcaggacaagctggagaaggagagaaacgacgccaagaacgccgtggaggagtacgtgtacgagatgagagacaagctgagcggcgagtacgagaagttcgtgagcgaggacgacagaaacagcttcaccctgaagctggaggacaccgagaactggctgtacgaggacggcgaggaccagcccaagcaggtgtacgtggacaagctggccgagctgaagaacctgggccagcccatcaagatcagattccaggagagcgaggagagacccaagctgttcgaggagctgggcaagcagatccagcagtacatgaagatcatcagcagcttcaagaacaaggaggaccagtacgaccacctggacgccgccgacatgaccaaggtggagaagagcaccaacgaggccatggagtggatgaacaacaagctgaacctgcagaacaagcagagcctgaccatggaccccgtggtgaagagcaaggagatcgaggccaagatcaaggagctgaccagcacctgcagccccatcatcagcaagcccaagcccaaggtggagccccccaaggaggagcagaagaacgccgagcagaacggccccgtggacggccagggcgacaaccccggcccccaggccgccgagcagggcaccgacaccgccgtgcccagcgacagcgacaagaagctgcccgagatggacatcgactag

SEQ ID NO: 84192 - DNA, 447 bp, Artificial Sequence
  Description of Artificial Sequence: Synthetic coding sequence
atgagcgtggtgggcatcgacctgggcttccagagctgctacgtggccgtggccagagccggcggcatcgagaccatcgccaacgagtacagcgacagatgcacccccgcctgcatcagcttcggccccaagaacagaagcatcggcgccgccgccaagagccaggtgatcagcaacgccaagaacaccgtgcagggcttcaagagattccacggcagagccttcagcgaccccttcgtggaggccgagaagagcaacctggcctacgacatcgtgcagctgcccaccggcctgaccggcatcaaggtgacctacatggaggaggagcagaacggccccgtggacggccagggcgacaaccccggcccccaggccgccgagcagggcaccgacaccgccgtgcccagcgacagcgacaagaagctgcccgagatggacatcgactag

SEQ ID NO: 84193 - DNA, 1422 bp, Artificial Sequence
  Description of Artificial Sequence: Synthetic coding sequence
atgagcgtggtgggcatcgacctgggcttccagagctgctacgtggccgtggccagagccggcggcatcgagaccatcgccaacgagtacagcgacagatgcacccccgcctgcatcagcttcggccccaagaacagaagcatcggcgccgccgccaagagccaggtgatcagcaacgccaagaacaccgtgcagggcttcaagagattccacggcagagccttcagcgaccccttcgtggaggccgagaagagcaacctggcctacgacatcgtgcagctgcccaccggcctgaccggcatcaaggtgacctacatggaggaggagagaaacttcaccaccgagcaggtgaccgccatgctgctgagcaagctgaaggagaccgccgagagcgtgctgaagaagcccgtggtggactgcgtggtgagcgtgccctgcttctacaccgacgccgagagaagaagcgtgatggacgccacccagatcgccggcctgaactgcctgagactgatgaacgagaccaccgccgtggccctggcctacggcatctacaagcaggacctgcccgccctggaggagaagcccagaaacgtggtgttcgtggacatgggccacagcgcctaccaggtgagcgtgtgcgccttcaacagaggcaagctgaaggtgctggccaccgccttcgacaccaccctgggcggcagaaagttcgacgaggtgctggtgaaccacttctgcgaggagttcggcaagaagtacaagctggacatcaagagcaagatcagagccctgctgagactgagccaggagtgcgagaagctgaagaagctgatgagcgccaacgccagcgacctgcccctgagcatcgagtgcttcatgaacgacgtggacgtgagcggcaccatgaacagaggcaagttcctggagatgtgcaacgacctgctggccagagtggagccccccctgagaagcgtgctggagcagaccaagctgaagaaggaggacatctacgccgtggagatcgtgggcggcgccaccagaatccccgccgtgaaggagaagatcagcaagttcttcggcaaggagctgagcaccaccctgaacgccgacgaggccgtgaccagaggctgcgccctgcagtgcgccatcctgagccccgccttcaaggtgagagagttcagcatcaccgacgtggtgccctaccccatcagcctgagatggaacagccccgccgaggagggcagcagcgactgcgaggtgttcagcaagaaccacgccgcccccttcagcaaggtgctgaccttctacagaaaggagcccttcaccctggaggcctactacagcagccccggcttcgccctgagcagaagctgctacagcatcatcaagagcctgctgagcctgatggcccccgtgcagaagtag

SEQ ID NO: 84194 - DNA, 1965 bp, Artificial Sequence
  Description of Artificial Sequence: Synthetic coding sequence
atgaagctgagcctggtggccgccatgctgctgctgctgagcgccgccagagccgaggaggaggacaagaaggaggacgtgggcaccgtggtgggcatcgacctgggcaccacctacagctgcgtgggcgtgttcaagaacggcagagtggagatcatcgccaacgaccagggcaacagaatcacccccagctacgtggccttcacccccgagggcgagagactgatcggcgacgccgccaagaaccagctgaccagcaaccccgagaacaccgtgttcgacgccaagagactgatcggcagaacctggaacgaccccagcgtgcagcaggacatcaagttcctgcccttcaaggtggtggagaagaagaccaagccctacatccaggtggacatcggcggcggccagaccaagaccttcgcccccgaggagatcagcgccatggtgctgaccaagatgaaggagaccgccgaggcctacctgggcaagaaggtgacccacgccgtggtgaccgtgcccgcctacttcaacgacgcccagagacaggccaccaaggacgccggcaccatcgccggcctgaacgtgatgagaatcatcaacgagcccaccgccgccgccatcgcctacggcctggacaagagagagggcgagaagaacatcctggtgttcgacctgggcggcggcaccttcgacgtgagcctgctgaccatcgacaacggcgtgttcgaggtggtggccaccaacggcgacacccacctgggcggcgaggacttcgaccagagagtgatggagcacttcatcaagctgtacaagaagaagaccggcaaggacgtgagaaaggacaacagagccgtgcagaagctgagaagagaggtggagaaggccaagagagccctgagcagccagcaccaggccagaatcgagatcgagagcttctacgagggcgaggacttcagcgagaccctgaccagagccaagttcgaggagctgaacatggacctgttcagaagcaccatgaagcccgtgcagaaggtgctggaggacagcgacctgaagaagagcgacatcgacgagatcgtgctggtgggcggcagcaccagaatccccaagatccagcagctggtgaaggagttcttcaacggcaaggagcccagcagaggcatcaaccccgacgaggccgtggcctacggcgccgccgtgcaggccggcgtgctgagcggcgaccaggacaccggcgacctggtgctgctggacgtgtgccccctgaccctgggcatcgagaccgtgggcggcgtgatgaccaagctgatccccagaaacaccgtggtgcccaccaagaagagccagatcttcagcaccgccagcgacaaccagcccaccgtgaccatcaaggtgtacgagggcgagagacccctgaccaaggacaaccacctgctgggcaccttcgacctgaccggcatcccccccgcccccagaggcgtgccccagatcgaggtgaccttcgagatcgacgtgaacggcatcctgagagtgaccgccgaggacaagggcaccggcaacaagaacaagatcaccatcaccaacgaccagaacagactgacccccgaggagatcgagagaatggtgaacgacgccgagaagttcgccgaggaggacaagaagctgaaggagagaatcgacaccagaaacgagctggagagctacgcctacagcctgaagaaccagatcggcgacaaggagaagctgggcggcaagctgagcagcgaggacaaggagaccatggagaaggccgtggaggagaagatcgagtggctggagagccaccaggacgccgacatcgaggacttcaaggccaagaagaaggagctggaggagatcgtgcagcccatcatcagcaagctgtacggcagcgccggccccccccccaccggcgaggaggacaccgccgagaaggacgagctgtag

SEQ ID NO: 84195 - DNA, 837 bp, Artificial Sequence
  Description of Artificial Sequence: Synthetic coding sequence
atgaagctgagcctggtggccgccatgctgctgctgctgagcgccgccagagccgaggaggaggacaagaaggaggacgtgggcaccgtggtgggcatcgacctgggcaccacctacagctgcgtgggcgtgttcaagaacggcagagtggagatcatcgccaacgaccagggcaacagaatcacccccagctacgtggccttcacccccgagggcgagagactgatcggcgacgccgccaagaaccagctgaccagcaaccccgagaacaccgtgttcgacgccaagagactgatcggcagaacctggaacgaccccagcgtgcagcaggacatcaagttcctgcccttcaaggtggtggagaagaagaccaagccctacatccaggtggacatcggcggcggccagaccaagaccttcgcccccgaggagatcagcgccatggtgctgaccaagatgaaggagaccgccgaggcctacctgggcaagaaggtgacccacgccgtggtgaccgtgcccgcctacttcaacgacgcccagagacaggccaccaaggacgccggcaccatcgccggcctgaacgtgatgagaatcatcaacgagcccaccgccgccgccatcgcctacggcctggacaagagagagggcgagaagaacatcctggtgttcgacctgggcggcggcaccttcgacgtgagcctgctgaccatcgacaacggcgtgttcgaggtggtggccaccaacggcgacacccacctgggcggcgaggacttcgaccagagagtgatggagcacttcatcaagctgtacaagaagaagaccttcctgagaccctag

SEQ ID NO: 84196 - DNA, 1932 bp, Artificial Sequence
  Description of Artificial Sequence: Synthetic coding sequence
atgcaggcccccagagagctggccgtgggcatcgacctgggcaccacctacagctgcgtgggcgtgttccagcagggcagagtggagatcctggccaacgaccagggcaacagaaccacccccagctacgtggccttcaccgacaccgagagactggtgggcgacgccgccaagagccaggccgccctgaacccccacaacaccgtgttcgacgccaagagactgatcggcagaaagttcgccgacaccaccgtgcagagcgacatgaagcactggcccttcagagtggtgagcgagggcggcaagcccaaggtgagagtgtgctacagaggcgaggacaagaccttctaccccgaggagatcagcagcatggtgctgagcaagatgaaggagaccgccgaggcctacctgggccagcccgtgaagcacgccgtgatcaccgtgcccgcctacttcaacgacagccagagacaggccaccaaggacgccggcgccatcgccggcctgaacgtgctgagaatcatcaacgagcccaccgccgccgccatcgcctacggcctggacagaagaggcgccggcgagagaaacgtgctgatcttcgacctgggcggcggcaccttcgacgtgagcgtgctgagcatcgacgccggcgtgttcgaggtgaaggccaccgccggcgacacccacctgggcggcgaggacttcgacaacagactggtgaaccacttcatggaggagttcagaagaaagcacggcaaggacctgagcggcaacaagagagccctgagaagactgagaaccgcctgcgagagagccaagagaaccctgagcagcagcacccaggccaccctggagatcgacagcctgttcgagggcgtggacttctacaccagcatcaccagagccagattcgaggagctgtgcagcgacctgttcagaagcaccctggagcccgtggagaaggccctgagagacgccaagctggacaaggcccagatccacgacgtggtgctggtgggcggcagcaccagaatccccaaggtgcagaagctgctgcaggacttcttcaacggcaaggagctgaacaagagcatcaaccccgacgaggccgtggcctacggcgccgccgtgcaggccgccgtgctgatgggcgacaagtgcgagaaggtgcaggacctgctgctgctggacgtggcccccctgagcctgggcctggagaccgccggcggcgtgatgaccaccctgatccagagaaacgccaccatccccaccaagcagacccagaccttcaccacctacagcgacaaccagcccggcgtgttcatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgagcgtgaccgccaccgacagaagcaccggcaaggccaacaagatcaccatcaccaacgacaagggcagactgagcaaggaggaggtggagagaatggtgcacgaggccgagcagtacaaggccgaggacgaggcccagagagacagagtggccgccaagaacagcctggaggcccacgtgttccacgtgaagggcagcctgcaggaggagagcctgagagacaagatccccgaggaggacagaagaaagatgcaggacaagtgcagagaggtgctggcctggctggagcacaaccagctggccgagaaggaggagtacgagcaccagaagagagagctggagcagatctgcagacccatcttcagcagactgtacggcggccccggcgtgcccggcggcagcagctgcggcacccaggccagacagggcgaccccagcaccggccccatcatcgaggaggtggactag

SEQ ID NO: 84197 - DNA, 1860 bp, Artificial Sequence
  Description of Artificial Sequence: Synthetic coding sequence
atgcaggcccccagagagctggccgtgggcatcgacctgggcaccacctacagctgcgtggccttcaccgacaccgagagactggtgggcgacgccgccaagagccaggccgccctgaacccccacaacaccgtgttcgacgccaagagactgatcggcagaaagttcgccgacaccaccgtgcagagcgacatgaagcactggcccttcagagtggtgagcgagggcggcaagcccaaggtgagagtgtgctacagaggcgaggacaagaccttctaccccgaggagatcagcagcatggtgctgagcaagatgaaggagaccgccgaggcctacctgggccagcccgtgaagcacgccgtgatcaccgtgcccgcctacttcaacgacagccagagacaggccaccaaggacgccggcgccatcgccggcctgaacgtgctgagaatcatcaacgagcccaccgccgccgccatcgcctacggcctggacagaagaggcgccggcgagagaaacgtgctgatcttcgacctgggcggcggcaccttcgacgtgagcgtgctgagcatcgacgccggcgtgttcgaggtgaaggccaccgccggcgacacccacctgggcggcgaggacttcgacaacagactggtgaaccacttcatggaggagttcagaagaaagcacggcaaggacctgagcggcaacaagagagccctgagaagactgagaaccgcctgcgagagagccaagagaaccctgagcagcagcacccaggccaccctggagatcgacagcctgttcgagggcgtggacttctacaccagcatcaccagagccagattcgaggagctgtgcagcgacctgttcagaagcaccctggagcccgtggagaaggccctgagagacgccaagctggacaaggcccagatccacgacgtggtgctggtgggcggcagcaccagaatccccaaggtgcagaagctgctgcaggacttcttcaacggcaaggagctgaacaagagcatcaaccccgacgaggccgtggcctacggcgccgccgtgcaggccgccgtgctgatgggcgacaagtgcgagaaggtgcaggacctgctgctgctggacgtggcccccctgagcctgggcctggagaccgccggcggcgtgatgaccaccctgatccagagaaacgccaccatccccaccaagcagacccagaccttcaccacctacagcgacaaccagcccggcgtgttcatccaggtgtacgagggcgagagagccatgaccaaggacaacaacctgctgggcagattcgagctgagcggcatcccccccgcccccagaggcgtgccccagatcgaggtgaccttcgacatcgacgccaacggcatcctgagcgtgaccgccaccgacagaagcaccggcaaggccaacaagatcaccatcaccaacgacaagggcagactgagcaaggaggaggtggagagaatggtgcacgaggccgagcagtacaaggccgaggacgaggcccagagagacagagtggccgccaagaacagcctggaggcccacgtgttccacgtgaagggcagcctgcaggaggagagcctgagagacaagatccccgaggaggacagaagaaagatgcaggacaagtgcagagaggtgctggcctggctggagcacaaccagctggccgagaaggaggagtacgagcaccagaagagagagctggagcagatctgcagacccatcttcagcagactgtacggcggccccggcgtgcccggcggcagcagctgcggcacccaggccagacagggcgaccccagcaccggccccatcatcgaggaggtggactag

SEQ ID NO: 84198 - DNA, 2337 bp, Artificial Sequence
  Description of Artificial Sequence: Synthetic coding sequence
atgagcaagagaaagctgatccccaagctgagcatccagagccccgtgctgcacaccaacctgaacgtgcagagcacccacccccccctgaagaaggaggacctgcacagaatcagcaaggacagcctggagagcgacagcgagagcctgacccaggagatcatgtgccacagcgagttcgacgacagaatcagaggcaacggcatggagcccgacagcctggacgaggaggagagccccagatggggcagcctgcacgagatggaggaggaggccagcggcaaggccgcccagatggccagagagcagaaccaccacacctgggaccagggcgccaacaacagacagcagcccatcgaggacaagtacagcgacctgagatacgaccccaactggaagagcaagaaggaggagggccagctgctgagcgtggaggccctgcccgagagcaccgacagcagcctggagaacctgcccctggcccccctgtaccccagccaggagaccagcatggagctgagcggcggcaagggcgagcagaaggagagcccccagagcgccgccagcctgctgggcagcgagttcctgagccccaactacgagcacggcgccagaagaagcaagcccttcagcgagctgagcgacagcgacctggaggagaagagcagcagcctgagcccctacgtgaagagcagcagcagccacaacgaggtgttcctgcccggcagcagaggccccagaagaagaaagagcaagcagcacttcgtggagaagaacaagctgaccctgggcctgcccacccccaagaccgacagctacctgcagctgcacaacaagaagagaggcgagagccaccccgagcagatcagctaccccgtgagagtgaccgacaagaccagcatccagaacgccaaggagatggagaacgccgccatcgaccccgaggacaagtggcaccagagagcccagcagctgaagaactaccaggagcactggagccagtacgagagcaccaagagcagcaacgtgcccagaggccagcccagcgacatggtgaacgaccaccagcccagcagaagacccgccaagctgaagatcagaaagcagtgcaagcaccagaacggcctgaagagcagcaccaccgaggaggtgaccgccagccagggcaaccagaacaacccccccagacagcagcagaaccagaacaagcccctggacaccagcaccaagcccgagagcatcgtgatcatgcacgccagcaacaacgacgtgcaggccagcagagccctgagaagccacaacctgaaggagaccagcaacaccttcgccccccccaagcaggccttcgacaaggtgctgagcaagaacagcaccggctgcgacagcggcctgaacgtgaacaaggagagaggccacaaggaccaggaggagaagagattcagctaccagcagctgcacaccctgagcgacatggacctgaacaacctgaacgagctgagcaagagacacgtgctgctgagccagaagggcagccagttcgtgtaccacatcaacacccacggcagcaccaagaacaagaagcagctgaagcagccctacaccgagaccaagtacagaaacctggagatgctgtggaagttccacagcagcagcgacagccagaccgtgagagccagccccgacagctggctgacccagatcatggagcagcaccagcaggccctggtgcagctgaccgacgtgcagcccagcgagggcgccctgagcagcgtgaccctgccccccatcctgagcagagtggagagcgagagccagctgagcagcgagagaagccagagaaaccaggtgaagatcagcagaagcaacagcgagggctacctgttccagctggagaagggcaagaagcacaagaagagaagcagcagcaagaacaccaagctgaagggctaccagaagagagacgtgaagctgggcggcctgggccccgacttcgagagcatcagagacaagacccagaagctgatccagcagaaggagtacgccaagcaggtgaaggagtacaacatgaagaccctgagcatcctgagcaagccccagaccgagaagacccagaagaagagcgccatccccagacagaaggccctggagtacgccaagaccatccccaagcccaagcccagcaacctgacccaccaggccagcaaggagcagaagaaccccacctacgccggcaaggaggagagcctgcccgagatcagcctgctggagatcctgcagaacagacacgagagagagaagcaggccgtggccgccttcaaggtgctgcacatcgtgtag

SEQ ID NO: 84199 - DNA, 1482 bp, Artificial Sequence
  Description of Artificial Sequence: Synthetic coding sequence
atgagcaagggccccgccgtgggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccgtgttcgacgccaagagactgatcggcagaagattcgacgacgccgtggtgcagagcgacatgaagcactggcccttcatggtggtgaacgacgccggcagacccaaggtgcaggtggagtacaagggcgagaccaagagcttctaccccgaggaggtgagcagcatggtgctgaccaagatgaaggagatcgccgaggcctacctgggcaagaccgtgaccaacgccgtggtgaccgtgcccgcctacttcaacgacagccagagacaggccaccaaggacgccggcaccatcgccggcctgaacgtgctgagaatcatcaacgagcccaccgccgccgccatcgcctacggcctggacaagaaggtgggcgccgagagaaacgtgctgatcttcgacctgggcggcggcaccttcgacgtgagcatcctgaccatcgaggacggcatcttcgaggtgaagagcaccgccggcgacacccacctgggcggcgaggacttcgacaacagaatggtgaaccacttcatcgccgagttcaagagaaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatgcccggcggcatgcccggcggcttccccggcggcggcgccccccccagcggcggcgccagcagcggccccaccatcgaggaggtggactag

SEQ ID NO: 84200 - DNA, 1884 bp, Artificial Sequence
  Description of Artificial Sequence: Synthetic coding sequence
atgagcaagggccccgccgtgggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccgtgttcgacgccaagagactgatcggcagaagattcgacgacgccgtggtgcagagcgacatgaagcactggcccttcatggtggtgaacgacgccggcagacccaaggtgcaggtggagtacaagggcgagaccaagagcttctaccccgaggaggtgagcagcatggtgctgaccaagatgaaggagatcgccgaggcctacctgggcaaggccaccaaggacgccggcaccatcgccggcctgaacgtgctgagaatcatcaacgagcccaccgccgccgccatcgcctacggcctggacaagaaggtgggcgccgagagaaacgtgctgatcttcgacctgggcggcggcaccttcgacgtgagcatcctgaccatcgaggacggcatcttcgaggtgaagagcaccgccggcgacacccacctgggcggcgaggacttcgacaacagaatggtgaaccacttcatcgccgagttcaagagaaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatcccccccgcccccagaggcgtgccccagatcgaggtgaccttcgacatcgacgccaacggcatcctgaacgtgagcgccgtggacaagagcaccggcaaggagaacaagatcaccatcaccaacgacaagggcagactgagcaaggaggacatcgagagaatggtgcaggaggccgagaagtacaaggccgaggacgagaagcagagagacaaggtgagcagcaagaacagcctggagagctacgccttcaacatgaaggccaccgtggaggacgagaagctgcagggcaagatcaacgacgaggacaagcagaagatcctggacaagtgcaacgagatcatcaactggctggacaagaaccagaccgccgagaaggaggagttcgagcaccagcagaaggagctggagaaggtgtgcaaccccatcatcaccaagctgtaccagagcgccggcggcatgcccggcggcatgcccggcggcttccccggcggcggcgccccccccagcggcggcgccagcagcggccccaccatcgaggaggtggactag

SEQ ID NO: 84201 - DNA, 1941 bp, Artificial Sequence
  Description of Artificial Sequence: Synthetic coding sequence
atgagcaagggccccgccgtgggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccgtgttcgacgccaagagactgatcggcagaagattcgacgacgccgtggtgcagagcgacatgaagcactggcccttcatggtggtgaacgacgccggcagacccaaggtgcaggtggagtacaagggcgagaccaagagcttctaccccgaggaggtgagcagcatggtgctgaccaagatgaaggagatcgccgaggcctacctgggcaagaccgtgaccaacgccgtggtgaccgtgcccgcctacttcaacgacagccagagacaggccaccaaggacgccggcaccatcgccggcctgaacgtgctgagaatcatcaacgagcccaccgccgccgccatcgcctacggcctggacaagaaggtgggcgccgagagaaacgtgctgatcttcgacctgggcggcggcaccttcgacgtgagcatcctgaccatcgaggacggcatcttcgaggtgaagagcaccgccggcgacacccacctgggcggcgaggacttcgacaacagaatggtgaaccacttcatcgccgagttcaagagaaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatcccccccgcccccagaggcgtgccccagatcgaggtgaccttcgacatcgacgccaacggcatcctgaacgtgagcgccgtggacaagagcaccggcaaggagaacaagatcaccatcaccaacgacaagggcagactgagcaaggaggacatcgagagaatggtgcaggaggccgagaagtacaaggccgaggacgagaagcagagagacaaggtgagcagcaagaacagcctggagagctacgccttcaacatgaaggccaccgtggaggacgagaagctgcagggcaagatcaacgacgaggacaagcagaagatcctggacaagtgcaacgagatcatcaactggctggacaagaaccagaccgccgagaaggaggagttcgagcaccagcagaaggagctggagaaggtgtgcaaccccatcatcaccaagctgtaccagagcgccggcggcatgcccggcggcatgcccggcggcttccccggcggcggcgccccccccagcggcggcgccagcagcggccccaccatcgaggaggtggactag

SEQ ID NO: 84202 - DNA, 1503 bp, Artificial Sequence
  Description of Artificial Sequence: Synthetic coding sequence
atgagcaagggccccgccgtgggcatcgacctgggcaccacctacagctgcgtgggcgtgttccagcacggcaaggtggagatcatcgccaacgaccagggcaacagaaccacccccagctacgtggccttcaccgacaccgagagactgatcggcgacgccgccaagaaccaggtggccatgaaccccaccaacaccgtgttcgacgccaagagactgatcggcagaagattcgacgacgccgtggtgcagagcgacatgaagcactggcccttcatggtggtgaacgacgccggcagacccaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatcccccccgcccccagaggcgtgccccagatcgaggtgaccttcgacatcgacgccaacggcatcctgaacgtgagcgccgtggacaagagcaccggcaaggagaacaagatcaccatcaccaacgacaagggcagactgagcaaggaggacatcgagagaatggtgcaggaggccgagaagtacaaggccgaggacgagaagcagagagacaaggtgagcagcaagaacagcctggagagctacgccttcaacatgaaggccaccgtggaggacgagaagctgcagggcaagatcaacgacgaggacaagcagaagatcctggacaagtgcaacgagatcatcaactggctggacaagaaccagaccgccgagaaggaggagttcgagcaccagcagaaggagctggagaaggtgtgcaaccccatcatcaccaagctgtaccagagcgccggcggcatgcccggcggcatgcccggcggcttccccggcggcggcgccccccccagcggcggcgccagcagcggccccaccatcgaggaggtggactag

SEQ ID NO: 84203 - DNA, 1233 bp, Artificial Sequence
  Description of Artificial Sequence: Synthetic coding sequence
atggtgaaccacttcatcgccgagttcaagagaaagcacaagaaggacatcagcgagaacaagagagccgtgagaagactgagaaccgcctgcgagagagccaagagaaccctgagcagcagcacccaggccagcatcgagatcgacagcctgtacgagggcatcgacttctacaccagcatcaccagagccagattcgaggagctgaacgccgacctgttcagaggcaccctggaccccgtggagaaggccctgagagacgccaagctggacaagagccagatccacgacatcgtgctggtgggcggcagcaccagaatccccaagatccagaagctgctgcaggacttcttcaacggcaaggagctgaacaagagcatcaaccccgacgaggccgtggcctacggcgccgccgtgcaggccgccatcctgagcggcgacaagagcgagaacgtgcaggacctgctgctgctggacgtgacccccctgagcctgggcatcgagaccgccggcggcgtgatgaccgtgctgatcaagagaaacaccaccatccccaccaagcagacccagaccttcaccacctacagcgacaaccagcccggcgtgctgatccaggtgtacgagggcgagagagccatgaccaaggacaacaacctgctgggcaagttcgagctgaccggcatcccccccgcccccagaggcgtgccccagatcgaggtgaccttcgacatcgacgccaacggcatcctgaacgtgagcgccgtggacaagagcaccggcaaggagaacaagatcaccatcaccaacgacaagggcagactgagcaaggaggacatcgagagaatggtgcaggaggccgagaagtacaaggccgaggacgagaagcagagagacaaggtgagcagcaagaacagcctggagagctacgccttcaacatgaaggccaccgtggaggacgagaagctgcagggcaagatcaacgacgaggacaagcagaagatcctggacaagtgcaacgagatcatcaactggctggacaagaaccagaccgccgagaaggaggagttcgagcaccagcagaaggagctggagaaggtgtgcaaccccatcatcaccaagctgtaccagagcgccggcggcatgcccggcggcatgcccggcggcttccccggcggcggcgccccccccagcggcggcgccagcagcggccccaccatcgaggaggtggactag

SEQ ID NO: 84204 - DNA, 1941 bp, Artificial Sequence; identical to SEQ ID NO: 84201
  Description of Artificial Sequence: Synthetic coding sequence

SEQ ID NO: 84205 - DNA, 2040 bp, Artificial Sequence
  Description of Artificial Sequence: Synthetic coding sequence
atgatcagcgccagcagagccgccgccgccagactggtgggcgccgccgccagcagaggccccaccgccgccagacaccaggacagctggaacggcctgagccacgaggccttcagactggtgagcagaagagactacgccagcgaggccatcaagggcgccgtggtgggcatcgacctgggcaccaccaacagctgcgtggccgtgatggagggcaagcaggccaaggtgctggagaacgccgagggcgccagaaccacccccagcgtggtggccttcaccgccgacggcgagagactggtgggcatgcccgccaagagacaggccgtgaccaaccccaacaacaccttctacgccaccaagagactgatcggcagaagatacgacgaccccgaggtgcagaaggacatcaagaacgtgcccttcaagatcgtgagagccagcaacggcgacgcctgggtggaggcccacggcaagctgtacagccccagccagatcggcgccttcgtgctgatgaagatgaaggagaccgccgagaactacctgggccacaccgccaagaacgccgtgatcaccgtgcccgcctacttcaacgacagccagagacaggccaccaaggacgccggccagatcagcggcctgaacgtgctgagagtgatcaacgagcccaccgccgccgccctggcctacggcctggacaagagcgaggacaaggtgatcgccgtgtacgacctgggcggcggcaccttcgacatcagcatcctggagatccagaagggcgtgttcgaggtgaagagcaccaacggcgacaccttcctgggcggcgaggacttcgaccaggccctgctgagacacatcgtgaaggagttcaagagagagaccggcgtggacctgaccaaggacaacatggccctgcagagagtgagagaggccgccgagaaggccaagtgcgagctgagcagcagcgtgcagaccgacatcaacctgccctacctgaccatggacagcagcggccccaagcacctgaacatgaagctgaccagagcccagttcgagggcatcgtgaccgacctgatcagaagaaccatcgccccctgccagaaggccatgcaggacgccgaggtgagcaagagcgacatcggcgaggtgatcctggtgggcggcatgaccagaatgcccaaggtgcagcagaccgtgcaggacctgttcggcagagcccccagcaaggccgtgaaccccgacgaggccgtggccatcggcgccgccatccagggcggcgtgctggccggcgacgtgaccgacgtgctgctgctggacgtgacccccctgagcctgggcatcgagaccctgggcggcgtgttcaccaagctgatcaacagaaacaccaccatccccaccaagaagagccaggtgttcagcaccgccgccgacggccagacccaggtggagatcaaggtgtgccagggcgagagagagatggccggcgacaacaagctgctgggccagttcaccctgatcggcatcccccccgcccccagaggcgtgccccagatcgaggtgaccttcgacatcgacgccaacggcatcgtgcacgtgagcgccaaggacaagggcaccggcagagagcagcagatcgtgatccagagcagcggcggcctgagcaaggacgacatcgagaacatggtgaagaacgccgagaagtacgccgaggaggacagaagaaagaaggagagagtggaggccgtgaacatggccgagggcatcatccacgacaccgagaccaagatggaggagttcaaggaccagctgcccgccgacgagtgcaacaagctgaaggaggagatcagcaagatgagagagctgctggccagaaaggacagcgagaccggcgagaacatcagacaggccgccagcagcctgcagcaggccagcctgaagctgttcgagatggcctacaagaagatggccagcgagagagagggcagcggcagcagcggcaccggcgagcagaaggaggaccagaaggaggagaagcagtag

SEQ ID NO: 84206 - DNA, 1998 bp, Artificial Sequence
  Description of Artificial Sequence: Synthetic coding sequence
atgatcagcgccagcagagccgccgccgccagacaccaggacagctggaacggcctgagccacgaggccttcagactggtgagcagaagagactacgccagcgaggccatcaagggcgccgtggtgggcatcgacctgggcaccaccaacagctgcgtggccgtgatggagggcaagcaggccaaggtgctggagaacgccgagggcgccagaaccacccccagcgtggtggccttcaccgccgacggcgagagactggtgggcatgcccgccaagagacaggccgtgaccaaccccaacaacaccttctacgccaccaagagactgatcggcagaagatacgacgaccccgaggtgcagaaggacatcaagaacgtgcccttcaagatcgtgagagccagcaacggcgacgcctgggtggaggcccacggcaagctgtacagccccagccagatcggcgccttcgtgctgatgaagatgaaggagaccgccgagaactacctgggccacaccgccaagaacgccgtgatcaccgtgcccgcctacttcaacgacagccagagacaggccaccaaggacgccggccagatcagcggcctgaacgtgctgagagtgatcaacgagcccaccgccgccgccctggcctacggcctggacaagagcgaggacaaggtgatcgccgtgtacgacctgggcggcggcaccttcgacatcagcatcctggagatccagaagggcgtgttcgaggtgaagagcaccaacggcgacaccttcctgggcggcgaggacttcgaccaggccctgctgagacacatcgtgaaggagttcaagagagagaccggcgtggacctgaccaaggacaacatggccctgcagagagtgagagaggccgccgagaaggccaagtgcgagctgagcagcagcgtgcagaccgacatcaacctgccctacctgaccatggacagcagcggccccaagcacctgaacatgaagctgaccagagcccagttcgagggcatcgtgaccgacctgatcagaagaaccatcgccccctgccagaaggccatgcaggacgccgaggtgagcaagagcgacatcggcgaggtgatcctggtgggcggcatgaccagaatgcccaaggtgcagcagaccgtgcaggacctgttcggcagagcccccagcaaggccgtgaaccccgacgaggccgtggccatcggcgccgccatccagggcggcgtgctggccggcgacgtgaccgacgtgctgctgctggacgtgacccccctgagcctgggcatcgagaccctgggcggcgtgttcaccaagctgatcaacagaaacaccaccatccccaccaagaagagccaggtgttcagcaccgccgccgacggccagacccaggtggagatcaaggtgtgccagggcgagagagagatggccggcgacaacaagctgctgggccagttcaccctgatcggcatcccccccgcccccagaggcgtgccccagatcgaggtgaccttcgacatcgacgccaacggcatcgtgcacgtgagcgccaaggacaagggcaccggcagagagcagcagatcgtgatccagagcagcggcggcctgagcaaggacgacatcgagaacatggtgaagaacgccgagaagtacgccgaggaggacagaagaaagaaggagagagtggaggccgtgaacatggccgagggcatcatccacgacaccgagaccaagatggaggagttcaaggaccagctgcccgccgacgagtgcaacaagctgaaggaggagatcagcaagatgagagagctgctggccagaaaggacagcgagaccggcgagaacatcagacaggccgccagcagcctgcagcaggccagcctgaagctgttcgagatggcctacaagaagatggccagcgagagagagggcagcggcagcagcggcaccggcgagcagaaggaggaccagaaggaggagaagcagtag

SEQ ID NO: 84207 - DNA, 1899 bp, Artificial Sequence
  Description of Artificial Sequence: Synthetic coding sequence
atggccctggtgatgagactgctggacctgttccagggcggcatcatgcaccagaagcagagcagagagcagctgctggtgctgatctgggtgctgcccacccccgcctggcagctgtggaaggtgaacaagcagagatgctggagaatgcccaaggtgcccgagccccccctgcagctgtggcccctgcagcagatggtgagcgacctgctggagtgcagacccagcgacagactgagccccacccagaccatccacttcatgctgcccagcgtgagcctggccggcgacatgatgatcctgaagtacagaaagaccctgaagatgttccccctgaagctgagcgtgccccccatggtgatgcccgtgctgatgaagatgaaggagaccgccgagaactacctgggccacaccgccaagaacgccgtgatcaccgtgcccgcctacttcaacgacagccagagacaggccaccaaggacgccggccagatcagcggcctgaacgtgctgagagtgatcaacgagcccaccgccgccgccctggcctacggcctggacaagagcgaggacaaggtgatcgccgtgtacgacctgggcggcggcaccttcgacatcagcatcctggagatccagaagggcgtgttcgaggtgaagagcaccaacggcgacaccttcctgggcggcgaggacttcgaccaggccctgctgagacacatcgtgaaggagttcaagagagagaccggcgtggacctgaccaaggacaacatggccctgcagagagtgagagaggccgccgagaaggccaagtgcgagctgagcagcagcgtgcagaccgacatcaacctgccctacctgaccatggacagcagcggccccaagcacctgaacatgaagctgaccagagcccagttcgagggcatcgtgaccgacctgatcagaagaaccatcgccccctgccagaaggccatgcaggacgccgaggtgagcaagagcgacatcggcgaggtgatcctggtgggcggcatgaccagaatgcccaaggtgcagcagaccgtgcaggacctgttcggcagagcccccagcaaggccgtgaaccccgacgaggccgtggccatcggcgccgccatccagggcggcgtgctggccggcgacgtgaccgacgtgctgctgctggacgtgacccccctgagcctgggcatcgagaccctgggcggcgtgttcaccaagctgatcaacagaaacaccaccatccccaccaagaagagccaggtgttcagcaccgccgccgacggccagacccaggtggagatcaaggtgtgccagggcgagagagagatggccggcgacaacaagctgctgggccagttcaccctgatcggcatcccccccgcccccagaggcgtgccccagatcgaggtgaccttcgacatcgacgccaacggcatcgtgcacgtgagcgccaaggacaagggcaccggcagagagcagcagatcgtgatccagagcagcggcggcctgagcaaggacgacatcgagaacatggtgaagaacgccgagaagtacgccgaggaggacagaagaaagaaggagagagtggaggccgtgaacatggccgagggcatcatccacgacaccgagaccaagatggaggagttcaaggaccagctgcccgccgacgagtgcaacaagctgaaggaggagatcagcaagatgagagagctgctggccagaaaggacagcgagaccggcgagaacatcagacaggccgccagcagcctgcagcaggccagcctgaagctgttcgagatggcctacaagaagatggccagcgagagagagggcagcggcagcagcggcaccggcgagcagaaggaggaccagaaggaggagaagcagtag

SEQ ID NO: 84208 - DNA, 2175 bp, Artificial Sequence
  Description of Artificial Sequence: Synthetic coding sequence
atgcccgaggaggtgcaccacggcgaggaggaggtggagaccttcgccttccaggccgagatcgcccagctgatgagcctgatcatcaacaccttctacagcaacaaggagatcttcctgagagagctgatcagcaacgccagcgacgccctggacaagatcagatacgagagcctgaccgaccccagcaagctggacagcggcaaggagctgaagatcgacatcatccccaacccccaggagagaaccctgaccctggtggacaccggcatcggcatgaccaaggccgacctgatcaacaacctgggcaccatcgccaagagcggcaccaaggccttcatggaggccctgcaggccggcgccgacatcagcatgatcggccagttcggcgtgggcttctacagcgcctacctggtggccgagaaggtggtggtgatcaccaagcacaacgacgacgagcagtacgcctgggagagcagcgccggcggcagcttcaccgtgagagccgaccacggcgagcccatcggcagaggcaccaaggtgatcctgcacctgaaggaggaccagaccgagtacctggaggagagaagagtgaaggaggtggtgaagaagcacagccagttcatcggctaccccatcaccctgtacctggagaaggagagagagaaggagatcagcgacgacgaggccgaggaggagaagggcgagaaggaggaggaggacaaggacgacgaggagaagcccaagatcgaggacgtgggcagcgacgaggaggacgacagcggcaaggacaagaagaagaagaccaagaagatcaaggagaagtacatcgaccaggaggagctgaacaagaccaagcccatctggaccagaaaccccgacgacatcacccaggaggagtacggcgagttctacaagagcctgaccaacgactgggaggaccacctggccgtgaagcacttcagcgtggagggccagctggagttcagagccctgctgttcatccccagaagagcccccttcgacctgttcgagaacaagaagaagaagaacaacatcaagctgtacgtgagaagagtgttcatcatggacagctgcgacgagctgatccccgagtacctgaacttcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcgagagcaaggagcaggtggccaacagcgccttcgtggagagagtgagaaagagaggcttcgaggtggtgtacatgaccgagcccatcgacgagtactgcgtgcagcagctgaaggagttcgacggcaagagcctggtgagcgtgaccaaggagggcctggagctgcccgaggacgaggaggagaagaagaagatggaggagagcaaggccaagttcgagaacctgtgcaagctgatgaaggagatcctggacaagaaggtggagaaggtgaccatcagcaacagactggtgagcagcccctgctgcatcgtgaccagcacctacggctggaccgccaacatggagagaatcatgaaggcccaggccctgagagacaacagcaccatgggctacatgatggccaagaagcacctggagatcaaccccgaccaccccatcgtggagaccctgagacagaaggccgaggccgacaagaacgacaaggccgtgaaggacctggtggtgctgctgttcgagaccgccctgctgagcagcggcttcagcctggaggacccccagacccacagcaacagaatctacagaatgatcaagctgggcctgggcatcgacgaggacgaggtggccgccgaggagcccaacgccgccgtgcccgacgagatcccccccctggagggcgacgaggacgccagcagaatggaggaggtggactag

SEQ ID NO: 84209 - DNA, 2175 bp, Artificial Sequence; identical to SEQ ID NO: 84208
  Description of Artificial Sequence: Synthetic coding sequence

SEQ ID NO: 84210 - DNA, 465 bp, Artificial Sequence
  Description of Artificial Sequence: Synthetic coding sequence
atggacagctgcgacgagctgatccccgagtacctgaacttcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcgagagcaaggagcaggtgtgcccctgccccacctggctgcccctgctggtgagcagcgtgttcttccccctgctgagcctgtgctag

SEQ ID NO: 84211 - DNA, 489 bp, Artificial Sequence
  Description of Artificial Sequence: Synthetic coding sequence
atggacagctgcgacgagctgatccccgagtacctgaacttcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcgagagcaaggagcaggtggccaacagcgccttcgtggagagatgcccctgccccacctggctgcccctgctggtgagcagcgtgttcttccccctgctgagcctgtgctag

SEQ ID NO: 84212 - DNA, 552 bp, Artificial Sequence
  Description of Artificial Sequence: Synthetic coding sequence
atggacagctgcgacgagctgatccccgagtacctgaacttcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcagcccctgctggtgcctggtgttcttcagcctgagctgcccctgcgtggagggcagcaagctgagagtgagcagccccatccccagcctgctgctgaccgccggcctggacgtggtgtactgcggcctgttctacttcctgcacttcgtgctgaagctgaagtacgccaagtag

SEQ ID NO: 84213 - DNA, 2175 bp, Artificial Sequence; identical to SEQ ID NO: 84208
  Description of Artificial Sequence: Synthetic coding sequence

SEQ ID NO: 84214 - DNA, 429 bp, Artificial Sequence
  Description of Artificial Sequence: Synthetic coding sequence
tgattcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcgagagcaaggagcaggtgtgcccctgccccacctggctgcccctgctggtgagcagcgtgttcttccccctgctgagcctgtgctag

SEQ ID NO: 84215 - DNA, 453 bp, Artificial Sequence
  Description of Artificial Sequence: Synthetic coding sequence
tgattcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcgagagcaaggagcaggtggccaacagcgccttcgtggagagatgcccctgccccacctggctgcccctgctggtgagcagcgtgttcttccccctgctgagcctgtgctag

SEQ ID NO: 84216 - DNA, 516 bp, Artificial Sequence
  Description of Artificial Sequence: Synthetic coding sequence
tgattcatcagaggcgtggtggacagcgaggacctgcccctgaacatcagcagagagatgctgcagcagagcaagatcctgaaggtgatcagaaagaacatcgtgaagaagtgcctggagctgttcagcgagctggccgaggacaaggagaactacaagaagttctacgaggccttcagcaagaacctgaagctgggcatccacgaggacagcaccaacagaagaagactgagcgagctgctgagataccacaccagccagagcggcgacgagatgaccagcctgagcgagtacgtgagcagaatgaaggagacccagaagagcatctactacatcaccggcagcccctgctggtgcctggtgttcttcagcctgagctgcccctgcgtggagggcagcaagctgagagtgagcagccccatccccagcctgctgctgaccgccggcctggacgtggtgtactgcggcctgttctacttcctgcacttcgtgctgaagctgaagtacgccaagtag

SEQ ID NO: 84217 - DNA, 507 bp, Artificial Sequence
  Description of Artificial Sequence: Synthetic coding sequence
atgcccgaggaggtgcaccacggcgaggaggaggtggagaccttcgccttccaggccgagatcgcccagctgatgagcctgatcatcaacaccttctacagcaacaaggagatcttcctgagagagctgatcagcaacgccagcgacgccctggacaagatcagatacgagagcctgaccgaccccagcaagctggacagcggcaaggagctgaagatcgacatcagcatgatcggccagttcggcgtgggcttctacagcgcctacctggtggccgagaaggtggtggtgatcaccaagcacaacgacgacgagcagtacgcctgggagagcagcgccggcggcagcttcaccgtgagagccgaccacggcgagcccatcggcagaggcaccaaggtgatcctgcacctgaaggaggaccagaccgagtacctggaggagagaagagtgaaggaggtggtgaagaagcacagccagttcatcggctaccccatcaccctgtactag

SEQ ID NO: 84218 - DNA, 483 bp, Artificial Sequence
  Description of Artificial Sequence: Synthetic coding sequence
atggagatccccgtgcccgtgcagcccagctggctgagaagagccagcgcccccctgcccggcctgagcgcccccggcagactgttcgaccagagattcggcgagggcctgctggaggccgagctggccgccctgtgccccaccaccctggccccctactacctgagagcccccagcgtggccctgcccgtggcccaggtgcccaccgaccccggccacttcagcgtgctgctggacgtgaagcacttcagccccgaggagatcgccgtgaaggtggtgggcgagcacgtggaggtgcacgccagacacgaggagagacccgacgagcacggcttcgtggccagagagttccacagaagatacagactgccccccggcgtggaccccgccgccgtgaccagcgccctgagccccgagggcgtgctgagcatccaggccgcccccgccagcgcccaggcccccccccccgccgccgccaagtag

SEQ ID NO: 84219 - DNA, 483 bp, Artificial Sequence; identical to SEQ ID NO: 84218
  Description of Artificial Sequence: Synthetic coding sequence

SEQ ID NO: 84220 - DNA, 591 bp, Artificial Sequence
  Description of Artificial Sequence: Synthetic coding sequence
atggagatccccgtgcccgtgcagcccagctggctgagaagagccagcgcccccctgcccggcctgagcgcccccggcagactgttcgaccagagattcggcgagggcctgctggaggccgagctggccgccctgtgccccaccaccctggccccctactacctgagagcccccagcgtggccctgcccgtggcccaggtgcccaccgaccccggccacttcagcgtgctgctggacgtgaagcacttcagccccgaggagatcgccgtgaaggtggtgggcgagcacgtggaggtgcacgccagacacgaggagagacccgacgagcacggcttcgtggccagagagttccacagaagatacagactgccccccggcgtggaccccgccgccgtgaccagcgccctgagccccgagggcgtgctgagcatccaggccgcccccgcccccagagagcccccccaggcccccagcatcaaggccgacctgaccccccccagccagatgagcagagtgagacagggcctgagcagccaccccctgctggacagcgccctgaccagcatcctggacaccgccctgatcacctag

SEQ ID NO: 84221 - DNA, 1590 bp, Artificial Sequence
  Description of Artificial Sequence: Synthetic coding sequence
atggacctgcccgtgggccccggcgccgccggccccagcaacgtgcccgccttcctgaccaagctgtggaccctggtgagcgaccccgacaccgacgccctgatctgctggagccccagcggcaacagcttccacgtgttcgaccagggccagttcgccaaggaggtgctgcccaagtacttcaagcacaacaacatggccagcttcgtgagacagctgaacatgtacggcttcagaaaggtggtgcacatcgagcagggcggcctggtgaagcccgagagagacgacaccgagttccagcacccctgcttcctgagaggccaggagcagctgctggagaacatcaagagaaaggtgaccagcgtgagcaccctgaagagcgaggacatcaagatcagacaggacagcgtgaccaagctgctgaccgacgtgcagctgatgaagggcaagcaggagtgcatggacagcaagctgctggccatgaagcacgagaacgaggccctgtggagagaggtggccagcctgagacagaagcacgcccagcagcagaaggtggtgaacaagctgatccagttcctgatcagcctggtgcagagcaacagaatcctgggcgtgaagagaaagatccccctgatgctgaacgacagcggcagcgcccacagcatgcccaagtacagcagacagttcagcctggagcacgtgcacggcagcggcccctacagcgcccccagccccgcctacagcagcagcagcctgtacgcccccgacgccgtggccagcagcggccccatcatcagcgacatcaccgagctggcccccgccagccccatggccagccccggcggcagcatcgacgagagacccctgagcagcagccccctggtgagagtgaaggaggagccccccagccccccccagagccccagagtggaggaggccagccccggcagacccagcagcgtggacaccctgctgagccccaccgccctgatcgacagcatcctgagagagagcgagcccgcccccgccagcgtgaccgccctgaccgacgccagaggccacaccgacaccgagggcagaccccccagccccccccccaccagcacccccgagaagtgcctgagcgtggcctgcctggacaagaacgagctgagcgaccacctggacgccatggacagcaacctggacaacctgcagaccatgctgagcagccacggcttcagcgtggacaccagcgccctgctggacctgttcagccccagcgtgaccgtgcccgacatgagcctgcccgacctggacagcagcctggccagcatccaggagctgctgagcccccaggagccccccagaccccccgaggccgagaacagcagccccgacagcggcaagcagctggtgcactacaccgcccagcccctgttcctgctggaccccggcagcgtggacaccggcagcaacgacctgcccgtgctgttcgagctgggcgagggcagctacttcagcgagggcgacggcttcgccgaggaccccaccatcagcctgctgaccggcagcgagccccccaaggccaaggaccccaccgtgagctag

SEQ ID NO: 84222 - DNA, 1611 bp, Artificial Sequence
  Description of Artificial Sequence: Synthetic coding sequence
atgaagcagagcagcaacgtgcccgccttcctgagcaagctgtggaccctggtggaggagacccacaccaacgagttcatcacctggagccagaacggccagagcttcctggtgctggacgagcagagattcgccaaggagatcctgcccaagtacttcaagcacaacaacatggccagcttcgtgagacagctgaacatgtacggcttcagaaaggtggtgcacatcgacagcggcatcgtgaagcaggagagagacggccccgtggagttccagcacccctacttcaagcagggccaggacgacctgctggagaacatcaagagaaaggtgagcagcagcaagcccgaggagaacaagatcagacaggaggacctgaccaagatcatcagcagcgcccagaaggtgcagatcaagcaggagaccatcgagagcagactgagcgagctgaagagcgagaacgagagcctgtggaaggaggtgagcgagctgagagccaagcacgcccagcagcagcaggtgatcagaaagatcgtgcagttcatcgtgaccctggtgcagaacaaccagctggtgagcctgaagagaaagagacccctgctgctgaacaccaacggcgcccagaagaagaacctgttccagcacatcgtgaaggagcccaccgacaaccaccaccacaaggtgccccacagcagaaccgagggcctgaagcccagagagagaatcagcgacgacatcatcatctacgacgtgaccgacgacaacgccgacgaggagaacatccccgtgatccccgagaccaacgaggacgtgatcagcgaccccagcaactgcagccagtaccccgacatcgtgatcgtggaggacgacaacgaggacgagtacgcccccgtgatccagagcggcgagcagaacgagcccgccagagagagcctgagcagcggcagcgacggcagcagccccctgatgagcagcgccgtgcagctgaacggcagcagcagcctgaccagcgaggaccccgtgaccatgatggacagcatcctgaacgacaacatcaacctgctgggcaaggtggagctgctggactacctggacagcatcgactgcagcctggaggacttccaggccatgctgagcggcagacagttcagcatcgaccccgacctgctggtggacctgttcaccagcagcgtgcagatgaaccccaccgactacatcaacaacaccaagagcgagaacaagggcctggagaccaccaagaacaacgtggtgcagcccgtgagcgaggagggcagaaagagcaagagcaagcccgacaagcagctgatccagtacaccgccttccccctgctggccttcctggacggcaaccccgccagcagcgtggagcaggccagcaccaccgccagcagcgaggtgctgagcagcgtggacaagcccatcgaggtggacgagctgctggacagcagcctggaccccgagcccacccagagcaagctggtgagactggagcccctgaccgaggccgaggccagcgaggccaccctgttctacctgtgcgagctggcccccgcccccctggacagcgacatgcccctgctggacagctag

SEQ ID NO: 84223 - DNA, 1557 bp, Artificial Sequence
  Description of Artificial Sequence: Synthetic coding sequence
atgaagcagagcagcaacgtgcccgccttcctgagcaagctgtggaccctggtggaggagacccacaccaacgagttcatcacctggagccagaacggccagagcttcctggtgctggacgagcagagattcgccaaggagatcctgcccaagtacttcaagcacaacaacatggccagcttcgtgagacagctgaacatgtacggcttcagaaaggtggtgcacatcgacagcggcatcgtgaagcaggagagagacggccccgtggagttccagcacccctacttcaagcagggccaggacgacctgctggagaacatcaagagaaaggtgagcagcagcaagcccgaggagaacaagatcagacaggaggacctgaccaagatcatcagcagcgcccagaaggtgcagatcaagcaggagaccatcgagagcagactgagcgagctgaagagcgagaacgagagcctgtggaaggaggtgagcgagctgagagccaagcacgcccagcagcagcaggtgatcagaaagatcgtgcagttcatcgtgaccctggtgcagaacaaccagctggtgagcctgaagagaaagagacccctgctgctgaacaccaacggcgcccagaagaagaacctgttccagcacatcgtgaaggagcccaccgacaaccaccaccacaaggtgccccacagcagaaccgagggcctgaagcccagagagagaatcagcgacgacatcatcatctacgacgtgaccgacgacaacgccgacgaggagaacatccccgtgatccccgagaccaacgaggacgtgatcagcgaccccagcaactgcagccagtaccccgacatcgtgatcgtggaggacgacaacgaggacgagtacgcccccgtgatccagagcggcgagcagaacgagcccgccagagagagcctgagcagcggcagcgacggcagcagccccctgatgagcagcgccgtgcagctgaacggcagcagcagcctgaccagcgaggaccccgtgaccatgatggacagcatcctgaacgacaacatcaacctgctgggcaaggtggagctgctggactacctggacagcatcgactgcagcctggaggacttccaggccatgctgagcggcagacagttcagcatcgaccccgacctgctggtggacagcgagaacaagggcctggagaccaccaagaacaacgtggtgcagcccgtgagcgaggagggcagaaagagcaagagcaagcccgacaagcagctgatccagtacaccgccttccccctgctggccttcctggacggcaaccccgccagcagcgtggagcaggccagcaccaccgccagcagcgaggtgctgagcagcgtggacaagcccatcgaggtggacgagctgctggacagcagcctggaccccgagcccacccagagcaagctggtgagactggagcccctgaccgaggccgaggccagcgaggccaccctgttctacctgtgcgagctggcccccgcccccctggacagcgacatgcccctgctggacagctag

SEQ ID NO: 84224 - DNA, 1005 bp, Artificial Sequence
  Description of Artificial Sequence: Synthetic coding sequence
atgggcgaggccggcgccgccgaggaggcctgcagacacatgggcaccaaggaggagttcgtgaaggtgagaaagaaggacctggagagactgaccaccgaggtgatgcagatcagagacttcctgcccagaatcctgaacggcgaggtgctggagagcttccagaagctgaagatcgtggagaagaacctggagagaaaggagcaggagctggagcagctgaagatggactgcgagcacttcaaggccagactggagaccgtgcaggccgacaacatcagagagaagaaggagaagctggccctgagacagcagctgaacgaggccaagcagcagctgctgcagcaggccgagtactgcaccgagatgggcgccgccgcctgcaccctgctgtggggcgtgagcagcagcgaggaggtggtgaaggccatcctgggcggcgacaaggccctgaagttcttcagcatcaccggccagaccatggagagcttcgtgaagagcctggacggcgacgtgcaggagctggacagcgacgagagccagttcgtgttcgccctggccggcatcgtgaccaacgtggccgccatcgcctgcggcagagagttcctggtgaacagcagcagagtgctgctggacaccatcctgcagctgctgggcgacctgaagcccggccagtgcaccaagctgaaggtgctgatgctgatgagcctgtacaacgtgagcatcaacctgaagggcctgaagtacatcagcgagagccccggcttcatccccctgctgtggtggctgctgagcgaccccgacgccgaggtgtgcctgcacgtgctgagactggtgcagagcgtggtgctggagcccgaggtgttcagcaagagcgccagcgagttcagaagcagcctgcccctgcagagaatcctggccatgagcaagagcagaaaccccagactgcagaccgccgcccaggagctgctggaggacctgagaaccctggagcacaacgtgtag

SEQ ID NO: 84225 - DNA, 780 bp, Artificial Sequence
  Description of Artificial Sequence: Synthetic coding sequence
atggactgcgagcacttcaaggccagactggagaccgtgcaggccgacaacatcagagagaagaaggagaagctggccctgagacagcagctgaacgaggccaagcagcagctgctgcagcaggccgagtactgcaccgagatgggcgccgccgcctgcaccctgctgtggggcgtgagcagcagcgaggaggtggtgaaggccatcctgggcggcgacaaggccctgaagttcttcagcatcaccggccagaccatggagagcttcgtgaagagcctggacggcgacgtgcaggagctggacagcgacgagagccagttcgtgttcgccctggccggcatcgtgaccaacgtggccgccatcgcctgcggcagagagttcctggtgaacagcagcagagtgctgctggacaccatcctgcagctgctgggcgacctgaagcccggccagtgcaccaagctgaaggtgctgatgctgatgagcctgtacaacgtgagcatcaacctgaagggcctgaagtacatcagcgagagccccggcttcatccccctgctgtggtggctgctgagcgaccccgacgccgaggtgtgcctgcacgtgctgagactggtgcagagcgtggtgctggagcccgaggtgttcagcaagagcgccagcgagttcagaagcagcctgcccctgcagagaatcctggccatgagcaagagcagaaaccccagactgcagaccgccgcccaggagctgctggaggacctgagaaccctggagcacaacgtgtag

SEQ ID NO: 84226 - DNA, 1479 bp, Artificial Sequence
  Description of Artificial Sequence: Synthetic coding sequence
atgcaggaggcccccgccgccctgcccaccgagcccggccccagccccgtgcccgccttcctgggcaagctgtgggccctggtgggcgaccccggcaccgaccacctgatcagatggagccccagcggcaccagcttcctggtgagcgaccagagcagattcgccaaggaggtgctgccccagtacttcaagcacagcaacatggccagcttcgtgagacagctgaacatgtacggcttcagaaaggtggtgagcatcgagcagggcggcctgctgagacccgagagagaccacgtggagttccagcaccccagcttcgtgagaggcagagagcagctgctggagagagtgagaagaaaggtgcccgccctgagaggcgacgacggcagatggagacccgaggacctgggcagactgctgggcgaggtgcaggccctgagaggcgtgcaggagagcaccgaggccagactgagagagctgagacagcagaacgagatcctgtggagagaggtggtgaccctgagacagagccacggccagcagcacagagtgatcggcaagctgatccagtgcctgttcggccccctgcaggccggccccagcaacgccggcggcaagagaaagctgagcctgatgctggacgagggcagcagctgccccacccccgccaagttcaacacctgccccctgcccggcgccctgctgcaggacccctacttcatccagagccccctgcccgagaccaacctgggcctgagcccccacagagccagaggccccatcatcagcgacatccccgaggacagccccagccccgagggcaccagactgagccccagcagcgacggcagaagagagaagggcctggccctgctgaaggaggagcccgccagccccggcggcgacggcgaggccggcctggccctggcccccaacgagtgcgacttctgcgtgaccgcccccccccccctgcccgtggccgtggtgcaggccatcctggagggcaagggcagcttcagccccgagggccccagaaacgcccagcagcccgagcccggcgaccccagagagatccccgacagaggccccctgggcctggagagcggcgacagaagccccgagagcctgctgccccccatgctgctgcagcccccccaggagagcgtggagcccgccggccccctggacgtgctgggccccagcctgcagggcagagagtggaccctgatggacctggacatggagctgagcctgatgcagcccctggtgcccgagagaggcgagcccgagctggccgtgaagggcctgaacagccccagccccggcaaggaccccaccctgggcgcccccctgctgctggacgtgcaggccgccctgggcggccccgccctgggcctgcccggcgccctgaccatctacagcacccccgagagcagaaccgccagctacctgggccccgaggccagccccagcccctag

SEQ ID NO: 84227 - DNA, 1389 bp, Artificial Sequence
  Description of Artificial Sequence: Synthetic coding sequence
atgcaggaggcccccgccgccctgcccaccgagcccggccccagccccgtgcccgccttcctgggcaagctgtgggccctggtgggcgaccccggcaccgaccacctgatcagatggagccccagcggcaccagcttcctggtgagcgaccagagcagattcgccaaggaggtgctgccccagtacttcaagcacagcaacatggccagcttcgtgagacagctgaacatgtacggcttcagaaaggtggtgagcatcgagcagggcggcctgctgagacccgagagagaccacgtggagttccagcaccccagcttcgtgagaggcagagagcagctgctggagagagtgagaagaaaggtgcccgccctgagaggcgacgacggcagatggagacccgaggacctgggcagactgctgggcgaggtgcaggccctgagaggcgtgcaggagagcaccgaggccagactgagagagctgagacagcagaacgagatcctgtggagagaggtggtgaccctgagacagagccacggccagcagcacagagtgatcggcaagctgatccagtgcctgttcggccccctgcaggccggccccagcaacgccggcggcaagagaaagctgagcctgatgctggacgagggcagcagctgccccacccccgccaagttcaacacctgccccctgcccggcgccctgctgcaggacccctacttcatccagagccccagcacctacagcctgagccagagacagatctgggccctggccctgaccggccccggcgcccccagcagcctgaccagccagaagaccctgcaccccctgagaggccccggcttcctgccccccgtgatggccggcgcccccccccccctgcccgtggccgtggtgcaggccatcctggagggcaagggcagcttcagccccgagggccccagaaacgcccagcagcccgagcccggcgaccccagagagatccccgacagaggccccctgggcctggagagcggcgacagaagccccgagagcctgctgccccccatgctgctgcagcccccccaggagagcgtggagcccgccggccccctggacgtgctgggccccagcctgcagggcagagagtggaccctgatggacctggacatggagctgagcctgatgcagcccctggtgcccgagagaggcgagcccgagctggccgtgaagggcctgaacagccccagccccggcaaggaccccaccctgggcgcccccctgctgctggacgtgcaggccgccctgggcggccccgccctgggcctgcccggcgccctgaccatctacagcacccccgagagcagaaccgccagctacctgggccccgaggccagccccagcccctag

SEQ ID NO: 84228 - DNA, 1251 bp, Artificial Sequence
  Description of Artificial Sequence: Synthetic coding sequence
atgcaggaggcccccgccgccctgcccaccgagcccggccccagccccgtgcccgccttcctgggcaagctgtgggccctggtgggcgaccccggcaccgaccacctgatcagatggagccccagcggcaccagcttcctggtgagcgaccagagcagattcgccaaggaggtgctgccccagtacttcaagcacagcaacatggccagcttcgtgagacagctgaacatgtacggcttcagaaaggtggtgagcatcgagcagggcggcctgctgagacccgagagagaccacgtggagttccagcaccccagcttcgtgagaggcagagagcagctgctggagagagtgagaagaaaggtgcccgccctgagaggcgacgacggcagatggagacccgaggacctgggcagactgctgggcgaggtgcaggccctgagaggcgtgcaggagagcaccgaggccagactgagagagctgagacagcagaacgagatcctgtggagagaggtggtgaccctgagacagagccacggccagcagcacagagtgatcggcaagctgatccagtgcctgttcggccccctgcaggccggccccagcaacgccggcggcaagagaaagctgagcctgatgctggacgagggcagcagctgccccacccccgccaagttcaacacctgccccctgcccggcgccctgctgcaggacccctacttcatccagagccccctgcccgagaccaacctgggcctgagcccccacagagccagaggccccatcatcagcgacatccccgaggacagccccagccccgagggcaccagactgagccccagcagcgacggcagaagaggccccctgggcctggagagcggcgacagaagccccgagagcctgctgccccccatgctgctgcagcccccccaggagagcgtggagcccgccggccccctggacgtgctgggccccagcctgcagggcagagagtggaccctgatggacctggacatggagctgagcctgatgcagcccctggtgcccgagagaggcgagcccgagctggccgtgaagggcctgaacagccccagccccggcaaggaccccaccctgggcgcccccctgctgctggacgtgcaggccgccctgggcggccccgccctgggcctgcccggcgccctgaccatctacagcacccccgagagcagaaccgccagctacctgggccccgaggccagccccagcccctag

SEQ ID NO: 84229 - DNA, 1479 bp, Artificial Sequence; identical to SEQ ID NO: 84226
  Description of Artificial Sequence: Synthetic coding sequence

SEQ ID NO: 84230 - DNA, 9 bp, Artificial Sequence
  Description of Artificial Sequence: Synthetic coding sequence
atgcagtag

SEQ ID NO: 84231 - DNA, 414 bp, Artificial Sequence
  Description of Artificial Sequence: Synthetic coding sequence
atgagcagcctgatcagaagagtgatcagcaccgccaaggcccccggcgccatcggcccctacagccaggccgtgctggtggacagaaccatctacatcagcggccagatcggcatggaccccagcagcggccagctggtgagcggcggcgtggccgaggaggccaagcaggccctgaagaacatgggcgagatcctgaaggccgccggctgcgacttcaccaacgtggtgaagaccaccgtgctgctggccgacatcaacgacttcaacaccgtgaacgagatctacaagcagtacttcaagagcaacttccccgccagagccgcctaccaggtggccgccctgcccaagggcagcagaatcgagatcgaggccgtggccatccagggccccctgaccaccgccagcctgtag

SEQ ID NO: 84232 - DNA, 14505 bp, Artificial Sequence
  Description of Artificial Sequence: Synthetic coding sequence
atgcccagcgagagcttctgcctggccgcccaggccagactggacagcaagtggctgaagaccgacatccagctggccttcaccagagacggcctgtgcggcctgtggaacgagatggtgaaggacggcgagatcgtgtacaccggcaccgagagcacccagaacggcgagctgccccccagaaaggacgacagcgtggagcccagcggcaccaagaaggaggacctgaacgacaaggagaagaaggacgaggaggagacccccgcccccatctacagagccaagagcatcctggacagctgggtgtggggcaagcagcccgacgtgaacgagctgaaggagtgcctgagcgtgctggtgaaggagcagcaggccctggccgtgcagagcgccaccaccaccctgagcgccctgagactgaagcagagactggtgatcctggagagatacttcatcgccctgaacagaaccgtgttccaggagaacgtgaaggtgaagtggaagagcagcggcatcagcctgccccccgtggacaagaagagcagcagacccgccggcaagggcgtggagggcctggccagagtgggcagcagagccgccctgagcttcgccttcgccttcctgagaagagcctggagaagcggcgaggacgccgacctgtgcagcgagctgctgcaggagagcctggacgccctgagagccctgcccgaggccagcctgttcgacgagagcaccgtgagcagcgtgtggctggaggtggtggagagagccaccagattcctgagaagcgtggtgaccggcgacgtgcacggcacccccgccaccaagggccccggcagcatccccctgcaggaccagcacctggccctggccatcctgctggagctggccgtgcagagaggcaccctgagccagatgctgagcgccatcctgctgctgctgcagctgtgggacagcggcgcccaggagaccgacaacgagagaagcgcccagggcaccagcgcccccctgctgcccctgctgcagagattccagagcatcatctgcagaaaggacgccccccacagcgagggcgacatgcacctgctgagcggccccctgagccccaacgagagcttcctgagatacctgaccctgccccaggacaacgagctggccatcgacctgagacagaccgccgtggtggtgatggcccacctggacagactggccaccccctgcatgccccccctgtgcagcagccccaccagccacaagggcagcctgcaggaggtgatcggctggggcctgatcggctggaagtactacgccaacgtgatcggccccatccagtgcgagggcctggccaacctgggcgtgacccagatcgcctgcgccgagaagagattcctgatcctgagcagaaacggcagagtgtacacccaggcctacaacagcgacaccctggccccccagctggtgcagggcctggccagcagaaacatcgtgaagatcgccgcccacagcgacggccaccactacctggccctggccgccaccggcgaggtgtacagctggggctgcggcgacggcggcagactgggccacggcgacaccgtgcccctggaggagcccaaggtgatcagcgccttcagcggcaagcaggccggcaagcacgtggtgcacatcgcctgcggcagcacctacagcgccgccatcaccgccgagggcgagctgtacacctggggcagaggcaactacggcagactgggccacggcagcagcgaggacgaggccatccccatgctggtggccggcctgaagggcctgaaggtgatcgacgtggcctgcggcagcggcgacgcccagaccctggccgtgaccgagaacggccaggtgtggagctggggcgacggcgactacggcaagctgggcagaggcggcagcgacggctgcaagacccccaagctgatcgagaagctgcaggacctggacgtggtgaaggtgagatgcggcagccagttcagcatcgccctgaccaaggacggccaggtgtacagctggggcaagggcgacaaccagagactgggccacggcaccgaggagcacgtgagataccccaagctgctggagggcctgcagggcaagaaggtgatcgacgtggccgccggcagcacccactgcctggccctgaccgaggacagcgaggtgcacagctggggcagcaacgaccagtgccagcacttcgacaccctgagagtgaccaagcccgagcccgccgccctgcccggcctggacaccaagcacatcgtgggcatcgcctgcggccccgcccagagcttcgcctggagcagctgcagcgagtggagcatcggcctgagagtgcccttcgtggtggacatctgcagcatgaccttcgagcagctggacctgctgctgagacaggtgagcgagggcatggacggcagcgccgactggccccccccccaggagaaggagtgcgtggccgtggccaccctgaacctgctgagactgcagctgcacgccgccatcagccaccaggtggaccccgagttcctgggcctgggcctgggcagcatcctgctgaacagcctgaagcagaccgtggtgaccctggccagcagcgccggcgtgctgagcaccgtgcagagcgccgcccaggccgtgctgcagagcggctggagcgtgctgctgcccaccgccgaggagagagccagagccctgagcgccctgctgccctgcgccgtgagcggcaacgaggtgaacatcagccccggcagaagattcatgatcgacctgctggtgggcagcctgatggccgacggcggcctggagagcgccctgcacgccgccatcaccgccgagatccaggacatcgaggccaagaaggaggcccagaaggagaaggagatcgacgagcaggaggccaacgccagcaccttccacagaagcagaacccccctggacaaggacctgatcaacaccggcatctgcgagagcagcggcaagcagtgcctgcccctggtgcagctgatccagcagctgctgagaaacatcgccagccagaccgtggccagactgaaggacgtggccagaagaatcagcagctgcctggacttcgagcagcacagcagagagagaagcgccagcctggacctgctgctgagattccagagactgctgatcagcaagctgtaccccggcgagagcatcggccagaccagcgacatcagcagccccgagctgatgggcgtgggcagcctgctgaagaagtacaccgccctgctgtgcacccacatcggcgacatcctgcccgtggccgccagcatcgccagcaccagctggagacacttcgccgaggtggcctacatcgtggagggcgacttcaccggcgtgctgctgcccgagctggtggtgagcatcgtgctgctgctgagcaagaacgccggcctgatgcaggaggccggcgccgtgcccctgctgggcggcctgctggagcacctggacagattcaaccacctggcccccggcaaggagagagacgaccacgaggagctggcctggcccggcatcatggagagcttcttcaccggccagaactgcagaaacaacgaggaggtgaccctgatcagaaaggccgacctggagaaccacaacaaggacggcggcttctggaccgtgatcgacggcaaggtgtacgacatcaaggacttccagacccagagcctgaccggcaacagcatcctggcccagttcgccggcgaggaccccgtggtggccctggaggccgccctgcagttcgaggacaccagagagagcatgcacgccttctgcgtgggccagtacctggagcccgaccaggagatcgtgaccatccccgacctgggcagcctgagcagccccctgatcgacaccgagagaaacctgggcctgctgctgggcctgcacgccagctacctggccatgagcacccccctgagccccgtggagatcgagtgcgccaagtggctgcagagcagcatcttcagcggcggcctgcagaccagccagatccactacagctacaacgaggagaaggacgaggaccactgcagcagccccggcggcacccccgccagcaagagcagactgtgcagccacagaagagccctgggcgaccacagccaggccttcctgcaggccatcgccgacaacaacatccaggaccacaacgtgaaggacttcctgtgccagatcgagagatactgcagacagtgccacctgaccacccccatcatgttcccccccgagcaccccgtggaggaggtgggcagactgctgctgtgctgcctgctgaagcacgaggacctgggccacgtggccctgagcctggtgcacgccggcgccctgggcatcgagcaggtgaagcacagaaccctgcccaagagcgtggtggacgtgtgcagagtggtgtaccaggccaagtgcagcctgatcaagacccaccaggagcagggcagaagctacaaggaggtgtgcgcccccgtgatcgagagactgagattcctgttcaacgagctgagacccgccgtgtgcaacgacctgagcatcatgagcaagttcaagctgctgagcagcctgcccagatggagaagaatcgcccagaagatcatcagagagagaagaaagaagagagtgcccaagaagcccgagagcaccgacgacgaggagaagatcggcaacgaggagagcgacctggaggaggcctgcatcctgccccacagccccatcaacgtggacaagagacccatcgccatcaagagccccaaggacaagtggcagcccctgctgagcaccgtgaccggcgtgcacaagtacaagtggctgaagcagaacgtgcagggcctgtacccccagagccccctgctgagcaccatcgccgagttcgccctgaaggaggagcccgtggacgtggagaagatgagaaagtgcctgctgaagcagctggagagagccgaggtgagactggagggcatcgacaccatcctgaagctggccagcaagaacttcctgctgcccagcgtgcagtacgccatgttctgcggctggcagagactgatccccgagggcatcgacatcggcgagcccctgaccgactgcctgaaggacgtggacctgatcccccccttcaacagaatgctgctggaggtgaccttcggcaagctgtacgcctgggccgtgcagaacatcagaaacgtgctgatggacgccagcgccaagttcaaggagctgggcatccagcccgtgcccctgcagaccatcaccaacgagaaccccagcggccccagcctgggcaccatcccccaggccagattcctgctggtgatgctgagcatgctgaccctgcagcacggcgccaacaacctggacctgctgctgaacagcggcatgctggccctgacccagaccgccctgagactgatcggccccagctgcgacaacgtggaggaggacatgaacgccagcgcccagggcgccagcgccaccgtgctggaggagaccagaaaggagaccgcccccgtgcagctgcccgtgagcggccccgagctggccgccatgatgaagatcggcaccagagtgatgagaggcgtggactggaagtggggcgaccaggacggccccccccccggcctgggcagagtgatcggcgagctgggcgaggacggctggatcagagtgcagtgggacaccggcagcaccaacagctacagaatgggcaaggagggcaagtacgacctgaagctggccgagctgcccgccgccgcccagcccagcgccgaggacagcgacaccgaggacgacagcgaggccgagcagaccgagagaaacatccaccccaccgccatgatgttcaccagcaccatcaacctgctgcagaccctgtgcctgagcgccggcgtgcacgccgagatcatgcagagcgaggccaccaagaccctgtgcggcctgctgagaatgctggtggagagcggcaccaccgacaagaccagcagccccaacagactggtgtacagagagcagcacagaagctggtgcaccctgggcttcgtgagaagcatcgccctgaccccccaggtgtgcggcgccctgagcagcccccagtggatcaccctgctgatgaaggtggtggagggccacgcccccttcaccgccaccagcctgcagagacagatcctggccgtgcacctgctgcaggccgtgctgcccagctgggacaagaccgagagagccagagacatgaagtgcctggtggagaagctgttcgacttcctgggcagcctgctgaccacctgcagcagcgacgtgcccctgctgagagagagcaccctgagaagaagaagagtgagaccccaggccagcctgaccgccacccacagcagcaccctggccgaggaggtggtggccctgctgagaaccctgcacagcctgacccagtggaacggcctgatcaacaagtacatcaacagccagctgagaagcatcacccacagcttcgtgggcagacccagcgagggcgcccagctggaggactacttccccgacagcgagaaccccgaggtgggcggcctgatggccgtgctggccgtgatcggcggcatcgacggcagactgagactgggcggccaggtgatgcacgacgagttcggcgagggcaccgtgaccagaatcacccccaagggcaagatcaccgtgcagttcagcgacatgagaacctgcagagtgtgccccctgaaccagctgaagcccctgcccgccgtggccttcaacgtgaacaacctgcccttcaccgagcccatgctgagcgtgtgggcccagctggtgaacctggccggcagcaagctggagaagcacaagatcaagaagagcaccaagcaggccttcgccggccaggtggacctggacctgctgagatgccagcagctgaagctgtacatcctgaaggccggcagagccctgctgagccaccaggacaagctgagacagatcctgagccagcccgccgtgcaggagaccggcaccgtgcacaccgacgacggcgccgtggtgagccccgacctgggcgacatgagccccgagggcccccagccccccatgatcctgctgcagcagctgctggccagcgccacccagcccagccccgtgaaggccatcttcgacaagcaggagctggaggccgccgccctggccgtgtgccagtgcctggccgtggagagcacccaccccagcagccccggcttcgaggactgcagcagcagcgaggccaccacccccgtggccgtgcagcacatcagacccgccagagtgaagagaagaaagcagagccccgtgcccgccctgcccatcgtggtgcagctgatggagatgggcttcagcagaagaaacatcgagttcgccctgaagagcctgaccggcgccagcggcaacgccagcagcctgcccggcgtggaggccctggtgggctggctgctggaccacagcgacatccaggtgaccgagctgagcgacgccgacaccgtgagcgacgagtacagcgacgaggaggtggtggaggacgtggacgacgccgcctacagcatgagcaccggcgccgtggtgaccgagagccagacctacaagaagagagccgacttcctgagcaacgacgactacgccgtgtacgtgagagagaacatccaggtgggcatgatggtgagatgctgcagagcctacgaggaggtgtgcgagggcgacgtgggcaaggtgatcaagctggacagagacggcctgcacgacctgaacgtgcagtgcgactggcagcagaagggcggcacctactgggtgagatacatccacgtggagctgatcggctaccccccccccagcagcagcagccacatcaagatcggcgacaaggtgagagtgaaggccagcgtgaccacccccaagtacaagtggggcagcgtgacccaccagagcgtgggcgtggtgaaggccttcagcgccaacggcaaggacatcatcgtggacttcccccagcagagccactggaccggcctgctgagcgagatggagctggtgcccagcatccaccccggcgtgacctgcgacggctgccagatgttccccatcaacggcagcagattcaagtgcagaaactgcgacgacttcgacttctgcgagacctgcttcaagaccaagaagcacaacaccagacacaccttcggcagaatcaacgagcccggccagagcgccgtgttctgcggcagaagcggcaagcagctgaagagatgccacagcagccagcccggcatgctgctggacagctggagcagaatggtgaagagcctgaacgtgagcagcagcgtgaaccaggccagcagactgatcgacggcagcgagccctgctggcagagcagcggcagccagggcaagcactggatcagactggagatcttccccgacgtgctggtgcacagactgaagatgatcgtggaccccgccgacagcagctacatgcccagcctggtggtggtgagcggcggcaacagcctgaacaacctgatcgagctgaagaccatcaacatcaaccccagcgacaccaccgtgcccctgctgaacgactgcaccgagtaccacagatacatcgagatcgccatcaagcagtgcagaagcagcggcatcgactgcaagatccacggcctgatcctgctgggcagaatcagagccgaggaggaggacctggccgccgtgcccttcctggccagcgacaacgaggaggaggaggacgagaagggcaacagcggcagcctgatcagaaagaaggccgccggcctggagagcgccgccaccatcagaaccaaggtgttcgtgtggggcctgaacgacaaggaccagctgggcggcctgaagggcagcaagatcaaggtgcccagcttcagcgagaccctgagcgccctgaacgtggtgcaggtggccggcggcagcaagagcctgttcgccgtgaccgtggagggcaaggtgtacgcctgcggcgaggccaccaacggcagactgggcctgggcatcagcagcggcaccgtgcccatccccagacagatcaccgccctgagcagctacgtggtgaagaaggtggccgtgcacagcggcggcagacacgccaccgccctgaccgtggacggcaaggtgttcagctggggcgagggcgacgacggcaagctgggccacttcagcagaatgaactgcgacaagcccagactgatcgaggccctgaagaccaagagaatcagagacatcgcctgcggcagcagccacagcgccgccctgaccagcagcggcgagctgtacacctggggcctgggcgagtacggcagactgggccacggcgacaacaccacccagctgaagcccaagatggtgaaggtgctgctgggccacagagtgatccaggtggcctgcggcagcagagacgcccagaccctggccctgaccgacgagggcctggtgttcagctggggcgacggcgacttcggcaagctgggcagaggcggcagcgagggctgcaacatcccccagaacatcgagagactgaacggccagggcgtgtgccagatcgagtgcggcgcccagttcagcctggccctgaccaagagcggcgtggtgtggacctggggcaagggcgactacttcagactgggccacggcagcgacgtgcacgtgagaaagccccaggtggtggagggcctgagaggcaagaagatcgtgcacgtggccgtgggcgccctgcactgcctggccgtgaccgacagcggccaggtgtacgcctggggcgacaacgaccacggccagcagggcaacggcaccaccaccgtgaacagaaagcccaccctggtgcagggcctggagggccagaagatcaccagagtggcctgcggcagcagccacagcgtggcctggaccaccgtggacgtggccacccccagcgtgcacgagcccgtgctgttccagaccgccagagaccccctgggcgccagctacctgggcgtgcccagcgacgccgacagcagcgccgccagcaacaagatcagcggcgccagcaacagcaagcccaacagacccagcctggccaagatcctgctgagcctggacggcaacctggccaagcagcaggccctgagccacatcctgaccgccctgcagatcatgtacgccagagacgccgtggtgggcgccctgatgcccgccgccatgatcgcccccgtggagtgccccagcttcagcagcgccgcccccagcgacgccagcgccatggccagccccatgaacggcgaggagtgcatgctggccgtggacatcgaggacagactgagccccaacccctggcaggagaagagagagatcgtgagcagcgaggacgccgtgacccccagcgccgtgacccccagcgcccccagcgccagcgccagacccttcatccccgtgaccgacgacctgggcgccgccagcatcatcgccgagaccatgaccaagaccaaggaggacgtggagagccagaacaaggccgccggccccgagccccaggccctggacgagttcaccagcctgctgatcgccgacgacaccagagtggtggtggacctgctgaagctgagcgtgtgcagcagagccggcgacagaggcagagacgtgctgagcgccgtgctgagcggcatgggcaccgcctacccccaggtggccgacatgctgctggagctgtgcgtgaccgagctggaggacgtggccaccgacagccagagcggcagactgagcagccagcccgtggtggtggagagcagccacccctacaccgacgacaccagcaccagcggcaccgtgaagatccccggcgccgagggcctgagagtggagttcgacagacagtgcagcaccgagagaagacacgaccccctgaccgtgatggacggcgtgaacagaatcgtgagcgtgagaagcggcagagagtggagcgactggagcagcgagctgagaatccccggcgacgagctgaagtggaagttcatcagcgacggcagcgtgaacggctggggctggagattcaccgtgtaccccatcatgcccgccgccggccccaaggagctgctgagcgacagatgcgtgctgagctgccccagcatggacctggtgacctgcctgctggacttcagactgaacctggccagcaacagaagcatcgtgcccagactggccgccagcctggccgcctgcgcccagctgagcgccctggccgccagccacagaatgtgggccctgcagagactgagaaagctgctgaccaccgagttcggccagagcatcaacatcaacagactgctgggcgagaacgacggcgagaccagagccctgagcttcaccggcagcgccctggccgccctggtgaagggcctgcccgaggccctgcagagacagttcgagtacgaggaccccatcgtgagaggcggcaagcagctgctgcacagccccttcttcaaggtgctggtggccctggcctgcgacctggagctggacaccctgccctgctgcgccgagacccacaagtgggcctggttcagaagatactgcatggccagcagagtggccgtggccctggacaagagaacccccctgcccagactgttcctggacgaggtggccaagaagatcagagagctgatggccgacagcgagaacatggacgtgctgcacgagagccacgacatcttcaagagagagcaggacgagcagctggtgcagtggatgaacagaagacccgacgactggaccctgagcgccggcggcagcggcaccatctacggctggggccacaaccacagaggccagctgggcggcatcgagggcgccaaggtgaaggtgcccaccccctgcgaggccctggccaccctgagacccgtgcagctgatcggcggcgagcagaccctgttcgccgtgaccgccgacggcaagctgtacgccaccggctacggcgccggcggcagactgggcatcggcggcaccgagagcgtgagcacccccaccctgctggagagcatccagcacgtgttcatcaagaaggtggccgtgaacagcggcggcaagcactgcctggccctgagcagcgagggcgaggtgtacagctggggcgaggccgaggacggcaagctgggccacggcaacagaagcccctgcgacagacccagagtgatcgagagcctgagaggcatcgaggtggtggacgtggccgccggcggcgcccacagcgcctgcgtgaccgccgccggcgacctgtacacctggggcaagggcagatacggcagactgggccacagcgacagcgaggaccagctgaagcccaagctggtggaggccctgcagggccacagagtggtggacatcgcctgcggcagcggcgacgcccagaccctgtgcctgaccgacgacgacaccgtgtggagctggggcgacggcgactacggcaagctgggcagaggcggcagcgacggctgcaaggtgcccatgaagatcgacagcctgaccggcctgggcgtggtgaaggtggagtgcggcagccagttcagcgtggccctgaccaagagcggcgccgtgtacacctggggcaagggcgactaccacagactgggccacggcagcgacgaccacgtgagaagacccagacaggtgcagggcctgcagggcaagaaggtgatcgccatcgccaccggcagcctgcactgcgtgtgctgcaccgaggacggcgaggtgtacacctggggcgacaacgacgagggccagctgggcgacggcaccaccaacgccatccagagacccagactggtggccgccctgcagggcaagaaggtgaacagagtggcctgcggcagcgcccacaccctggcctggagcaccagcaagcccgccagcgccggcaagctgcccgcccaggtgcccatggagtacaaccacctgcaggagatccccatcatcgccctgagaaacagactgctgctgctgcaccacctgagcgagctgttctgcccctgcatccccatgttcgacctggagggcagcctggacgagaccggcctgggccccagcgtgggcttcgacaccctgagaggcatcctgatcagccagggcaaggaggccgccttcagaaaggtggtgcaggccaccatggtgagagacagacagcacggccccgtggtggagctgaacagaatccaggtgaagagaagcagaagcaagggcggcctggccggccccgacggcaccaagagcgtgttcggccagatgtgcgccaagatgagcagcttcggccccgacagcctgctgctgccccacagagtgtggaaggtgaagttcgtgggcgagagcgtggacgactgcggcggcggctacagcgagagcatcgccgagatctgcgaggagctgcagaacggcctgacccccctgctgatcgtgacccccaacggcagagacgagagcggcgccaacagagactgctacctgctgagccccgccgccagagcccccgtgcacagcagcatgttcagattcctgggcgtgctgctgggcatcgccatcagaaccggcagccccctgagcctgaacctggccgagcccgtgtggaagcagctggccggcatgagcctgaccatcgccgacctgagcgaggtggacaaggacttcatccccggcctgatgtacatcagagacaacgaggccaccagcgaggagttcgaggccatgagcctgcccttcaccgtgcccagcgccagcggccaggacatccagctgagcagcaagcacacccacatcaccctggacaacagagccgagtacgtgagactggccatcaactacagactgcacgagttcgacgagcaggtggccgccgtgagagagggcatggccagagtggtgcccgtgcccctgctgagcctgttcaccggctacgagctggagaccatggtgtgcggcagccccgacatccccctgcacctgctgaagagcgtggccacctacaagggcatcgagcccagcgccagcctgatccagtggttctgggaggtgatggagagcttcagcaacaccgagagaagcctgttcctgagattcgtgtggggcagaaccagactgcccagaaccatcgccgacttcagaggcagagacttcgtgatccaggtgctggacaagtacaacccccccgaccacttcctgcccgagagctacacctgcttcttcctgctgaagctgcccagatacagctgcaagcaggtgctggaggagaagctgaagtacgccatccacttctgcaagagcatcgacaccgacgactacgccagaatcgccctgaccggcgagcccgccgccgacgacagcagcgacgacagcgacaacgaggacgtggacagcttcgccagcgacagcacccaggactacctgaccggccactag

SEQ ID NO: 84233 - DNA, 3075 bp, Artificial Sequence
  Description of Artificial Sequence: Synthetic coding sequence
atggagagaagaagcagaagaaagagcagaagaaacggcagaagcaccgccggcaaggccgccgccacccagcccgccaagagccccggcgcccagctgtggctgttccccagcgccgccggcctgcacagagccctgctgagaagagtggaggtgaccagacagctgtgctgcagccccggcagactggccgtgctggagagaggcggcgccggcgtgcaggtgcaccagctgctggccggcagcggcggcgccagaacccccaagtgcatcaagctgggcaagaacatgaagatccacagcgtggaccagggcgccgagcacatgctgatcctgagcagcgacggcaagcccttcgagtacgacaactacagcatgaagcacctgagattcgagagcatcctgcaggagaagaagatcatccagatcacctgcggcgactaccacagcctggccctgagcaagggcggcgagctgttcgcctggggccagaacctgcacggccagctgggcgtgggcagaaagttccccagcaccaccaccccccagatcgtggagcacctggccggcgtgcccctggcccagatcagcgccggcgaggcccacagcatggccctgagcatgagcggcaacatctacagctggggcaagaacgagtgcggccagctgggcctgggccacaccgagagcaaggacgaccccagcctgatcgagggcctggacaaccagaaggtggagttcgtggcctgcggcggcagccacagcgccctgctgacccaggacggcctgctgttcaccttcggcgccggcaagcacggccagctgggccacaacagcacccagaacgagctgagaccctgcctggtggccgagctggtgggctacagagtgacccagatcgcctgcggcagatggcacaccctggcctacgtgagcgacctgggcaaggtgttcagcttcggcagcggcaaggacggccagctgggcaacggcggcaccagagaccagctgatgcccctgcccgtgaaggtgagcagcagcgaggagctgaagctggagagccacaccagcgagaaggagctgatcatgatcgccggcggcaaccagagcatcctgctgtggatcaagaaggagaacagctacgtgaacctgaagagaaccatccccaccctgaacgagggcaccgtgaagagatggatcgccgacgtggagaccaagagatggcagagcaccaagagagagatccaggagatcttcagcagccccgcctgcctgaccggcagcttcctgagaaagagaagaaccaccgagatgatgcccgtgtacctggacctgaacaaggccagaaacatcttcaaggagctgacccagaaggactggatcaccaacatgatcaccacctgcctgaaggacaacctgctgaagagactgcccttccacagccccccccaggaggccctggagatcttcttcctgctgcccgagtgccccatgatgcacatcagcaacaactgggagagcctggtggtgcccttcgccaaggtggtgtgcaagatgagcgaccagagcagcctggtgctggaggagtactgggccaccctgcaggagagcaccttcagcaagctggtgcagatgttcaagaccgccgtgatctgccagctggactactgggacgagagcgccgaggagaacggcaacgtgcaggccctgctggagatgctgaagaagctgcacagagtgaaccaggtgaagtgccagctgcccgagagcatcttccaggtggacgagctgctgcacagactgaacttcttcgtggaggtgtgcagaagatacctgtggaagatgaccgtggacgccagcgagaacgtgcagtgctgcgtgatcttcagccacttccccttcatcttcaacaacctgagcaagatcaagctgctgcacaccgacaccctgctgaagatcgagagcaagaagcacaaggcctacctgagaagcgccgccatcgaggaggagagagagagcgagttcgccctgagacccaccttcgacctgaccgtgagaagaaaccacctgatcgaggacgtgctgaaccagctgagccagttcgagaacgaggacctgagaaaggagctgtgggtgagcttcagcggcgagatcggctacgacctgggcggcgtgaagaaggagttcttctactgcctgttcgccgagatgatccagcccgagtacggcatgttcatgtaccccgagggcgccagctgcatgtggttccccgtgaagcccaagttcgagaagaagagatacttcttcttcggcgtgctgtgcggcctgagcctgttcaactgcaacgtggccaacctgcccttccccctggccctgttcaagaagctgctggaccagatgcccagcctggaggacctgaaggagctgagccccgacctgggcaagaacctgcagaccctgctggacgacgagggcgacaacttcgaggaggtgttctacatccacttcaacgtgcactgggacagaaacgacaccaacctgatccccaacggcagcagcatcaccgtgaaccagaccaacaagagagactacgtgagcaagtacatcaactacatcttcaacgacagcgtgaaggccgtgtacgaggagttcagaagaggcttctacaagatgtgcgacgaggacatcatcaagctgttccaccccgaggagctgaaggacgtgatcgtgggcaacaccgactacgactggaagaccttcgagaagaacgccagatacgagcccggctacaacagcagccaccccaccatcgtgatgttctggaaggccttccacaagctgaccctggaggagaagaagaagttcctggtgttcctgaccggcaccgacagactgcagatgaaggacctgaacaacatgaagatcaccttctgctgccccgagagctggaacgagagagaccccatcagagccctgacctgcttcagcgtgctgttcctgcccaagtacagcaccatggagaccgtggaggaggccctgcaggaggccatcaacaacaacagaggcttcggctag

SEQ ID NO: 84234 - DNA, 1854 bp, Artificial Sequence
  Description of Artificial Sequence: Synthetic coding sequence
atgggccccaccctggccgtgcccaccccctacggctgcatcggctgcaagctgccccagcccgagtacccccccgccctgatcatcttcatgttctgcgccatggtgatcaccatcgtggtggacctgatcggcaacagcatggtgatcctggccgtgaccaagaacaagaagctgagaaacagcggcaacatcttcgtggtgagcctgagcgtggccgacatgctggtggccatctacccctaccccctgatgctgcacgccatgagcatcggcggctgggacctgagccagctgcagtgccagatggtgggcttcatcaccggcctgagcgtggtgggcagcatcttcaacatcgtggccatcgccatcaacagatactgctacatctgccacagcctgcagtacgagagaatcttcagcgtgagaaacacctgcatctacctggtgatcacctggatcatgaccgtgctggccgtgctgcccaacatgtacatcggcaccatcgagtacgaccccagaacctacacctgcatcttcaactacctgaacaaccccgtgttcaccgtgaccatcgtgtgcatccacttcgtgctgcccctgctgatcgtgggcttctgctacgtgagaatctggaccaaggtgctggccgccagagaccccgccggccagaaccccgacaaccagctggccgaggtgagaaacttcctgaccatgttcgtgatcttcctgctgttcgccgtgtgctggtgccccatcaacgtgctgaccgtgctggtggccgtgagccccaaggagatggccggcaagatccccaactggctgtacctggccgcctacttcatcgcctacttcaacagctgcctgaacgccgtgatctacggcctgctgaacgagaacttcagaagagagtactggaccatcttccacgccatgagacaccccatcatcttcttcagcggcctgatcagcgacatcagagagatgcaggaggccagaaccctggccagagccagagcccacgccagagaccaggccagagagcaggacagagcccacgcctgccccgccgtggaggagacccccatgaacgtgagaaacgtgcccctgcccggcgacgccgccgccggccaccccgacagagccagcggccaccccaagccccacagcagaagcagcagcgcctacagaaagagcgccagcacccaccacaagagcgtgttcagccacagcaaggccgccagcggccacctgaagcccgtgagcggccacagcaagcccgccagcggccaccccaagagcgccaccgtgtaccccaagcccgccagcgtgcacttcaaggccgacagcgtgcacttcaagggcgacagcgtgcacttcaagcccgacagcgtgcacttcaagcccgccagcagcaaccccaagcccatcaccggccaccacgtgagcgccggcagccacagcaagagcgccttcagcgccgccaccagccaccccaagcccaccaccggccacatcaagcccgccaccagccacgccgagcccaccaccgccgactaccccaagcccgccaccaccagccaccccaagcccaccgccgccgacaaccccgagctgagcgccagccactgccccgagatccccgccatcgcccaccccgtgagcgacgacagcgacctgcccgagagcgccagcagccccgccgccggccccaccaagcccgccgccagccagctggagagcgacaccatcgccgacctgcccgaccccaccgtggtgaccaccagcaccaacgactaccacgacgtggtggtgatcgacgtggaggacgaccccgacgagatggccgtgtag

SEQ ID NO: 84235 - DNA, 13125 bp, Artificial Sequence
  Description of Artificial Sequence: Synthetic coding sequence
atgaaggtggacagaaccaagctgaagaagacccccaccgaggcccccgccgactgcagagccctgatcgacaagctgaaggtgtgcaacgacgagcagctgctgctggagctgcagcagatcaagacctggaacatcggcaagtgcgagctgtaccactgggtggacctgctggacagattcgacggcatcctggccgacgccggccagaccgtggagaacatgagctggatgctggtgtgcgacagacccgagagagagcagctgaagatgctgctgctggccgtgctgaacttcaccgccctgctgatcgagtacagcttcagcagacacctgtacagcagcatcgagcacctgaccaccctgctggccagcagcgacatgcaggtggtgctggccgtgctgaacctgctgtacgtgttcagcaagagaagcaactacatcaccagactgggcagcgacaagagaacccccctgctgaccagactgcagcacctggccgagagctggggcggcaaggagaacggcttcggcctggccgagtgctgcagagacctgcacatgatgaagtacccccccagcgccaccaccctgcacttcgagttctacgccgaccccggcgccgaggtgaagatcgagaagagaaccaccagcaacaccctgcactacatccacatcgagcagctggacaagatcagcgagagccccagcgagatcatggagagcctgaccaagatgtacagcatccccaaggacaagcagatgctgctgttcacccacatcagactggcccacggcttcagcaaccacagaaagagactgcaggccgtgcaggccagactgcacgccatcagcatcctggtgtacagcaacgccctgcaggagagcgccaacagcatcctgtacaacggcctgatcgaggagctggtggacgtgctgcagatcaccgacaagcagctgatggagatcaaggccgccagcctgagaaccctgaccagcatcgtgcacctggagagaacccccaagctgagcagcatcatcgactgcaccggcaccgccagctaccacggcttcctgcccgtgctggtgagaaactgcatccaggccatgatcgaccccagcatggacccctacccccaccagttcgccaccgccctgttcagcttcctgtaccacctggccagctacgacgccggcggcgaggccctggtgagctgcggcatgatggaggccctgctgaaggtgatcaagttcctgggcgacgagcaggaccagatcaccttcgtgaccagagccgtgagagtggtggacctgatcaccaacctggacatggccgccttccagagccacagcggcctgagcatcttcatctacagactggagcacgaggtggacctgtgcagaaaggagtgccccttcgtgatcaagcccaagatccagagacccaacaccacccaggagggcgaggagatggagaccgacatggacggcgtgcagtgcatcccccagagagccgccctgctgaagagcatgctgaacttcctgaagaaggccatccaggaccccgccttcagcgacggcatcagacacgtgatggacggcagcctgcccaccagcctgaagcacatcatcagcaacgccgagtactacggccccagcctgttcctgctggccaccgaggtggtgaccgtgttcgtgttccaggagcccagcctgctgagcagcctgcaggacaacggcctgaccgacgtgatgctgcacgccctgctgatcaaggacgtgcccgccaccagagaggtgctgggcagcctgcccaacgtgttcagcgccctgtgcctgaacgccagaggcctgcagagcttcgtgcagtgccagcccttcgagagactgttcaaggtgctgctgagccccgactacctgcccgccatgagaagaagaagaagcagcgaccccctgggcgacaccgccagcaacctgggcagcgccgtggacgagctgatgagacaccagcccaccctgaagaccgacgccaccaccgccatcatcaagctgctggaggagatctgcaacctgggcagagaccccaagtacatctgccagaagcccagcatccagaaggccgacggcaccgccaccgcccccccccccagaagcaaccacgccgccgaggaggccagcagcgaggacgaggaggaggaggaggtgcaggccatgcagagcttcaacagcacccagcagaacgagaccgagcccaaccagcaggtggtgggcaccgaggagagaatccccatccccctgatggactacatcctgaacgtgatgaagttcgtggagagcatcctgagcaacaacaccaccgacgaccactgccaggagttcgtgaaccagaagggcctgctgcccctggtgaccatcctgggcctgcccaacctgcccatcgacttccccaccagcgccgcctgccaggccgtggccggcgtgtgcaagagcatcctgaccctgagccacgagcccaaggtgctgcaggagggcctgctgcagctggacagcatcctgagcagcctggagcccctgcacagacccatcgagagccccggcggcagcgtgctgctgagagagctggcctgcgccggcaacgtggccgacgccaccctgagcgcccaggccacccccctgctgcacgccctgaccgccgcccacgcctacatcatgatgttcgtgcacacctgcagagtgggccagagcgagatcagaagcatcagcgtgaaccagtggggcagccagctgggcctgagcgtgctgagcaagctgagccagctgtactgcagcctggtgtgggagagcaccgtgctgctgagcctgtgcacccccaacagcctgcccagcggctgcgagttcggccaggccgacatgcagaagctggtgcccaaggacgagaaggccggcaccacccagggcggcaagagaagcgacggcgagcaggacggcgccgccggcagcatggacgccagcacccagggcctgctggagggcatcggcctggacggcgacaccctggcccccatggagaccgacgagcccaccgccagcgacagcaagggcaagagcaagatcacccccgccatggccgccagaatcaagcagatcaagcccctgctgagcgccagcagcagactgggcagagccctggccgagctgttcggcctgctggtgaagctgtgcgtgggcagccccgtgagacagagaagaagccaccacgccgccagcaccaccaccgcccccacccccgccgccagaagcaccgccagcgccctgaccaagctgctgaccaagggcctgagctggcagccccccccctacacccccacccccagattcagactgaccttcttcatctgcagcgtgggcttcaccagccccatgctgttcgacgagagaaagtacccctaccacctgatgctgcagaagttcctgtgcagcggcggccacaacgccctgttcgagaccttcaactgggccctgagcatgggcggcaaggtgcccgtgagcgagggcctggagcacagcgacctgcccgacggcaccggcgagttcctggacgcctggctgatgctggtggagaagatggtgaaccccaccaccgtgctggagagcccccacagcctgcccgccaagctgcccggcggcgtgcagaacttcccccagttcagcgccctgagattcctggtggtgacccagaaggccgccttcacctgcatcaagaacctgtggaacagaaagcccctgaaggtgtacggcggcagaatggccgagagcatgctggccatcctgtgccacatcctgagaggcgagcccgtgatcagagagagactgagcaaggagaaggagggcagcagaggcgaggaggacaccggccaggaggagggcggcagcagaagagagccccaggtgaaccagcagcagctgcagcagctgatggacatgggcttcaccagagagcacgccatggaggccctgctgaacaccagcaccatggagcaggccaccgagtacctgctgacccaccccccccccatcatgggcggcgtggtgagagacctgagcatgagcgaggaggaccagatgatgagagccatcgccatgagcctgggccaggacatccccatggaccagagagccgagagccccgaggaggtggcctgcagaaaggaggaggaggagagaaaggccagagagaagcaggaggaggaggaggccaagtgcctggagaagttccaggacgccgaccccctggagcaggacgagctgcacaccttcaccgacaccatgctgcccggctgcttccacctgctggacgagctgcccgacaccgtgtacagagtgtgcgacctgatcatgaccgccatcaagagaaacggcgccgactacagagacatgatcctgaagcaggtggtgaaccaggtgtgggaggccgccgacgtgctgatcaaggccgccctgcccctgaccaccagcgacaccaagaccgtgagcgagtggatcagccagatggccaccctgccccaggccagcaacctggccaccagaatcctgctgctgaccctgctgttcgaggagctgaagctgccctgcgcctgggtggtggagagcagcggcatcctgaacgtgctgatcaagctgctggaggtggtgcagccctgcctgcaggccgccaaggagcagaaggaggtgcagacccccaagtggatcacccccgtgctgctgctgatcgacttctacgagaagaccgccatcagcagcaagagaagagcccagatgaccaagtacctgcagagcaacagcaacaactggagatggttcgacgacagaagcggcagatggtgcagctacagcgccagcaacaacagcaccatcgacagcgcctggaagagcggcgagaccagcgtgagattcaccgccggcagaagaagatacaccgtgcagttcaccaccatggtgcaggtgaacgaggagaccggcaacagaagacccgtgatgctgaccctgctgagagtgcccagactgaacaagaacagcaagaacagcaacggccaggagctggagaagaccctggaggagagcaaggagatggacatcaagagaaaggagaacaagggcaacgacacccccctggccctggagagcaccaacaccgagaaggagaccagcctggaggagaccaagatcggcgagatcctgatccagggcctgaccgaggacatggtgaccgtgctgatcagagcctgcgtgagcatgctgggcgtgcccgtggaccccgacaccctgcacgccaccctgagactgtgcctgagactgaccagagaccacaagtacgccatgatgttcgccgagctgaagagcaccagaatgatcctgaacctgacccagagcagcggcttcaacggcttcacccccctggtgaccctgctgctgagacacatcatcgaggacccctgcaccctgagacacaccatggagaaggtggtgagaagcgccgccaccagcggcgccggcagcaccaccagcggcgtggtgagcggcagcctgggcagcagagagatcaactacatcctgagagtgctgggccccgccgcctgcagaaaccccgacatcttcaccgaggtggccaactgctgcatcagaatcgccctgcccgcccccagaggcagcggcaccgccagcgacgacgagttcgagaacctgagaatcaagggccccaacgccgtgcagctggtgaagaccacccccctgaagcccagccccctgcccgtgatccccgacaccatcaaggaggtgatctacgacatgctgaacgccctggccgcctaccacgcccccgaggaggccgacaagagcgaccccaagcccggcgtgatgacccaggaggtgggccagctgctgcaggacatgggcgacgacgtgtaccagcagtacagaagcctgaccagacagagcagcgacttcgacacccagagcggcttcagcatcaacagccaggtgttcgccgccgacggcgccagcaccgagaccagcgccagcggcaccagccagggcgaggccagcacccccgaggagagcagagacggcaagaaggacaaggagggcgacagagccagcgaggagggcaagcagaagggcaagggcagcaagcccctgatgcccaccagcaccatcctgagactgctggccgagctggtgagaagctacgtgggcatcgccaccctgatcgccaactacagctacaccgtgggccagagcgagctgatcaaggaggactgcagcgtgctggccttcgtgctggaccacctgctgccccacacccagaacgccgaggacaaggacacccccgccctggccagactgttcctggccagcctggccgccgccggcagcggcaccgacgcccaggtggccctggtgaacgaggtgaaggccgccctgggcagagccctggccatggccgagagcaccgagaagcacgccagactgcaggccgtgatgtgcatcatcagcaccatcatggagagctgccccagcaccagcagcttctacagcagcgccaccgccaagacccagcacaacggcatgaacaacatcatcagactgttcctgaagaagggcctggtgaacgacctggccagagtgccccacagcctggacctgagcagccccaacatggccaacaccgtgaacgccgccctgaagcccctggagaccctgagcagaatcgtgaaccagcccagcagcctgttcggcagcaagagcgccagcagcaagaacaagagcgagcaggacgcccagggcgccagccaggacagcagcagcaaccagcaggaccccggcgagcccggcgaggccgaggtgcaggaggaggaccacgacgtgacccagaccgaggtggccgacggcgacatcatggacggcgaggccgagaccgacagcgtggtgatcgccggccagcccgaggtgctgagcagccaggagatgcaggtggagaacgagctggaggacctgatcgacgagctgctggagagagacggcggcagcggcaacagcaccatcatcgtgagcagaagcggcgaggacgagagccaggaggacgtgctgatggacgaggcccccagcaacctgagccaggccagcaccctgcaggccaacagagaggacagcatgaacatcctggaccccgaggacgaggaggagcacacccaggaggaggacagcagcggcagcaacgaggacgaggacgacagccaggacgaggaggaggaggaggaggaggacgaggaggacgaccaggaggacgacgagggcgaggagggcgacgaggacgacgacgacgacggcagcgagatggagctggacgaggactaccccgacatgaacgccagccccctggtgagattcgagagattcgacagagaggacgacctgatcatcgagttcgacaacatgttcagcagcgccaccgacatcccccccagccccggcaacatccccaccacccaccccctgatggtgagacacgccgaccacagcagcctgaccctgggcagcggcagcagcaccaccagactgacccagggcatcggcagaagccagagaaccctgagacagctgaccgccaacaccggccacaccatccacgtgcactaccccggcaacagacagcccaacccccccctgatcctgcagagactgctgggccccagcgccgccgccgacatcctgcagctgagcagcagcctgcccctgcagagcagaggcagagccagactgctggtgggcaacgacgacgtgcacatcatcgccagaagcgacgacgagctgctggacgacttcttccacgaccagagcaccgccaccagccaggccggcaccctgagcagcatccccaccgccctgaccagatggaccgaggagtgcaaggtgctggacgccgagagcatgcacgactgcgtgagcgtggtgaaggtgagcatcgtgaaccacctggagttcctgagagacgaggagctggaggagagaagagagaagagaagaaagcagctggccgaggaggagaccaagatcaccgacaagggcaaggaggacaaggagaacagagaccagagcgcccagtgcaccgccagcaagagcaacgacagcaccgagcagaacctgagcgacggcacccccatgcccgacagctaccccaccacccccagcagcaccgacgccgccaccagcgagagcaaggagaccctgggcaccctgcagagcagccagcagcagcccaccctgcccaccccccccgccctgggcgaggtgccccaggagctgcagagccccgccggcgagggcggcagcagcacccagctgctgatgcccgtggagcccgaggagctgggccccaccagacccagcggcgaggccgagaccacccagatggagctgagccccgcccccaccatcaccagcctgagccccgagagagccgaggacagcgacgccctgaccgccgtgagcagccagctggagggcagccccatggacaccagcagcctggccagctgcaccctggaggaggccgtgggcgacaccagcgccgccggcagcagcgagcagcccagagccggcagcagcacccccggcgacgccccccccgccgtggccgaggtgcagggcagaagcgacggcagcggcgagagcgcccagccccccgaggacagcagcccccccgccagcagcgagagcagcagcaccagagacagcgccgtggccatcagcggcgccgacagcagaggcatcctggaggagcccctgcccagcaccagcagcgaggaggaggaccccctggccggcatcagcctgcccgagggcgtggaccccagcttcctggccgccctgcccgacgacatcagaagagaggtgctgcagaaccagctgggcatcagaccccccaccagaaccgcccccagcaccaacagcagcgcccccgccgtggtgggcaaccccggcgtgaccgaggtgagccccgagttcctggccgccctgccccccgccatccaggaggaggtgctggcccagcagagagccgagcagcagagaagagagctggcccagaacgccagcagcgacacccccatggaccccgtgaccttcatccagaccctgcccagcgacctgagaagaagcgtgctggaggacatggaggacagcgtgctggccgtgatgccccccgacatcgccgccgaggcccaggccctgagaagagagcaggaggccagacagagacagctgatgcacgagagactgttcggccacagcagcaccagcgccctgagcgccatcctgagaagccccgccttcaccagcagactgagcggcaacagaggcgtgcagtacaccagactggccgtgcagagaggcggcaccttccagatgggcggcagcagcagccacaacagacccagcggcagcaacgtggacaccctgctgagactgagaggcagactgctgctggaccacgaggccctgagctgcctgctggtgctgctgttcgtggacgagcccaagctgaacaccagcagactgcacagagtgctgagaaacctgtgctaccacgcccagaccagacactgggtgatcagaagcctgctgagcatcctgcagagaagcagcgagagcgagctgtgcatcgagacccccaagctgaccaccagcgaggagaagggcaagaagagcagcaagagctgcggcagcagcagccacgagaacagacccctggacctgctgcacaagatggagagcaagagcagcaaccagctgagctggctgagcgtgagcatggacgccgccctgggctgcagaaccaacatcttccagatccagagaagcggcggcagaaagcacaccgagaagcacgccagcggcggcagcaccgtgcacatccacccccaggccgcccccgtggtgtgcagacacgtgctggacaccctgatccagctggccaaggtgttccccagccacttcacccagcagagaaccaaggagaccaactgcgagagcgacagagagagaggcaacaaggcctgcagcccctgcagcagccagagcagcagcagcggcatctgcaccgacttctgggacctgctggtgaagctggacaacatgaacgtgagcagaaagggcaagaacagcgtgaagagcgtgcccgtgagcgccggcggcgagggcgagaccagcccctacagcctggaggccagccccctgggccagctgatgaacatgctgagccaccccgtgatcagaagaagcagcctgctgaccgagaagctgctgagactgctgagcctgatcagcatcgccctgcccgagaacaaggtgagcgaggcccaggccaacagcggcagcggcgccagcagcaccaccaccgccaccagcaccaccagcaccaccaccaccaccgccgccagcaccacccccaccccccccaccgcccccacccccgtgaccagcgcccccgccctggtggccgccaccgccatcagcaccatcgtggtggccgccagcaccaccgtgaccacccccaccaccgccaccaccaccgtgagcatcagccccaccaccaagggcagcaagagccccgccaaggtgagcgacggcggcagcagcagcaccgacttcaagatggtgagcagcggcctgaccgagaaccagctgcagctgagcgtggaggtgctgaccagccacagctgcagcgaggagggcctggaggacgccgccaacgtgctgctgcagctgagcagaggcgacagcggcaccagagacaccgtgctgaagctgctgctgaacggcgccagacacctgggctacaccctgtgcaagcagatcggcaccctgctggccgagctgagagagtacaacctggagcagcagagaagagcccagtgcgagaccctgagccccgacggcctgcccgaggagcagccccagaccaccaagctgaagggcaagatgcagagcagattcgacatggccgagaacgtggtgatcgtggccagccagaagagacccctgggcggcagagagctgcagctgcccagcatgagcatgctgaccagcaagaccagcacccagaagttcttcctgagagtgctgcaggtgatcatccagctgagagacgacaccagaagagccaacaagaaggccaagcagaccggcagactgggcagcagcggcctgggcagcgccagcagcatccaggccgccgtgagacagctggaggccgaggccgacgccatcatccagatggtgagagagggccagagagccagaagacagcagcaggccgccaccagcgagagcagccagagcgaggccagcgtgagaagagaggagagccccatggacgtggaccagcccagccccagcgcccaggacacccagagcatcgccagcgacggcaccccccagggcgagaaggagaaggaggagagaccccccgagctgcccctgctgagcgagcagctgagcctggacgagctgtgggacatgctgggcgagtgcctgaaggagctggaggagagccacgaccagcacgccgtgctggtgctgcagcccgccgtggaggccttcttcctggtgcacgccaccgagagagagagcaagccccccgtgagagacaccagagagagccagctggcccacatcaaggacgagcccccccccctgagccccgcccccctgacccccgccacccccagcagcctggaccccttcttcagcagagagcccagcagcatgcacatcagcagcagcctgccccccgacacccagaagttcctgagattcgccgagacccacagaaccgtgctgaaccagatcctgagacagagcaccacccacctggccgacggccccttcgccgtgctggtggactacatcagagtgctggacttcgacgtgaagagaaagtacttcagacaggagctggagagactggacgagggcctgagaaaggaggacatggccgtgcacgtgagaagagaccacgtgttcgaggacagctacagagagctgcacagaaagagccccgaggagatgaagaacagactgtacatcgtgttcgagggcgaggagggccaggacgccggcggcctgctgagagagtggtacatgatcatcagcagagagatgttcaaccccatgtacgccctgttcagaaccagccccggcgacagagtgacctacaccatcaaccccagcagccactgcaaccccaaccacctgagctacttcaagttcgtgggcagaatcgtggccaaggccgtgtacgacaacagactgctggagtgctacttcaccagaagcttctacaagcacatcctgggcaagagcgtgagatacaccgacatggagagcgaggactaccacttctaccagggcctggtgtacctgctggagaacgacgtgagcaccctgggctacgacctgaccttcagcaccgaggtgcaggagttcggcgtgtgcgaggtgagagacctgaagcccaacggcgccaacatcctggtgaccgaggagaacaagaaggagtacgtgcacctggtgtgccagatgagaatgaccggcgccatcagaaagcagctggccgccttcctggagggcttctacgagatcatccccaagagactgatcagcatcttcaccgagcaggagctggagctgctgatcagcggcctgcccaccatcgacatcgacgacctgaagagcaacaccgagtaccacaagtaccagagcaacagcatccagatccagtggttctggagagccctgagaagcttcgaccaggccgacagagccaagttcctgcagttcgtgaccggcaccagcaaggtgcccctgcagggcttcgccgccctggagggcatgaacggcatccagaagttccagatccacagagacgacagaagcaccgacagactgcccagcgcccacacctgcttcaaccagctggacctgcccgcctacgagagcttcgagaagctgagacacatgctgctgctggccatccaggagtgcagcgagggcttcggcctggcctag

SEQ ID NO: 84236 - DNA, 13125 bp, Artificial Sequence; identical to SEQ ID NO: 84235
  Description of Artificial Sequence: Synthetic coding sequence

SEQ ID NO: 84237 - DNA, 771 bp, Artificial Sequence
  Description of Artificial Sequence: Synthetic coding sequence
atggacccctacccccaccagttcgccaccgccctgttcagcttcctgtaccacctggccagctacgacgccggcggcgaggccctggtgagctgcggcatgatggaggccctgctgaaggtgatcaagttcctgggcgacgagcaggaccagatcaccttcgtgaccagagccgtgagagtggtggacctgatcaccaacctggacatggccgccttccagagccacagcggcctgagcatcttcatctacagactggagcacgaggtggacctgtgcagaaaggagtgccccttcgtgatcaagcccaagatccagagacccaacaccacccaggagggcgaggagatggagaccgacatggacgtggccgacgtggccatggagagcagccccggcagcagcatcagcatggagcacagactggacgtggagctgagagccagcggcagcagcagcagcaccaacatcagcagcggccccagccccggccccagccccggcaccggccccggccccggccccggccccggccccggccccggccccggccccggccccggccccggccccggccccggccccggccccggccccggccccagacccggcgtgcagtgcatcccccagagagccgccctgctgaagagcatgctgaacttcctgaagaaggccatccaggaccccgccttcagcgacggcatcagacacgtgatggacggcagcctgcccaccagcctgaagcacatcatcagcaacgccgagtactag

SEQ ID NO: 84238 - DNA, 687 bp, Artificial Sequence
  Description of Artificial Sequence: Synthetic coding sequence
tgagtgagctgcggcatgatggaggccctgctgaaggtgatcaagttcctgggcgacgagcaggaccagatcaccttcgtgaccagagccgtgagagtggtggacctgatcaccaacctggacatggccgccttccagagccacagcggcctgagcatcttcatctacagactggagcacgaggtggacctgtgcagaaaggagtgccccttcgtgatcaagcccaagatccagagacccaacaccacccaggagggcgaggagatggagaccgacatggacgtggccgacgtggccatggagagcagccccggcagcagcatcagcatggagcacagactggacgtggagctgagagccagcggcagcagcagcagcaccaacatcagcagcggccccagccccggccccagccccggcaccggccccggccccggccccggccccggccccggccccggccccggccccggccccggccccggccccggccccggccccggccccggccccggccccagacccggcgtgcagtgcatcccccagagagccgccctgctgaagagcatgctgaacttcctgaagaaggccatccaggaccccgccttcagcgacggcatcagacacgtgatggacggcagcctgcccaccagcctgaagcacatcatcagcaacgccgagtactag

SEQ ID NO: 84239 - DNA, 3594 bp, Artificial Sequence
  Description of Artificial Sequence: Synthetic coding sequence
tgacccagcggcagcaacgtggacaccctgctgagactgagaggcagactgctgctggaccacgaggccctgagctgcctgctggtgctgctgttcgtggacgagcccaagctgaacaccagcagactgcacagagtgctgagaaacctgtgctaccacgcccagaccagacactgggtgatcagaagcctgctgagcatcctgcagagaagcagcgagagcgagctgtgcatcgagacccccaagctgaccaccagcgaggagaagggcaagaagagcagcaagagctgcggcagcagcagccacgagaacagacccctggacctgctgcacaagatggagagcaagagcagcaaccagctgagctggctgagcgtgagcatggacgccgccctgggctgcagaaccaacatcttccagatccagagaagcggcggcagaaagcacaccgagaagcacgccagcggcggcagcaccgtgcacatccacccccaggccgcccccgtggtgtgcagacacgtgctggacaccctgatccagctggccaaggtgttccccagccacttcacccagcagagaaccaaggagaccaactgcgagagcgacagagagagaggcaacaaggcctgcagcccctgcagcagccagagcagcagcagcggcatctgcaccgacttctgggacctgctggtgaagctggacaacatgaacgtgagcagaaagggcaagaacagcgtgaagagcgtgcccgtgagcgccggcggcgagggcgagaccagcccctacagcctggaggccagccccctgggccagctgatgaacatgctgagccaccccgtgatcagaagaagcagcctgctgaccgagaagctgctgagactgctgagcctgatcagcatcgccctgcccgagaacaaggtgagcgaggcccaggccaacagcggcagcggcgccagcagcaccaccaccgccaccagcaccaccagcaccaccaccaccaccgccgccagcaccacccccaccccccccaccgcccccacccccgtgaccagcgcccccgccctggtggccgccaccgccatcagcaccatcgtggtggccgccagcaccaccgtgaccacccccaccaccgccaccaccaccgtgagcatcagccccaccaccaagggcagcaagagccccgccaaggtgagcgacggcggcagcagcagcaccgacttcaagatggtgagcagcggcctgaccgagaaccagctgcagctgagcgtggaggtgctgaccagccacagctgcagcgaggagggcctggaggacgccgccaacgtgctgctgcagctgagcagaggcgacagcggcaccagagacaccgtgctgaagctgctgctgaacggcgccagacacctgggctacaccctgtgcaagcagatcggcaccctgctggccgagctgagagagtacaacctggagcagcagagaagagcccagtgcgagaccctgagccccgacggcctgcccgaggagcagccccagaccaccaagctgaagggcaagatgcagagcagattcgacatggccgagaacgtggtgatcgtggccagccagaagagacccctgggcggcagagagctgcagctgcccagcatgagcatgctgaccagcaagaccagcacccagaagttcttcctgagagtgctgcaggtgatcatccagctgagagacgacaccagaagagccaacaagaaggccaagcagaccggcagactgggcagcagcggcctgggcagcgccagcagcatccaggccgccgtgagacagctggaggccgaggccgacgccatcatccagatgagcgagagcagccagagcgaggccagcgtgagaagagaggagagccccatggacgtggaccagcccagccccagcgcccaggacacccagagcatcgccagcgacggcaccccccagggcgagaaggagaaggaggagagaccccccgagctgcccctgctgagcgagcagctgagcctggacgagctgtgggacatgctgggcgagtgcctgaaggagctggaggagagccacgaccagcacgccgtgctggtgctgcagcccgccgtggaggccttcttcctggtgcacgccaccgagagagagagcaagccccccgtgagagacaccagagagagccagctggcccacatcaaggacgagcccccccccctgagccccgcccccctgacccccgccacccccagcagcctggaccccttcttcagcagagagcccagcagcatgcacatcagcagcagcctgccccccgacacccagaagttcctgagattcgccgagacccacagaaccgtgctgaaccagatcctgagacagagcaccacccacctggccgacggccccttcgccgtgctggtggactacatcagagtgctggacttcgacgtgaagagaaagtacttcagacaggagctggagagactggacgagggcctgagaaaggaggacatggccgtgcacgtgagaagagaccacgtgttcgaggacagctacagagagctgcacagaaagagccccgaggagatgaagaacagactgtacatcgtgttcgagggcgaggagggccaggacgccggcggcctgctgagagagtggtacatgatcatcagcagagagatgttcaaccccatgtacgccctgttcagaaccagccccggcgacagagtgacctacaccatcaaccccagcagccactgcaaccccaaccacctgagctacttcaagttcgtgggcagaatcgtggccaaggccgtgtacgacaacagactgctggagtgctacttcaccagaagcttctacaagcacatcctgggcaagagcgtgagatacaccgacatggagagcgaggactaccacttctaccagggcctggtgtacctgctggagaacgacgtgagcaccctgggctacgacctgaccttcagcaccgaggtgcaggagttcggcgtgtgcgaggtgagagacctgaagcccaacggcgccaacatcctggtgaccgaggagaacaagaaggagtacgtgcacctggtgtgccagatgagaatgaccggcgccatcagaaagcagctggccgccttcctggagggcttctacgagatcatccccaagagactgatcagcatcttcaccgagcaggagctggagctgctgatcagcggcctgcccaccatcgacatcgacgacctgaagagcaacaccgagtaccacaagtaccagagcaacagcatccagatccagtggttctggagagccctgagaagcttcgaccaggccgacagagccaagttcctgcagttcgtgaccggcaccagcaaggtgcccctgcagggcttcgccgccctggagggcatgaacggcatccagaagttccagatccacagagacgacagaagcaccgacagactgcccagcgcccacacctgcttcaaccagctggacctgcccgcctacgagagcttcgagaagctgagacacatgctgctgctggccatccaggagtgcagcgagggcttcggcctggcctag

SEQ ID NO: 84240 - DNA, 10227 bp, Artificial Sequence
  Description of Artificial Sequence: Synthetic coding sequence
tgaagcctgcccagcggctgcgagttcggccaggccgacatgcagaagctggtgcccaaggacgagaaggccgacggcgagcaggacggcgccgccggcagcatggacgccagcacccagggcctgctggagggcatcggcctggacggcgacaccctggcccccatggagaccgacgagcccaccgccagcgacagcaagggcaagagcaagatcacccccgccatggccgccagaatcaagcagatcaagcccctgctgagcgccagcagcagactgggcagagccctggccgagctgttcggcctgctggtgaagctgtgcgtgggcagccccgtgagacagagaagaagccaccacgccgccagcaccaccaccgcccccacccccgccgccagaagcaccgccagcgccctgaccaagctgctgaccaagggcctgagctggcagccccccccctacacccccacccccagattcagactgaccttcttcatctgcagcgtgggcttcaccagccccatgctgttcgacgagagaaagtacccctaccacctgatgctgcagaagttcctgtgcagcggcggccacaacgccctgttcgagaccttcaactgggccctgagcatgggcggcaaggtgcccgtgagcgagggcctggagcacagcgacctgcccgacggcaccggcgagttcctggacgcctggctgatgctggtggagaagatggtgaaccccaccaccgtgctggagagcccccacagcctgcccgccaagctgcccggcggcgtgcagaacttcccccagttcagcgccctgagattcctggtggtgacccagaaggccgccttcacctgcatcaagaacctgtggaacagaaagcccctgaaggtgtacggcggcagaatggccgagagcatgctggccatcctgtgccacatcctgagaggcgagcccgtgatcagagagagactgagcaaggagaaggagggcagcagaggcgaggaggacaccggccaggaggagggcggcagcagaagagagccccaggtgaaccagcagcagctgcagcagctgatggacatgggcttcaccagagagcacgccatggaggccctgctgaacaccagcaccatggagcaggccaccgagtacctgctgacccaccccccccccatcatgggcggcgtggtgagagacctgagcatgagcgaggaggaccagatgatgagagccatcgccatgagcctgggccaggacatccccatggaccagagagccgagagccccgaggaggtggcctgcagaaaggaggaggaggagagaaaggccagagagaagcaggaggaggaggaggccaagtgcctggagaagttccaggacgccgaccccctggagcaggacgagctgcacaccttcaccgacaccatgctgcccggctgcttccacctgctggacgagctgcccgacaccgtgtacagagtgtgcgacctgatcatgaccgccatcaagagaaacggcgccgactacagagacatgatcctgaagcaggtggtgaaccaggtgtgggaggccgccgacgtgctgatcaaggccgccctgcccctgaccaccagcgacaccaagaccgtgagcgagtggatcagccagatggccaccctgccccaggccagcaacctggccaccagaatcctgctgctgaccctgctgttcgaggagctgaagctgccctgcgcctgggtggtggagagcagcggcatcctgaacgtgctgatcaagctgctggaggtggtgcagccctgcctgcaggccgccaaggagcagaaggaggtgcagacccccaagtggatcacccccgtgctgctgctgatcgacttctacgagaagaccgccatcagcagcaagagaagagcccagatgaccaagtacctgcagagcaacagcaacaactggagatggttcgacgacagaagcggcagatggtgcagctacagcgccagcaacaacagcaccatcgacagcgcctggaagagcggcgagaccagcgtgagattcaccgccggcagaagaagatacaccgtgcagttcaccaccatggtgcaggtgaacgaggagaccggcaacagaagacccgtgatgctgaccctgctgagagtgcccagactgaacaagaacagcaagaacagcaacggccaggagctggagaagaccctggaggagagcaaggagatggacatcaagagaaaggagaacaagggcaacgacacccccctggccctggagagcaccaacaccgagaaggagaccagcctggaggagaccaagatcggcgagatcctgatccagggcctgaccgaggacatggtgaccgtgctgatcagagcctgcgtgagcatgctgggcgtgcccgtggaccccgacaccctgcacgccaccctgagactgtgcctgagactgaccagagaccacaagtacgccatgatgttcgccgagctgaagagcaccagaatgatcctgaacctgacccagagcagcggcttcaacggcttcacccccctggtgaccctgctgctgagacacatcatcgaggacccctgcaccctgagacacaccatggagaaggtggtgagaagcgccgccaccagcggcgccggcagcaccaccagcggcgtggtgagcggcagcctgggcagcagagagatcaactacatcctgagagtgctgggccccgccgcctgcagaaaccccgacatcttcaccgaggtggccaactgctgcatcagaatcgccctgcccgcccccagaggcagcggcaccgccagcgacgacgagttcgagaacctgagaatcaagggccccaacgccgtgcagctggtgaagaccacccccctgaagcccagccccctgcccgtgatccccgacaccatcaaggaggtgatctacgacatgctgaacgccctggccgcctaccacgcccccgaggaggccgacaagagcgaccccaagcccggcgtgatgacccaggaggtgggccagctgctgcaggacatgggcgacgacgtgtaccagcagtacagaagcctgaccagacagagcagcgacttcgacacccagagcggcttcagcatcaacagccaggtgttcgccgccgacggcgccagcaccgagaccagcgccagcggcaccagccagggcgaggccagcacccccgaggagagcagagacggcaagaaggacaaggagggcgacagagccagcgaggagggcaagcagaagggcaagggcagcaagcccctgatgcccaccagcaccatcctgagactgctggccgagctggtgagaagctacgtgggcatcgccaccctgatcgccaactacagctacaccgtgggccagagcgagctgatcaaggaggactgcagcgtgctggccttcgtgctggaccacctgctgccccacacccagaacgccgaggacaaggacacccccgccctggccagactgttcctggccagcctggccgccgccggcagcggcaccgacgcccaggtggccctggtgaacgaggtgaaggccgccctgggcagagccctggccatggccgagagcaccgagaagcacgccagactgcaggccgtgatgtgcatcatcagcaccatcatggagagctgccccagcaccagcagcttctacagcagcgccaccgccaagacccagcacaacggcatgaacaacatcatcagactgttcctgaagaagggcctggtgaacgacctggccagagtgccccacagcctggacctgagcagccccaacatggccaacaccgtgaacgccgccctgaagcccctggagaccctgagcagaatcgtgaaccagcccagcagcctgttcggcagcaagagcgccagcagcaagaacaagagcgagcaggacgcccagggcgccagccaggacagcagcagcaaccagcaggaccccggcgagcccggcgaggccgaggtgcaggaggaggaccacgacgtgacccagaccgaggtggccgacggcgacatcatggacggcgaggccgagaccgacagcgtggtgatcgccggccagcccgaggtgctgagcagccaggagatgcaggtggagaacgagctggaggacctgatcgacgagctgctggagagagacggcggcagcggcaacagcaccatcatcgtgagcagaagcggcgaggacgagagccaggaggacgtgctgatggacgaggcccccagcaacctgagccaggccagcaccctgcaggccaacagagaggacagcatgaacatcctggaccccgaggacgaggaggagcacacccaggaggaggacagcagcggcagcaacgaggacgaggacgacagccaggacgaggaggaggaggaggaggaggacgaggaggacgaccaggaggacgacgagggcgaggagggcgacgaggacgacgacgacgacggcagcgagatggagctggacgaggactaccccgacatgaacgccagccccctggtgagattcgagagattcgacagagaggacgacctgatcatcgagttcgacaacatgttcagcagcgccaccgacatcccccccagccccggcaacatccccaccacccaccccctgatggtgagacacgccgaccacagcagcctgaccctgggcagcggcagcagcaccaccagactgacccagggcatcggcagaagccagagaaccctgagacagctgaccgccaacaccggccacaccatccacgtgcactaccccggcaacagacagcccaacccccccctgatcctgcagagactgctgggccccagcgccgccgccgacatcctgcagctgagcagcagcctgcccctgcagagcagaggcagagccagactgctggtgggcaacgacgacgtgcacatcatcgccagaagcgacgacgagctgctggacgacttcttccacgaccagagcaccgccaccagccaggccggcaccctgagcagcatccccaccgccctgaccagatggaccgaggagtgcaaggtgctggacgccgagagcatgcacgactgcgtgagcgtggtgaaggtgagcatcgtgaaccacctggagttcctgagagacgaggagctggaggagagaagagagaagagaagaaagcagctggccgaggaggagaccaagatcaccgacaagggcaaggaggacaaggagaacagagaccagagcgcccagtgcaccgccagcaagagcaacgacagcaccgagcagaacctgagcgacggcacccccatgcccgacagctaccccaccacccccagcagcaccgacgccgccaccagcgagagcaaggagaccctgggcaccctgcagagcagccagcagcagcccaccctgcccaccccccccgccctgggcgaggtgccccaggagctgcagagccccgccggcgagggcggcagcagcacccagctgctgatgcccgtggagcccgaggagctgggccccaccagacccagcggcgaggccgagaccacccagatggagctgagccccgcccccaccatcaccagcctgagccccgagagagccgaggacagcgacgccctgaccgccgtgagcagccagctggagggcagccccatggacaccagcagcctggccagctgcaccctggaggaggccgtgggcgacaccagcgccgccggcagcagcgagcagcccagagccggcagcagcacccccggcgacgccccccccgccgtggccgaggtgcagggcagaagcgacggcagcggcgagagcgcccagccccccgaggacagcagcccccccgccagcagcgagagcagcagcaccagagacagcgccgtggccatcagcggcgccgacagcagaggcatcctggaggagcccctgcccagcaccagcagcgaggaggaggaccccctggccggcatcagcctgcccgagggcgtggaccccagcttcctggccgccctgcccgacgacatcagaagagaggtgctgcagaaccagctgggcatcagaccccccaccagaaccgcccccagcaccaacagcagcgcccccgccgtggtgggcaaccccggcgtgaccgaggtgagccccgagttcctggccgccctgccccccgccatccaggaggaggtgctggcccagcagagagccgagcagcagagaagagagctggcccagaacgccagcagcgacacccccatggaccccgtgaccttcatccagaccctgcccagcgacctgagaagaagcgtgctggaggacatggaggacagcgtgctggccgtgatgccccccgacatcgccgccgaggcccaggccctgagaagagagcaggaggccagacagagacagctgatgcacgagagactgttcggccacagcagcaccagcgccctgagcgccatcctgagaagccccgccttcaccagcagactgagcggcaacagaggcgtgcagtacaccagactggccgtgcagagaggcggcaccttccagatgggcggcagcagcagccacaacagacccagcggcagcaacgtggacaccctgctgagactgagaggcagactgctgctggaccacgaggccctgagctgcctgctggtgctgctgttcgtggacgagcccaagctgaacaccagcagactgcacagagtgctgagaaacctgtgctaccacgcccagaccagacactgggtgatcagaagcctgctgagcatcctgcagagaagcagcgagagcgagctgtgcatcgagacccccaagctgaccaccagcgaggagaagggcaagaagagcagcaagagctgcggcagcagcagccacgagaacagacccctggacctgctgcacaagatggagagcaagagcagcaaccagctgagctggctgagcgtgagcatggacgccgccctgggctgcagaaccaacatcttccagatccagagaagcggcggcagaaagcacaccgagaagcacgccagcggcggcagcaccgtgcacatccacccccaggccgcccccgtggtgtgcagacacgtgctggacaccctgatccagctggccaaggtgttccccagccacttcacccagcagagaaccaaggagaccaactgcgagagcgacagagagagaggcaacaaggcctgcagcccctgcagcagccagagcagcagcagcggcatctgcaccgacttctgggacctgctggtgaagctggacaacatgaacgtgagcagaaagggcaagaacagcgtgaagagcgtgcccgtgagcgccggcggcgagggcgagaccagcccctacagcctggaggccagccccctgggccagctgatgaacatgctgagccaccccgtgatcagaagaagcagcctgctgaccgagaagctgctgagactgctgagcctgatcagcatcgccctgcccgagaacaaggtgagcgaggcccaggccaacagcggcagcggcgccagcagcaccaccaccgccaccagcaccaccagcaccaccaccaccaccgccgccagcaccacccccaccccccccaccgcccccacccccgtgaccagcgcccccgccctggtggccgccaccgccatcagcaccatcgtggtggccgccagcaccaccgtgaccacccccaccaccgccaccaccaccgtgagcatcagccccaccaccaagggcagcaagagccccgccaaggtgagcgacggcggcagcagcagcaccgacttcaagatggtgagcagcggcctgaccgagaaccagctgcagctgagcgtggaggtgctgaccagccacagctgcagcgaggagggcctggaggacgccgccaacgtgctgctgcagctgagcagaggcgacagcggcaccagagacaccgtgctgaagctgctgctgaacggcgccagacacctgggctacaccctgtgcaagcagatcggcaccctgctggccgagctgagagagtacaacctggagcagcagagaagagcccagtgcgagaccctgagccccgacggcctgcccgaggagcagccccagaccaccaagctgaagggcaagatgcagagcagattcgacatggccgagaacgtggtgatcgtggccagccagaagagacccctgggcggcagagagctgcagctgcccagcatgagcatgctgaccagcaagaccagcacccagaagttcttcctgagagtgctgcaggtgatcatccagctgagagacgacaccagaagagccaacaagaaggccaagcagaccggcagactgggcagcagcggcctgggcagcgccagcagcatccaggccgccgtgagacagctggaggccgaggccgacgccatcatccagatggtgagagagggccagagagccagaagacagcagcaggccgccaccagcgagagcagccagagcgaggccagcgtgagaagagaggagagccccatggacgtggaccagcccagccccagcgcccaggacacccagagcatcgccagcgacggcaccccccagggcgagaaggagaaggaggagagaccccccgagctgcccctgctgagcgagcagctgagcctggacgagctgtgggacatgctgggcgagtgcctgaaggagctggaggagagccacgaccagcacgccgtgctggtgctgcagcccgccgtggaggccttcttcctggtgcacgccaccgagagagagagcaagccccccgtgagagacaccagagagagccagctggcccacatcaaggacgagcccccccccctgagccccgcccccctgacccccgccacccccagcagcctggaccccttcttcagcagagagcccagcagcatgcacatcagcagcagcctgccccccgacacccagaagttcctgagattcgccgagacccacagaaccgtgctgaaccagatcctgagacagagcaccacccacctggccgacggccccttcgccgtgctggtggactacatcagagtgctggacttcgacgtgaagagaaagtacttcagacaggagctggagagactggacgagggcctgagaaaggaggacatggccgtgcacgtgagaagagaccacgtgttcgaggacagctacagagagctgcacagaaagagccccgaggagatgaagaacagactgtacatcgtgttcgagggcgaggagggccaggacgccggcggcctgctgagagagtggtacatgatcatcagcagagagatgttcaaccccatgtacgccctgttcagaaccagccccggcgacagagtgacctacaccatcaaccccagcagccactgcaaccccaaccacctgagctacttcaagttcgtgggcagaatcgtggccaaggccgtgtacgacaacagactgctggagtgctacttcaccagaagcttctacaagcacatcctgggcaagagcgtgagatacaccgacatggagagcgaggactaccacttctaccagggcctggtgtacctgctggagaacgacgtgagcaccctgggctacgacctgaccttcagcaccgaggtgcaggagttcggcgtgtgcgaggtgagagacctgaagcccaacggcgccaacatcctggtgaccgaggagaacaagaaggagtacgtgcacctggtgtgccagatgagaatgaccggcgccatcagaaagcagctggccgccttcctggagggcttctacgagatcatccccaagagactgatcagcatcttcaccgagcaggagctggagctgctgatcagcggcctgcccaccatcgacatcgacgacctgaagagcaacaccgagtaccacaagtaccagagcaacagcatccagatccagtggttctggagagccctgagaagcttcgaccaggccgacagagccaagttcctgcagttcgtgaccggcaccagcaaggtgcccctgcagggcttcgccgccctggagggcatgaacggcatccagaagttccagatccacagagacgacagaagcaccgacagactgcccagcgcccacacctgcttcaaccagctggacctgcccgcctacgagagcttcgagaagctgagacacatgctgctgctggccatccaggagtgcagcgagggcttcggcctggcctag

SEQ ID NO: 84241 - DNA, 651 bp, Artificial Sequence
  Description of Artificial Sequence: Synthetic coding sequence
atgaaggtggacagaaccaagctgaagaagacccccaccgaggcccccgccgactgcagagccctgatcgacaagctgaaggtgtgcaacgacgagcagctgctgctggagctgcagcagatcaagacctggaacatcggcaagtgcgagctgtaccactgggtggacctgctggacagattcgacggcatcctggccgacgccggccagaccgtggagaacatgagctggatgctggtgtgcgacagacccgagagagagcagctgaagatgctgctgctggccgtgctgaacttcaccgccctgctgatcgagtacagcttcagcagacacctgtacagcagcatcgagcacctgaccaccctgctggccagcagcgacatgcaggtggtgctggccgtgctgaacctgctgtacgtgttcagcaagagaagcaactacatcaccagactgggcagcgacaagagaacccccctgctgaccagactgcagcacctggccgagagctggggcggcaaggagaacggcttcggcctggccgagtgctgcagagacctgcacatgatgaagtacccccccagcgccaccaccctgcacttcgagttctacgccgaccccggcgccgaggtgaagatcgagaagagaaagtag

SEQ ID NO: 84242 - DNA, 282 bp, Artificial Sequence
  Description of Artificial Sequence: Synthetic coding sequence
atgaaggtggacagaaccaagctgaagaagacccccaccgaggcccccgccgactgcagagccctgatcgacaagctgaaggtgtgcaacgacgagcagctgctgctggagctgcagcagatcaagacctggaacatcggcaagtgcgagctgtaccactgggtggacctgctggacagattcgacggcatcctggccgacgccggccagaccgtggagaacatgagctggatgctggtgtgcgacagacccgagagagagcagctgaagatgctgctgtag

SEQ ID NO: 84243 - DNA, 1482 bp, Artificial Sequence
  Description of Artificial Sequence: Synthetic coding sequence
atgctgcccagatgggagctggccctgtacctgctggccagcctgggcttccacttctacagcttctacgaggtgtacaaggtgagcagagagcacgaggaggagctggaccaggagttcgagctggagaccgacaccctgttcggcggcctgaagaaggacgccaccgacttcgagtggagcttctggatggagtggggcaagcagtggctggtgtggctgctgctgggccacatggtggtgagccagatggccaccctgctggccagaaagcacagaccctggatcctgatgctgtacggcatgtgggcctgctggtgcgtgctgggcacccccggcgtggccatggtgctgctgcacaccaccatcagcttctgcgtggcccagttcagaagccagctgctgacctggctgtgcagcctgctgctgctgagcaccctgagactgcagggcgtggaggaggtgaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84244 - DNA, 1347 bp, Artificial Sequence
  Description of Artificial Sequence: Synthetic coding sequence
atgaagttcaccaagagccccgaggacgccaccgacttcgagtggagcttctggatggagtggggcaagcagtggctggtgtggctgctgctgggccacatggtggtgagccagatggccaccctgctggccagaaagcacagaccctggatcctgatgctgtacggcatgtgggcctgctggtgcgtgctgggcacccccggcgtggccatggtgctgctgcacaccaccatcagcttctgcgtggcccagttcagaagccagctgctgacctggctgtgcagcctgctgctgctgagcaccctgagactgcagggcgtggaggaggtgaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84245 - DNA, 552 bp, Artificial Sequence
  Description of Artificial Sequence: Synthetic coding sequence
atgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84246 - DNA, 1482 bp, Artificial Sequence; identical to SEQ ID NO: 84243
  Description of Artificial Sequence: Synthetic coding sequence

SEQ ID NO: 84247 - DNA, 1557 bp, Artificial Sequence
  Description of Artificial Sequence: Synthetic coding sequence
atgctgcccagatgggagctggccctgtacctgctggccagcctgggcttccacttctacagcttctacgaggtgtacaaggtgagcagagagcacgaggaggagctggaccaggagttcgagctggagaccgacaccctgttcggcggcctgaagaaggacgccaccgacttcgagtggagcttctggatggagtggggcaagcagtggctggtgtggctgctgctgggccacatggtggtgagccagatggccaccctgctggccagaaagcacagaccctggatcctgatgctgtacggcatgtgggcctgctggtgcgtgctgggcacccccggcgtggccatggtgctgctgcacaccaccatcagcttctgcgtggcccagttcagaagccagctgctgacctggctgtgcagcctgctgctgctgagcaccctgagactgcagggcgtggaggaggtgaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggcggcctgttcctgttcttcctgctgaacccctgctgggagaccgccttccagggcttccccgtgttcctgcacttcctgcagaccgaggtgctggccaccttcgtgcccaactacttcagctggaacatctgcatcgagaacaccagcgagctgagcagctactag

SEQ ID NO: 84248 - DNA, 1482 bp, Artificial Sequence; identical to SEQ ID NO: 84243
  Description of Artificial Sequence: Synthetic coding sequence

SEQ ID NO: 84249 - DNA, 624 bp, Artificial Sequence
  Description of Artificial Sequence: Synthetic coding sequence
atggagtggggcaagcagtggctggtgtggctgctgctgggccacatggtggtgagccagatggccaccctgctggccagaaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggtag

SEQ ID NO: 84250 - DNA, 1287 bp, Artificial Sequence
  Description of Artificial Sequence: Synthetic coding sequence
atgctgcccagatgggagctggccctgtacctgctggccagcctgggcttccacttctacagcttctacgaggtgtacaaggtgagcagagagcacgaggaggagctggaccaggagttcgagctggagaccgacaccctgttcggcggcctgaagaaggacgccaccgacttcgagtggagcttctggatggagtggggcaagcagtggctggtgtggctgctgctgggccacatggtggtgagccagatggccaccctgctggccagaaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84251 - DNA, 1071 bp, Artificial Sequence
  Description of Artificial Sequence: Synthetic coding sequence
atgctgcccagatgggagctggccctgtacctgctggccagcctgggcttccacttctacagcttctacgaggtgtacaaggtgagcagagagcacgaggaggagctggaccaggagttcgagctggagaccgacaccctgttcggcggcctgaagaaggacgccaccgacttcgagtggagcttctggatggagtggggcaagcagtggctggtgtggctgctgctgggccacatggtggtgagccagatggccaccctgctggccagaaagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84252 - DNA, 1485 bp, Artificial Sequence
  Description of Artificial Sequence: Synthetic coding sequence
atgagcctgggcctgggcagcgccgagagaggcgtgctgggcaccagaggcgccagagagagatgcagaagaagaagacccggccagcccggcgagcacgaggaggagctggaccaggagttcgagctggagaccgacaccctgttcggcggcctgaagaaggacgccaccgacttcgagtggagcttctggatggagtggggcaagcagtggctggtgtggctgctgctgggccacatggtggtgagccagatggccaccctgctggccagaaagcacagaccctggatcctgatgctgtacggcatgtgggcctgctggtgcgtgctgggcacccccggcgtggccatggtgctgctgcacaccaccatcagcttctgcgtggcccagttcagaagccagctgctgacctggctgtgcagcctgctgctgctgagcaccctgagactgcagggcgtggaggaggtgaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84253 - DNA, 1293 bp, Artificial Sequence
  Description of Artificial Sequence: Synthetic coding sequence
atggagtggggcaagcagtggctggtgtggctgctgctgggccacatggtggtgagccagatggccaccctgctggccagaaagcacagaccctggatcctgatgctgtacggcatgtgggcctgctggtgcgtgctgggcacccccggcgtggccatggtgctgctgcacaccaccatcagcttctgcgtggcccagttcagaagccagctgctgacctggctgtgcagcctgctgctgctgagcaccctgagactgcagggcgtggaggaggtgaagagaagatggtacaagaccgagaacgagtactacctgctgcagttcaccctgaccgtgagatgcctgtactacaccagcttcagcctggagctgtgctggcagcagctgcccgccgccagcaccagctacagcttcccctggatgctggcctacgtgttctactaccccgtgctgcacaacggccccatcctgagcttcagcgagttcatcaagcagatgcagcagcaggagcacgacagcctgaaggccagcctgtgcgtgctggccctgggcctgggcagactgctgtgctggtggtggctggccgagctgatggcccacctgatgtacatgcacgccatctacagcagcatccccctgctggagaccgtgagctgctggaccctgggcggcctggccctggcccaggtgctgttcttctacgtgaagtacctggtgctgttcggcgtgcccgccctgctgatgagactggacggcctgaccccccccgccctgcccagatgcgtgagcaccatgttcagcttcaccggcatgtggagatacttcgacgtgggcctgcacaacttcctgatcagatacgtgtacatccccgtgggcggcagccagcacggcctgctgggcaccctgttcagcaccgccatgaccttcgccttcgtgagctactggcacggcggctacgactacctgtggtgctgggccgccctgaactggctgggcgtgaccgtggagaacggcgtgagaagactggtggagaccccctgcatccaggacagcctggccagatacttcagcccccaggccagaagaagattccacgccgccctggccagctgcagcaccagcatgctgatcctgagcaacctggtgttcctgggcggcaacgaggtgggcaagacctactggaacagaatcttcatccagggctggccctgggtgaccctgagcgtgctgggcttcctgtactgctacagccacgtgggcatcgcctgggcccagacctacgccaccgactag

SEQ ID NO: 84254 - DNA, 2103 bp, Artificial Sequence
  Description of Artificial Sequence: Synthetic coding sequence
atgctgaagatgctgagcttcaagctgctgctgctggccgtggccctgggcttcttcgagggcgacgccaagttcggcgagagaaacgagggcagcggcgccagaagaagaagatgcctgaacggcaacccccccaagagactgaagagaagagacagaagaatgatgagccagctggagctgctgagcggcggcgagatgctgtgcggcggcttctaccccagactgagctgctgcctgagaagcgacagccccggcctgggcagactggagaacaagatcttcagcgtgaccaacaacaccgagtgcggcaagctgctggaggagatcaagtgcgccctgtgcagcccccacagccagagcctgttccacagccccgagagagaggtgctggagagagacctggtgctgcccctgctgtgcaaggactactgcaaggagttcttctacacctgcagaggccacatccccggcttcctgcagaccaccgccgacgagttctgcttctactacgccagaaaggacggcggcctgtgcttccccgacttccccagaaagcaggtgagaggccccgccagcaactacctggaccagatggaggagtacgacaaggtggaggagatcagcagaaagcacaagcacaactgcttctgcatccaggaggtggtgagcggcctgagacagcccgtgggcgccctgcacagcggcgacggcagccagagactgttcatcctggagaaggagggctacgtgaagatcctgacccccgagggcgagatcttcaaggagccctacctggacatccacaagctggtgcagagcggcatcaagggcggcgacgagagaggcctgctgagcctggccttccaccccaactacaagaagaacggcaagctgtacgtgagctacaccaccaaccaggagagatgggccatcggcccccacgaccacatcctgagagtggtggagtacaccgtgagcagaaagaacccccaccaggtggacctgagaaccgccagagtgttcctggaggtggccgagctgcacagaaagcacctgggcggccagctgctgttcggccccgacggcttcctgtacatcatcctgggcgacggcatgatcaccctggacgacatggaggagatggacggcctgagcgacttcaccggcagcgtgctgagactggacgtggacaccgacatgtgcaacgtgccctacagcatccccagaagcaacccccacttcaacagcaccaaccagccccccgaggtgttcgcccacggcctgcacgaccccggcagatgcgccgtggacagacaccccaccgacatcaacatcaacctgaccatcctgtgcagcgacagcaacggcaagaacagaagcagcgccagaatcctgcagatcatcaagggcaaggactacgagagcgagcccagcctgctggagttcaagcccttcagcaacggccccctggtgggcggcttcgtgtacagaggctgccagagcgagagactgtacggcagctacgtgttcggcgacagaaacggcaacttcctgaccctgcagcagagccccgtgaccaagcagtggcaggagaagcccctgtgcctgggcaccagcggcagctgcagaggctacttcagcggccacatcctgggcttcggcgaggacgagctgggcgaggtgtacatcctgagcagcagcaagagcatgacccagacccacaacggcaagctgtacaagatcgtggaccccaagagacccctgatgcccgaggagtgcagagccaccgtgcagcccgcccagaccctgaccagcgagtgcagcagactgtgcagaaacggctactgcacccccaccggcaagtgctgctgcagccccggctgggagggcgacttctgcagaaccgccaagtgcgagcccgcctgcagacacggcggcgtgtgcgtgagacccaacaagtgcctgtgcaagaagggctacctgggcccccagtgcgagcaggtggacagaaacatcagaagagtgaccagagccggcatcctggaccagatcatcgacatgaccagctacctgctggacctgaccagctacatcgtgtag

SEQ ID NO: 84255 - DNA, 963 bp, Artificial Sequence
  Description of Artificial Sequence: Synthetic coding sequence
atgctgaagatgctgagcttcaagctgctgctgctggccgtggccctgggcttcttcgagggcgacgccaagttcggcgagagaaacgagggcagcggcgccagaagaagaagatgcctgaacggcaacccccccaagagactgaagagaagagacagaagaatgatgagccagctggagctgctgagcggcggcgagatgctgtgcggcggcttctaccccagactgagctgctgcctgagaagcgacagccccggcctgggcagactggagaacaagatcttcagcgtgaccaacaacaccgagtgcggcaagctgctggaggagatcaagtgcgccctgtgcagcccccacagccagagcctgttccacagccccgagagagaggtgctggagagagacctggtgctgcccctgctgtgcaaggactactgcaaggagttcttctacacctgcagaggccacatccccggcttcctgcagaccaccgccgacgagttctgcttctactacgccagaaaggacggcggcctgtgcttccccgacttccccagaaagcaggtgagaggccccgccagcaactacctggaccagatggaggagtacgacaaggtggaggagatcagcagaaagcacaagcacaactgcttctgcatccaggaggtggtgagcggcctgagacagcccgtgggcgccctgcacagcggcgacggcagccagagactgttcatcctggagaaggagggctacgtgaagatcctgacccccgagggcgagatcttcaaggagccctacctggacatccacaagctggtgcagagcggcatcaaggtgggcttcctgaacttcatctacttctgcgccggctacgtgaacttcatcctggtgctgcccagcagcctgaaggtgttcctgtgcaacaagagaaagaacctggccggcgagaacaagggcgccacctag

SEQ ID NO: 84256 - DNA, 4146 bp, Artificial Sequence
  Description of Artificial Sequence: Synthetic coding sequence
atggccagccccagagccagcagatggcccccccccctgctgctgctgctgctgcccctgctgctgctgccccccgccgcccccggcaccagagaccccccccccagccccgccagaagagccctgagcctggcccccctggccggcgccggcctggagctgcagctggagagaagacccgagagagagcccccccccaccccccccagagagagaagaggccccgccacccccggccccagctacagagcccccgagcccggcgccgccacccagagaggccccagcggcagagcccccagaggcggcagcgccgacgccgcctggaagcactggcccgagagcaacaccgaggcccacgtggagaacatcaccttctaccagaaccaggaggacttcagcaccgtgagcagcaaggagggcgtgatggtgcagaccagcggcaagagccacgccgccagcgacgcccccgagaacctgaccctgctggccgagaccgccgacgccagaggcagaagcggcagcagcagcagaaccaacttcaccatcctgcccgtgggctacagcctggagatcgccaccgccctgaccagccagagcggcaacctggccagcgagagcctgcacctgcccagcagcagcagcgagttcgacgagagaatcgccgccttccagaccaagagcggcaccgccagcgagatgggcaccgagagagccatgggcctgagcgaggagtggaccgtgcacagccaggaggccaccaccagcgcctggagccccagcttcctgcccgccctggagatgggcgagctgaccacccccagcagaaagagaaacagcagcggccccgacctgagctggctgcacttctacagaaccgccgccagcagccccctgctggacctgagcagcagcagcgagagcaccgagaagctgaacaacagcaccggcctgcagagcagcagcgtgagccagaccaagaccatgcacgtggccaccgtgttcaccgacggcggccccagaaccctgagaagcctgaccgtgagcctgggccccgtgagcaagaccgagggcttccccaaggacagcagaatcgccaccaccagcagcagcgtgctgctgagccccagcgccgtggagagcagaagaaacagcagagtgaccggcaaccccggcgacgaggagttcatcgagcccagcaccgagaacgagttcggcctgaccagcctgagatggcagaacgacagccccaccttcggcgagcaccagctggccagcagcagcgaggtgcagaacggcagccccatgagccagaccgagaccgtgagcagaagcgtggcccccatgagaggcggcgagatcaccgcccactggctgctgaccaacagcaccaccagcgccgacgtgaccggcagcagcgccagctaccccgagggcgtgaacgccagcgtgctgacccagttcagcgacagcaccgtgcagagcggcggcagccacaccgccctgggcgacagaagctacagcgagagcagcagcaccagcagcagcgagagcctgaacagcagcgcccccagaggcgagagaagcatcgccggcatcagctacggccaggtgagaggcaccgccatcgagcagagaaccagcagcgaccacaccgaccacacctacctgagcagcaccttcaccaagggcgagagagccctgctgagcatcaccgacaacagcagcagcagcgacatcgtggagagcagcaccagctacatcaagatcagcaacagcagccacagcgagtacagcagcttcttccacgcccagaccgagagaagcaacatcagcagctacgacggcgagtacgcccagcccagcaccgagagccccgtgctgcacaccagcaacctgcccagctacacccccaccatcaacatgcccaacaccagcgtggtgctggacaccgacgccgagttcgtgagcgacagcagcagcagcagcagcagcagcagcagcagcagcagcagcggcccccccctgcccctgcccagcgtgagccagagccaccacctgttcagcagcatcctgcccagcaccagagccagcgtgcacctgctgaagagcaccagcgacgccagcaccccctggagcagcagccccagccccctgcccgtgagcctgaccaccagcaccagcgcccccctgagcgtgagccagaccaccctgccccagagcagcagcacccccgtgctgcccagagccagagagacccccgtgaccagcttccagaccagcaccatgaccagcttcatgaccatgctgcacagcagccagaccgccgacctgaagagccagagcaccccccaccaggagaaggtgatcaccgagagcaagagccccagcctggtgagcctgcccaccgagagcaccaaggccgtgaccaccaacagccccctgccccccagcctgaccgagagcagcaccgagcagaccctgcccgccaccagcaccaacctggcccagatgagccccaccttcaccaccaccatcctgaagaccagccagcccctgatgaccacccccggcaccctgagcagcaccgccagcctggtgaccggccccatcgccgtgcagaccaccgccggcaagcagctgagcctgacccaccccgagatcctggtgccccagatcagcaccgagggcggcatcagcaccgagagaaacagagtgatcgtggacgccaccaccggcctgatccccctgaccagcgtgcccaccagcgccaaggagatgaccaccaagctgggcgtgaccgccgagtacagccccgccagcagaagcctgggcaccagccccagcccccagaccaccgtggtgagcaccgccgaggacctggcccccaagagcgccaccttcgccgtgcagagcagcacccagagccccaccaccgtgagcagcagcgccagcgtgaacagctgcgccgtgaacccctgcctgcacaacggcgagtgcgtggccgacaacaccagcagaggctaccactgcagatgcccccccagctggcagggcgacgactgcagcgtggacgtgaacgagtgcctgagcaacccctgccccagcaccgccatgtgcaacaacacccagggcagcttcatctgcaagtgccccgtgggctaccagctggagaagggcatctgcaacctggtgagaaccttcgtgaccgagttcaagctgaagagaaccttcctgaacaccaccgtggagaagcacagcgacctgcaggaggtggagaacgagatcaccaagaccctgaacatgtgcttcagcgccctgcccagctacatcagaagcaccgtgcacgccagcagagagagcaacgccgtggtgatcagcctgcagaccaccttcagcctggccagcaacgtgaccctgttcgacctggccgacagaatgcagaagtgcgtgaacagctgcaagagcagcgccgaggtgtgccagctgctgggcagccagagaagaatcttcagagccggcagcctgtgcaagagaaagagccccgagtgcgacaaggacaccagcatctgcaccgacctggacggcgtggccctgtgccagtgcaagagcggctacttccagttcaacaagatggaccacagctgcagagcctgcgaggacggctacagactggagaacgagacctgcatgagctgccccttcggcctgggcggcctgaactgcggcaacccctaccagctgatcaccgtggtgatcgccgccgccggcggcggcctgctgctgatcctgggcatcgccctgatcgtgacctgctgcagaaagaacaagaacgacatcagcaagctgatcttcaagagcggcgacttccagatgagcccctacgccgagtaccccaagaaccccagaagccaggagtggggcagagaggccatcgagatgcacgagaacggcagcaccaagaacctgctgcagatgaccgacgtgtactacagccccaccagcgtgagaaaccccgagctggagagaaacggcctgtaccccgcctacaccggcctgcccggcagcagacacagctgcatcttccccggccagtacaaccccagcttcatcagcgacgagagcagaagaagagactacttctag

SEQ ID NO: 84257 - DNA, 5829 bp, Artificial Sequence
  Description of Artificial Sequence: Synthetic coding sequence
atggaggacagaagagccgagaagagctgcgagcaggcctgcgagagcctgaagagacaggactacgagatggccctgaagcactgcaccgaggccctgctgagcctgggccagtacagcatggccgacttcaccggcccctgccccctggagatcgagagaatcaagatcgagagcctgctgtacagaatcgccagcttcctgcagctgaagaactacgtgcaggccgacgaggactgcagacacgtgctgggcgagggcctggccaagggcgaggacgccttcagagccgtgctgtgctgcatgcagctgaagggcaagctgcagcccgtgagcaccatcctggccaagagcctgaccggcgagagcctgaacggcatggtgaccaaggacctgaccagactgaagaccctgctgagcgagaccgagaccgccaccagcaacgccctgagcggctaccacgtggaggacctggacgagggcagctgcaacggctggcacttcagacccccccccagaggcatcaccagcagcgaggagtacaccctgtgcaagagattcctggagcagggcatctgcagatacggcgcccagtgcaccagcgcccacagccaggaggagctggccgagtggcagaagagatacgccagcagactgatcaagctgaagcagcagaacgagaacaagcagctgagcggcagctacatggagaccctgatcgagaagtggatgaacagcctgagccccgagaaggtgctgagcgagtgcatcgagggcgtgaaggtggagcacaaccccgacctgagcgtgaccgtgagcaccaagaagagccaccagacctggaccttcgccctgacctgcaagcccgccagaatgctgtacagagtggccctgctgtacgacgcccacagaccccacttcagcatcatcgccatcagcgccggcgacagcaccacccaggtgagccaggaggtgcccgagaactgccaggagtggatcggcggcaagatggcccagaacggcctggaccactacgtgtacaaggtgggcatcgccttcaacaccgagatcttcggcaccttcagacagaccatcgtgttcgacttcggcctggagcccgtgctgatgcagagagtgatgatcgacgccgccagcaccgaggacctggagtacctgatgcacgccaagcagcagctggtgaccaccgccaagagatgggacagcagcagcaagaccatcatcgacttcgagcccaacgagaccaccgacctggagaagagcctgctgatcagataccagatccccctgagcgccgaccagctgttcacccagagcgtgctggacaagagcctgaccaagagcaactaccagagcagactgcacgacctgctgtacatcgaggagatcgcccagtacaaggagatcagcaagttcaacctgaaggtgcagctgcagatcctggccagcttcatgctgaccggcgtgagcggcggcgccaagtacgcccagaacggccagctgttcggcagattcaagctgaccgagaccctgagcgaggacaccctggccggcagactggtgatgaccaaggtgaacgccgtgtacctgctgcccgtgcccaagcagaagctggtgcagacccagggcaccaaggagaaggtgtacgaggccaccatcgaggagaagaccaaggagtacatcttcctgagactgagcagagagtgctgcgaggagctgaacctgagacccgactgcgacacccaggtggagctgcagttccagctgaacagactgcccctgtgcgagatgcactacgccctggacagaatcaaggacaacggcgtgctgttccccgacatcagcatgacccccaccatcccctggagccccaacagacagtgggacgagcagctggaccccagactgaacgccaagcagaaggaggccgtgctggccatcaccacccccctggccatccagctgccccccgtgctgatcatcggcccctacggcaccggcaagaccttcaccctggcccaggccgtgaagcacatcctgcagcagcaggagaccagaatcctgatctgcacccacagcaacagcgccgccgacctgtacatcaaggactacctgcacccctacgtggaggccggcaacccccaggccagacccctgagagtgtacttcagaaacagatgggtgaagaccgtgcaccccgtggtgcaccagtactgcctgatcagcagcgcccacagcaccttccagatgccccagaaggaggacatcctgaagcacagagtggtggtggtgaccctgaacaccagccagtacctgtgccagctggacctggagcccggcttcttcacccacatcctgctggacgaggccgcccaggccatggagtgcgagaccatcatgcccctggccctggccacccagaacaccagaatcgtgctggccggcgaccacatgcagctgagccccttcgtgtacagcgagttcgccagagagagaaacctgcacgtgagcctgctggacagactgtacgagcactaccccgccgagttcccctgcagaatcctgctgtgcgagaactacagaagccacgaggccatcatcaactacaccagcgagctgttctacgagggcaagctgatggccagcggcaagcagcccgcccacaaggacttctaccccctgaccttcttcaccgccagaggcgaggacgtgcaggagaagaacagcaccgccttctacaacaacgccgaggtgttcgaggtggtggagagagtggaggagctgagaagaaagtggcccgtggcctggggcaagctggacgacggcagcatcggcgtggtgaccccctacgccgaccaggtgttcagaatcagagccgagctgagaaagaagagactgagcgacgtgaacgtggagagagtgctgaacgtgcagggcaagcagttcagagtgctgttcctgagcaccgtgagaaccagacacacctgcaagcacaagcagacccccatcaagaagaaggagcagctgctggaggacagcaccgaggacctggactacggcttcctgagcaactacaagctgctgaacaccgccatcaccagagcccagagcctggtggccgtggtgggcgaccccatcgccctgtgcagcatcggcagatgcagaaagttctgggagagattcatcgccctgtgccacgagaacagcagcctgcacggcatcaccttcgagcagatcaaggcccagctggaggccctggagctgaagaagacctacgtgctgaaccccctggcccccgagttcatccccagagccctgagactgcagcacagcggcagcaccaacaagcagcagcagagcccccccaagggcaagagcctgcaccacacccagaacgaccacttccagaacgacggcatcgtgcagcccaaccccagcgtgctgatcggcaaccccatcagagcctacaccccccccccccccctgggcccccaccccaacctgggcaagagccccagccccgtgcagagaatcgacccccacaccggcaccagcatcctgtacgtgcccgccgtgtacggcggcaacgtggtgatgagcgtgcccctgcccgtgccctggaccggctaccagggcagattcgccgtggaccccagaatcatcacccaccaggccgccatggcctacaacatgaacctgctgcagacccacggcagaggcagccccatcccctacggcctgggccaccacccccccgtgaccatcggccagccccagaaccagcaccaggagaaggaccagcacgagcagaacagaaacggcaagagcgacaccaacaacagcggccccgagatcaacaagatcagaacccccgagaagaagcccaccgagcccaagcaggtggacctggagagcaacccccagaacagaagccccgagagcagacccagcgtggtgtaccccagcaccaagttccccagaaaggacaacctgaaccccagacacatcaacctgcccctgcccgccccccacgcccagtacgccatccccaacagacacttccaccccctgccccagctgcccagaccccccttccccatcccccagcagcacaccctgctgaaccagcagcagaacaacctgcccgagcagcccaaccagatccccccccagcccaaccaggtggtgcagcagcagagccagctgaaccagcagccccagcagccccccccccagctgagccccgcctaccaggccggccccaacaacgccttcttcaacagcgccgtggcccacagaccccagagcccccccgccgaggccgtgatccccgagcagcagcccccccccatgctgcaggagggccacagccccctgagagccatcgcccagcccggccccatcctgcccagccacctgaacagcttcatcgacgagaaccccagcggcctgcccatcggcgaggccctggacagaatccacggcagcgtggccctggagaccctgagacagcagcaggccagattccagcagtggagcgagcaccacgccttcctgagccagggcagcgccccctacccccaccaccaccacccccacctgcagcacctgccccagccccccctgggcctgcaccagccccccgtgagagccgactggaagctgaccagcagcgccgaggacgaggtggagaccacctacagcagattccaggacctgatcagagagctgagccacagagaccagagcgagaccagagagctggccgagatgccccccccccagagcagactgctgcagtacagacaggtgcagagcagaagcccccccgccgtgcccagcccccccagcagcaccgaccacagcagccacttcagcaacttcaacgacaacagcagagacatcgaggtggccagcaaccccgccttcccccagagactgcccccccagatcttcaacagccccttcagcctgcccagcgagcacctggcccccccccccctgaagtacctggcccccgacggcgcctggaccttcgccaacctgcagcagaaccacctgatgggccccggcttcccctacggcctgccccccctgccccacagacccccccagaaccccttcgtgcagatccagaaccaccagcacgccatcggccaggagcccttccaccccctgagcagcagaaccgtgagcagcagcagcctgcccagcctggaggagtacgagcccagaggccccggcagacccctgtaccagagaagaatcagcagcagcagcgtgcagccctgcagcgaggaggtgagcaccccccaggacagcctggcccagtgcaaggagctgcaggaccacagcaaccagagcagcttcaacttcagcagccccgagagctgggtgaacaccaccagcagcaccccctaccagaacatcccctgcaacggcagcagcagaaccgcccagcccagagagctgatcgccccccccaagaccgtgaagccccccgaggaccagctgaagagcgagaacctggaggtgagcagcagcttcaactacagcgtgctgcagcacctgggccagttcccccccctgatgcccaacaagcagatcgccgagagcgccaacagcagcagcccccagagcagcgccggcggcaagcccgccatgagctacgccagcgccctgagagccccccccaagcccagacccccccccgagcaggccaagaagagcagcgaccccctgagcctgttccaggagctgagcctgggcagcagcagcggcagcaacggcttctacagctacttcaagtag

SEQ ID NO: 84258 - DNA, 1365 bp, Artificial Sequence
  Description of Artificial Sequence: Synthetic coding sequence
atggaggacagaagagccgagaagagctgcgagcaggcctgcgagagcctgaagagacaggactacgagatggccctgaagcactgcaccgaggccctgctgagcctgggccagtacagcatggccgacttcaccggcccctgccccctggagatcgagagaatcaagatcgagagcctgctgtacagaatcgccagcttcctgcagctgaagaactacgtgcaggccgacgaggactgcagacacgtgctgggcgagggcctggccaagggcgaggacgccttcagagccgtgctgtgctgcatgcagctgaagggcaagctgcagcccgtgagcaccatcctggccaagagcctgaccggcgagagcctgaacggcatggtgaccaaggacctgaccagactgaagaccctgctgagcgagaccgagaccgccaccagcaacgccctgagcggctaccacgtggaggacctggacgagggcagctgcaacggctggcacttcagacccccccccagaggcatcaccagcagcgaggagtacaccctgtgcaagagattcctggagcagggcatctgcagatacggcgcccagtgcaccagcgcccacagccaggaggagctggccgagtggcagaagagatacgccagcagactgatcaagctgaagcagcagaacgagaacaagcagctgagcggcagctacatggagaccctgatcgagaagtggatgaacagcctgagccccgagaaggtgctgagcgagtgcatcgagggcgtgaaggtggagcacaaccccgacctgagcgtgaccgtgagcaccaagaagagccaccagacctggaccttcgccctgacctgcaagcccgccagaatgctgtacagagtggccctgctgtacgacgcccacagaccccacttcagcatcatcgccatcagcgccggcgacagcaccacccaggtgagccaggaggtgcccgagaactgccaggagtggatcggcggcaagatggcccagaacggcctggaccactacgtgtacaaggtgggcatcgccttcaacaccgagatcttcggcaccttcagacagaccatcgtgttcgacttcggcctggagcccgtgctgatgcagagagtgatgatcgacgccgccagcaccgaggacctggagtacctgatgcacgccaagcagcagctggtgaccaccgccaagagatgggacagcagcagcaagaccatcatcgacttcgagcccaacgagaccaccgacctggagaagagcctgctgatcagataccagatccccctgagcgagaagaagaagaagaagaagaagaagaagaagaagaagaagaagaagaagtag

SEQ ID NO: 84259 - DNA, 294 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggagaccgtgatgaagatctag

SEQ ID NO: 84260 - DNA, 2517 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccgtgatgagaaagaagagaggcagagaggacgagagctacaacatcagcgaggtgatgagcaaggaggagatcctgagcgtggccaagaagaacaagaaggagaacgaggacgagaacagcagcagcaccaacctgtgcgtggaggacctgcagaagaacaaggacagcaacagcatcatcaaggacagactgagcgagaccgtgagacagaacaccaagttcttcttcgaccccgtgagaaagtgcaacggccagcccgtgcccttccagcagcccaagcacttcaccggcggcgtgatgagatggtaccaggtggagggcatggagtggctgagaatgctgtgggagaacggcatcaacggcatcctggccgacgagatgggcctgggcaagaccgtgcagtgcatcgccaccatcgccctgatgatccagagaggcgtgcccggccccttcctggtgtgcggccccctgagcaccctgcccaactggatggccgagttcaagagattcacccccgacatccccaccatgctgtaccacggcacccaggaggagagacagaagctggtgagaaacatctacaagagaaagggcaccctgcagatccaccccgtggtgatcaccagcttcgagatcgccatgagagacagaaacgccctgcagcactgctactggaagtacctgatcgtggacgagggccacagaatcaagaacatgaagtgcagactgatcagagagctgaagagattcaacgccgacaacaagctgctgctgaccggcacccccctgcagaacaacctgagcgagctgtggagcctgctgaacttcctgctgcccgacgtgttcgacgacctgaagagcttcgagagctggttcgacatcaccagcctgagcgagaccgccgaggacatcatcgccaaggagagagagcagaacgtgctgcacatgctgcaccagatcctgacccccttcctgctgagaagactgaagagcgacgtggccctggaggtgccccccaagagagaggtggtggtgtacgcccccctgagcaagaagcaggagatcttctacaccgccatcgtgaacagaaccatcgccaacatgttcggcagcagcgagaaggagaccatcgagctgagccccaccggcagacccaagagaagaaccagaaagagcatcaactacagcaagatcgacgacttccccaacgagctggagaagctgatcagccagatccagcccgaggtggacagagagagagccgtggtggaggtgaacatccccgtggagagcgaggtgaacctgaagctgcagaacatcatgatgctgctgagaaagtgctgcaaccacccctacctgatcgagtaccccatcgaccccgtgacccaggagttcaagatcgacgaggagctggtgaccaacagcggcaagttcctgatcctggacagaatgctgcccgagctgaagaagagaggccacaaggtgctgctgttcagccagatgaccagcatgctggacatcctgatggactactgccacctgagagacttcaacttcagcagactggacggcagcatgagctacagcgagagagagaagaacatgcacagcttcaacaccgaccccgaggtgttcatcttcctggtgagcaccagagccggcggcctgggcatcaacctgaccgccgccgacaccgtgatcatctacgacagcgactggaacccccagagcgacctgcaggcccaggacagatgccacagaatcggccagaccaagcccgtggtggtgtacagactggtgaccgccaacaccatcgaccagaagatcgtggagagagccgccgccaagagaaagctggagaagctgatcatccacaagaaccacttcaagggcggccagagcggcctgaacctgagcaagaacttcctggaccccaaggagctgatggagctgctgaagagcagagactacgagagagagatcaagggcagcagagagaaggtgatcagcgacaaggacctggagctgctgctggacagaagcgacctgatcgaccagatgaacgccagcggccccatcaaggagaagatgggcatcttcaagatcctggagaacagcgaggacagcagccccgagtgcctgttctag

SEQ ID NO: 84261 - DNA, 2655 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccgtgatgagaaagaagagaggcagagaggacgagagctacaacatcagcgaggtgatgagcaaggaggagatcctgagcgtggccaagaagaacaagaaggagaacgaggacgagaacagcagcagcaccaacctgtgcgtggaggacctgcagaagaacaaggacagcaacagcatcatcaaggacagactgagcgagaccgtgagacagaacaccaagttcttcttcgaccccgtgagaaagtgcaacggccagcccgtgcccttccagcagcccaagcacttcaccggcggcgtgatgagatggtaccaggtggagggcatggagtggctgagaatgctgtgggagaacggcatcaacggcatcctggccgacgagatgggcctgggcaagaccgtgcagtgcatcgccaccatcgccctgatgatccagagaggcgtgcccggccccttcctggtgtgcggccccctgagcaccctgcccaactggatggccgagttcaagagattcacccccgacatccccaccatgctgtaccacggcacccaggaggagagacagaagctggtgagaaacatctacaagagaaagggcaccctgcagatccaccccgtggtgatcaccagcttcgagatcgccatgagagacagaaacgccctgcagcactgctactggaagtacctgatcgtggacgagggccacagaatcaagaacatgaagtgcagactgatcagagagctgaagagattcaacgccgacaacaagctgctgctgaccggcacccccctgcagaacaacctgagcgagctgtggagcctgctgaacttcctgctgcccgacgtgttcgacgacctgaagagcttcgagagctggttcgacatcaccagcctgagcgagaccgccgaggacatcatcgccaaggagagagagcagaacgtgctgcacatgctgcaccaggagagaatccccagaatgtacgtgagcgagttcaccgacgagggcttcttcgagggcaagctgcccagcagaaaggacctgtacgacatcagaccctacgagaacacctacctgctgaagctgcacaccaacttcgagatcctgacccccttcctgctgagaagactgaagagcgacgtggccctggaggtgccccccaagagagaggtggtggtgtacgcccccctgagcaagaagcaggagatcttctacaccgccatcgtgaacagaaccatcgccaacatgttcggcagcagcgagaaggagaccatcgagctgagccccaccggcagacccaagagaagaaccagaaagagcatcaactacagcaagatcgacgacttccccaacgagctggagaagctgatcagccagatccagcccgaggtggacagagagagagccgtggtggaggtgaacatccccgtggagagcgaggtgaacctgaagctgcagaacatcatgatgctgctgagaaagtgctgcaaccacccctacctgatcgagtaccccatcgaccccgtgacccaggagttcaagatcgacgaggagctggtgaccaacagcggcaagttcctgatcctggacagaatgctgcccgagctgaagaagagaggccacaaggtgctgctgttcagccagatgaccagcatgctggacatcctgatggactactgccacctgagagacttcaacttcagcagactggacggcagcatgagctacagcgagagagagaagaacatgcacagcttcaacaccgaccccgaggtgttcatcttcctggtgagcaccagagccggcggcctgggcatcaacctgaccgccgccgacaccgtgatcatctacgacagcgactggaacccccagagcgacctgcaggcccaggacagatgccacagaatcggccagaccaagcccgtggtggtgtacagactggtgaccgccaacaccatcgaccagaagatcgtggagagagccgccgccaagagaaagctggagaagctgatcatccacaagaaccacttcaagggcggccagagcggcctgaacctgagcaagaacttcctggaccccaaggagctgatggagctgctgaagagcagagactacgagagagagatcaagggcagcagagagaaggtgatcagcgacaaggacctggagctgctgctggacagaagcgacctgatcgaccagatgaacgccagcggccccatcaaggagaagatgggcatcttcaagatcctggagaacagcgaggacagcagccccgagtgcctgttctag

SEQ ID NO: 84262 - DNA, 390 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccggcaacttcgtgtgcggctag

SEQ ID NO: 84263 - DNA, 948 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccgtgatgagaaagaagagaggcagagaggacgagagctacaacatcagcgaggtgatgagcaaggaggagatcctgagcgtggccaagaagaacaagaaggagaacgaggacgagaacagcagcagcaccaacctgtgcgtggaggacctgcagaagaacaaggacagcaacagcatcatcaaggacagactgagcgagaccgtgagacagaacaccaagttcttcttcgaccccgtgagaaagtgcaacggccagcccgtgcccttccagcagcccaagcacttcaccggcggcgtgatgagatggtaccaggtggagggcatggagtggctgagaatgctgtgggagaacggcatcaacggcatcctggccgacgagatgggcctgggcaagaccgtgcagtgcatcgccaccatcgccctgatgatccagagaggcgtgcccggccccttcctggtgtgcggccccctgagcaccctgcccaactggatggccgagttcaagagattcacccccgacatccccaccatgctgtaccacggcacccaggaggagagacagaagctgatctacctgtag

SEQ ID NO: 84264 - DNA, 2223 bp, Artificial Sequence
  Description of Artificial Sequence: Synthetic coding sequence
atgcccgccgagagacccgccggcagcggcggcagcgaggcccccgccatggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccgtgatgagaaagaagagaggcagagaggacgagagctacaacatcagcgaggtgatgagcaaggaggagatcctgagcgtggccaagaagaacaagaaggagaacgaggacgagaacagcagcagcaccaacctgtgcgtggaggacctgcagaagaacaaggacagcaacagcatcatcaaggacagactgagcgagaccgtgagacagaacaccaagttcttcttcgaccccgtgagaaagtgcaacggccagcccgtgcccttccagcagcccaagcacttcaccggcggcgtgatgagatggtaccaggtggagggcatggagtggctgagaatgctgtgggagaacggcatcaacggcatcctggccgacgagatgggcctgggcaagaccgtgcagtgcatcgccaccatcgccctgatgatccagagaggcgtgcccggccccttcctggtgtgcggccccctgagcaccctgcccaactggatggccgagttcaagagattcacccccgacatccccaccatgctgtaccacggcacccaggaggagagacagaagctggtgagaaacatctacaagagaaagggcaccctgcagatccaccccgtggtgatcaccagcttcgagatcgccatgagagacagaaacgccctgcagatcctgacccccttcctgctgagaagactgaagagcgacgtggccctggaggtgccccccaagagagaggtggtggtgtacgcccccctgagcaagaagcaggagatcttctacaccgccatcgtgaacagaaccatcgccaacatgttcggcagcagcgagaaggagaccatcgagctgagccccaccggcagacccaagagaagaaccagaaagagcatcaactacagcaagatcgacgacttccccaacgagctggagaagctgatcagccagatccagcccgaggtggacagagagagagccgtggtggaggtgaacatccccgtggagagcgaggtgaacctgaagctgcagaacatcatgatgctgctgagaaagtgctgcaaccacccctacctgatcgagtaccccatcgaccccgtgacccaggagttcaagatcgacgaggagctggtgaccaacagcggcaagttcctgatcctggacagaatgctgcccgagctgaagaagagaggccacaaggtgctgctgttcagccagatgaccagcatgctggacatcctgatggactactgccacctgagagacttcaacttcagcagactggacggcagcatgagctacagcgagagagagaagaacatgcacagcttcaacaccgaccccgaggtgttcatcttcctggtgagcaccagagccggcggcctgggcatcaacctgaccgccgccgacaccgtgatcatctacgacagcgactggaacccccagagcgacctgcaggcccaggacagatgccacagaatcggccagaccaagcccgtggtggtgtacagactggtgaccgccaacaccatcgaccagaagatcgtggagagagccgccgccaagagaaagctggagaagctgatcatccacaagaaccacttcaagggcggccagagcggcctgaacctgagcaagaacttcctggaccccaaggagctgatggagctgctgaagagcagagactacgagagagagatcaagggcagcagagagaaggtgatcagcgacaaggacctggagctgctgctggacagaagcgacctgatcgaccagatgaacgccagcggccccatcaaggagaagatgggcatcttcaagatcctggagaacagcgaggacagcagccccgagtgcctgttctag

SEQ ID NO: 84265 - DNA, 579 bp, Artificial Sequence
  Description of Artificial Sequence: Synthetic coding sequence
atggtggagcagctggacaccgccgtgatcacccccgccatgctggaggaggaggagcagctggaggccgccggcctggagagagagagaaagatgctggagaaggccagaatgagctgggacagagagagcaccgagatcagatacagaagactgcagcacctgctggagaagagcaacatctacagcaagttcctgctgaccaagatggagcagcagcagctggaggagcagaagaagaaggagaagctggagagaaagaaggagagcctgaaggtgaagaagggcaagaacagcatcgacgccagcgaggagaagcccgtgatgagaaagaagagaggcagagaggacgagagctacaacatcagcgaggtgatgagcaaggaggagatcctgagcgtggccaagaagaacaagaaggagaacgaggacgagaacagcagcagcaccaacctgtgcgtggaggacctgcagaagaacaaggacagcaacagcatcatcaaggacagactgagcgagaccgtgagacagaacaccaagttcttcttcgaccccgtgagaaagtgcaacggccagtag

SEQ ID NO: 84266 - DNA, 1461 bp, Artificial Sequence
  Description of Artificial Sequence: Synthetic coding sequence
atgtggaagagcgtggtgggccacgacgtgagcgtgagcgtggagacccagggcgacgactgggacaccgaccccgacttcgtgaacgacatcagcgagaaggagcagagatggggcgccaagaccatcgagggcagcggcagaaccgagcacatcaacatccaccagctgagaaacaaggtgagcgaggagcacgacgtgctgagaaagaaggagatggagagcggccccaaggccagccacggctacggcggcagattcggcgtggagagagacagaatggacaagagcgccgtgggccacgagtacgtggccgaggtggagaagcacagcagccagaccgacgccgccaagggcttcggcggcaagtacggcgtggagagagacagagccgacaagagcgccgtgggcttcgactacaagggcgaggtggagaagcacaccagccagaaggactacagcagaggcttcggcggcagatacggcgtggagaaggacaagtgggacaaggccgccctgggctacgactacaagggcgagaccgagaagcacgagagccagagagactacgccaagggcttcggcggccagtacggcatccagaaggacagagtggacaagagcgccgtgggcttcaacgagatggaggcccccaccaccgcctacaagaagaccacccccatcgaggccgccagcagcggcaccagaggcctgaaggccaagttcgagagcatggccgaggagaagagaaagagagaggaggaggagaaggcccagcaggtggccagaagacagcaggagagaaaggccgtgaccaagagaagccccgaggccccccagcccgtgatcgccatggaggagcccgccgtgcccgcccccctgcccaagaagatcagcagcgaggcctggccccccgtgggcaccccccccagcagcgagagcgagcccgtgagaaccagcagagagcaccccgtgcccctgctgcccatcagacagaccctgcccgaggacaacgaggagccccccgccctgccccccagaaccctggagggcctgcaggtggaggaggagcccgtgtacgaggccgagcccgagcccgagcccgagcccgagcccgagcccgagaacgactacgaggacgtggaggagatggacagacacgagcaggaggacgagcccgagggcgactacgaggaggtgctggagcccgaggacagcagcttcagcagcgccctggccggcagcagcggctgccccgccggcgccggcgccggcgccgtggccctgggcatcagcgccgtggccgtgtacgactaccagggcgagggcagcgacgagctgagcttcgaccccgacgacgtgatcaccgacatcgagatggtggacgagggctggtggagaggcagatgccacggccacttcggcctgttccccgccaactacgtgaagctgctggagtag

SEQ ID NO: 84267 - DNA, 600 bp, Artificial Sequence
  Description of Artificial Sequence: Synthetic coding sequence
atgcccaactacaagctgacctacttcaacatgagaggcagagccgagatcatcagatacatcttcgcctacctggacatccagtacgaggaccacagaatcgagcaggccgactggcccgagatcaagagcaccctgcccttcggcaagatccccatcctggaggtggacggcctgaccctgcaccagagcctggccatcgccagatacctgaccaagaacaccgacctggccggcaacaccgagatggagcagtgccacgtggacgccatcgtggacaccctggacgacttcatgagctgcttcccctgggccgagaagaagcaggacgtgaaggagcagatgttcaacgagctgctgacctacaacgccccccacctgatgcaggacctggacacctacctgggcggcagagagtggctgatcggcaacagcgtgacctgggccgacttctactgggagatctgcagcaccaccctgctggtgttcaagcccgacctgctggacaaccaccccagactggtgaccctgagaaagaaggtgcaggccatccccgccgtggccaactggatcaagagaagaccccagaccaagctgtag

SEQ ID NO: 84268 - DNA, 813 bp, Artificial Sequence
  Description of Artificial Sequence: Synthetic coding sequence
atgcagtacccccaccccggccccgccgccggcgccgtgggcgtgcccctgtacgcccccacccccctgctgcagcccgcccaccccacccccttctacatcgaggacatcctgggcagaggccccgccgcccccacccccgcccccaccctgcccagccccaacagcagcttcaccagcctggtgagcccctacagaacccccgtgtacgagcccacccccatccaccccgccttcagccaccacagcgccgccgccctggccgccgcctacggccccggcggcttcggcggccccctgtaccccttccccagaaccgtgaacgactacacccacgccctgctgagacacgaccccctgggcaagcccctgctgtggagccccttcctgcagagacccctgcacaagagaaagggcggccaggtgagattcagcaacgaccagaccatcgagctggagaagaagttcgagacccagaagtacctgagcccccccgagagaaagagactggccaagatgctgcagctgagcgagagacaggtgaagacctggttccagaacagaagagccaagtggagaagactgaagcaggagaacccccagagcaacaagaaggaggagctggagagcctggacagcagctgcgaccagagacaggacctgcccagcgagcagaacaagggcgccagcctggacagcagccagtgcagccccagccccgccagccaggaggacctggagagcgagatcagcgaggacagcgaccaggaggtggacatcgagggcgacaagagctacttcaacgccggctag

SEQ ID NO: 84269 - DNA, 570 bp, Artificial Sequence
  Description of Artificial Sequence: Synthetic coding sequence
atgctgggcatgatcaagaacagcctgttcggcagcgtggagacctggccctggcaggtgctgagcaagggcgacaaggaggaggtggcctacgaggagagagcctgcgagggcggcaagttcgccaccgtggaggtgaccgacaagcccgtggacgaggccctgagagaggccatgcccaaggtggccaagtacgccggcggcaccaacgacaagggcatcggcatgggcatgaccgtgcccatcagcttcgccgtgttccccaacgaggacggcagcctgcagaagaagctgaaggtgtggttcagaatccccaaccagttccagagcgacccccccgcccccagcgacaagagcgtgaagatcgaggagagagagggcatcaccgtgtacagcatgcagttcggcggctacgccaaggaggccgactacgtggcccaggccaccagactgagagccgccctggagggcaccgccacctacagaggcgacatctacttctgcaccggctacgacccccccatgaagccctacggcagaagaaacgagatctggctgctgaagacctag

SEQ ID NO: 84270 - DNA, 4059 bp, Artificial Sequence
  Description of Artificial Sequence: Synthetic coding sequence
atgagcaaggtgaccgcccccggcagcggcccccccgccgccgccagcggcaaggagaagagaagcttcagcaagagactgttcagaagcggcagagccggcggcggcggcgccggcggccccggcgccagcggccccgccgcccccagcagccccagcagccccagcagcgccagaagcgtgggcagcttcatgagcagagtgctgaagaccctgagcaccctgagccacctgagcagcgagggcgccgcccccgacagaggcggcctgagaagctgcttcccccccggccccgccgccgcccccaccccccccccctgcccccccccccccgccagccccgccccccccgcctgcgccgccgagcccgtgcccggcgtggccggcctgagaaaccacggcaacacctgcttcatgaacgccaccctgcagtgcctgagcaacaccgagctgttcgccgagtacctggccctgggccagtacagagccggcagacccgagcccagccccgaccccgagcagcccgccggcagaggcgcccagggccagggcgaggtgaccgagcagctggcccacctggtgagagccctgtggaccctggagtacaccccccagcacagcagagacttcaagaccatcgtgagcaagaacgccctgcagtacagaggcaacagccagcacgacgcccaggagttcctgctgtggctgctggacagagtgcacgaggacctgaaccacagcgtgaagcagagcggccagccccccctgaagccccccagcgagaccgacatgatgcccgagggccccagcttccccgtgtgcagcaccttcgtgcaggagctgttccaggcccagtacagaagcagcctgacctgcccccactgccagaagcagagcaacaccttcgaccccttcctgtgcatcagcctgcccatccccctgccccacaccagacccctgtacgtgaccgtggtgtaccagggcaagtgcagccactgcatgagaatcggcgtggccgtgcccctgagcggcaccgtggccagactgagagaggccgtgagcatggagaccaagatccccaccgaccagatcgtgctgaccgagatgtactacgacggcttccacagaagcttctgcgacaccgacgacctggagaccgtgcacgagagcgactgcatcttcgccttcgagacccccgagatcttcagacccgagggcatcctgagccagagaggcatccacctgaacaacaacctgaaccacctgaagttcggcctggactaccacagactgagcagccccacccagaccgccgccaagcagggcaagatggacagccccaccagcagagccggcagcgacaagatcgtgctgctggtgtgcaacagagcctgcaccggccagcagggcaagagattcggcctgcccttcgtgctgcacctggagaagaccatcgcctgggacctgctgcagaaggagatcctggagaagatgaagtacttcctgagacccaccgtgtgcatccaggtgtgccccttcagcctgagagtggtgagcgtggtgggcatcacctacctgctgccccaggaggagcagcccctgtgccaccccatcgtggagagagccctgaagagctgcggccccggcggcaccgcccacgtgaagctggtggtggagtgggacaaggagaccagagacttcctgttcgtgaacaccgaggacgagtacatccccgacgccgagagcgtgagactgcagagagagagacaccaccagccccagacctgcaccctgagccagtgcttccagctgtacaccaaggaggagagactggcccccgacgacgcctggagatgcccccactgcaagcagctgcagcagggcagcatcaccctgagcctgtggaccctgcccgacgtgctgatcatccacctgaagagattcagacaggagggcgacagaagaatgaagctgcagaacatggtgaagttccccctgaccggcctggacatgaccccccacgtggtgaagagaagccagagcagctggagcctgcccagccactggagcccctggagaagaccctacggcctgggcagagaccccgaggactacatctacgacctgtacgccgtgtgcaaccaccacggcaccatgcagggcggccactacaccgcctactgcaagaacagcgtggacggcctgtggtactgcttcgacgacagcgacgtgcagcagctgagcgaggacgaggtgtgcacccagaccgcctacatcctgttctaccagagaagaaccgccatccccagctggagcgccaacagcagcgtggccggcagcaccagcagcagcctgtgcgagcactgggtgagcagactgcccggcagcaagcccgccagcgtgaccagcgccgccagcagcagaagaaccagcctggccagcctgagcgagagcgtggagatgaccggcgagagaagcgaggacgacggcggcttcagcaccagacccttcgtgagaagcgtgcagagacagagcctgagcagcagaagcagcgtgaccagccccctggccgtgaacgagaactgcatgagacccagctggagcctgagcgccaagctgcagatgagaagcaacagccccagcagattcagcggcgacagccccatccacagcagcgccagcaccctggagaagatcggcgaggccgccgacgacaaggtgagcatcagctgcttcggcagcctgagaaacctgagcagcagctaccaggagcccagcgacagccacagcagaagagagcacaaggccgtgggcagagcccccctggccgtgatggagggcgtgttcaaggacgagagcgacaccagaagactgaacagcagcgtggtggacacccagagcaagcacagcgcccagggcgacagactgccccccctgagcggccccttcgacaacaacaaccagatcgcctacgtggaccagagcgacagcgtggacagcagccccgtgaaggaggtgaaggcccccagccaccccggcagcctggccaagaagcccgagagcaccaccaagagaagccccagcagcaagggcaccagcgagcccgagaagagcctgagaaagggcagacccgccctggccagccaggagagcagcctgagcagcaccagccccagcagccccctgcccgtgaaggtgagcctgaagcccagcagaagcagaagcaaggccgacagcagcagcagaggcagcggcagacacagcagccccgcccccgcccagcccaagaaggagagcagccccaagagccaggacagcgtgagcagccccagcccccagaagcagaagagcgccagcgccctgacctacaccgccagcagcaccagcgccaagaaggccagcggccccgccaccagaagccccttcccccccggcaagagcagaaccagcgaccacagcctgagcagagagggcagcagacagagcctgggcagcgacagagccagcgccaccagcaccagcaagcccaacagccccagagtgagccaggccagagccggcgagggcagaggcgccggcaagcacgtgagaagcagcagcatggccagcctgagaagccccagcaccagcatcaagagcggcctgaagagagacagcaagagcgaggacaagggcctgagcttcttcaagagcgccctgagacagaaggagaccagaagaagcaccgacctgggcaagaccgccctgctgagcaagaaggccggcggcagcagcgtgaagagcgtgtgcaagaacaccggcgacgacgaggccgagagaggccaccagccccccgccagccagcagcccaacgccaacaccaccggcaaggagcagctggtgaccaaggaccccgccagcgccaagcacagcctgctgagcgccagaaagagcaagagcagccagctggacagcggcgtgcccagcagccccggcggcagacagagcgccgagaagagcagcaagaagctgagcagcagcatgcagaccagcgccagacccagccagaagccccagtag

SEQ ID NO: 84271 - DNA, 951 bp, Artificial Sequence
  Description of Artificial Sequence: Synthetic coding sequence
atgagcgccgaggtggagaccagcgagggcgtggacgagagcgagaagaagaacagcggcgccctggagaaggagaaccagatgagaatggccgacctgagcgagctgctgaaggagggcaccaaggaggcccacgacagagccgagaacacccagttcgtgaaggacttcctgaagggcaacatcaagaaggagctgttcaagctggccaccaccgccctgtacttcacctacagcgccctggaggaggagatggagagaaacaaggaccaccccgccttcgcccccctgtacttccccatggagctgcacagaaaggaggccctgaccaaggacatggagtacttcttcggcgagaactgggaggagcaggtgcagtgccccaaggccgcccagaagtacgtggagagaatccactacatcggccagaacgagcccgagctgctggtggcccacgcctacaccagatacatgggcgacctgagcggcggccaggtgctgaagaaggtggcccagagagccctgaagctgcccagcaccggcgagggcacccagttctacctgttcgagaacgtggacaacgcccagcagttcaagcagctgtacagagccagaatgaacgccctggacctgaacatgaagaccaaggagagaatcgtggaggaggccaacaaggccttcgagtacaacatgcagatcttcaacgagctggaccaggccggcagcaccctggccagagagaccctggaggacggcttccccgtgcacgacggcaagggcgacatgagaaagtgccccttctacgccgccgagcaggacaagggcgccctggagggcagcagctgccccttcagaaccgccatggccgtgctgagaaagcccagcctgcagttcatcctggccgccggcgtggccctggccgccggcctgctggcctggtactacatgtag

SEQ ID NO: 84272 - DNA, 951 bp, Artificial Sequence; identical to SEQ ID NO: 84271
  Description of Artificial Sequence: Synthetic coding sequence

SEQ ID NO: 84273 - DNA, 951 bp, Artificial Sequence; identical to SEQ ID NO: 84271
  Description of Artificial Sequence: Synthetic coding sequence

SEQ ID NO: 84274 - DNA, 951 bp, Artificial Sequence; identical to SEQ ID NO: 84271
  Description of Artificial Sequence: Synthetic coding sequence

SEQ ID NO: 84275 - DNA, 951 bp, Artificial Sequence; identical to SEQ ID NO: 84271
  Description of Artificial Sequence: Synthetic coding sequence

SEQ ID NO: 84276 - DNA, 16908 bp, Artificial Sequence
  Description of Artificial Sequence: Synthetic coding sequence
atgatcagctgggaggtggtgcacaccgtgttcctgttcgccctgctgtacagcagcctggcccaggacgccagcccccagagcgagatcagagccgaggagatccccgagggcgccagcaccctggccttcgtgttcgacgtgaccggcagcatgtacgacgacctggtgcaggtgatcgagggcgccagcaagatcctggagaccagcctgaagagacccaagagacccctgttcaacttcgccctggtgcccttccacgaccccgagatcggccccgtgaccatcaccaccgaccccaagaagttccagtacgagctgagagagctgtacgtgcagggcggcggcgactgccccgagatgagcatcggcgccatcaagatcgccctggagatcagcctgcccggcagcttcatctacgtgttcaccgacgccagaagcaaggactacagactgacccacgaggtgctgcagctgatccagcagaagcagagccaggtggtgttcgtgctgaccggcgactgcgacgacagaacccacatcggctacaaggtgtacgaggagatcgccagcaccagcagcggccaggtgttccacctggacaagaagcaggtgaacgaggtgctgaagtgggtggaggaggccgtgcaggccagcaaggtgcacctgctgagcaccgaccacctggagcaggccgtgaacacctggagaatccccttcgaccccagcctgaaggaggtgaccgtgagcctgagcggccccagccccatgatcgagatcagaaaccccctgggcaagctgatcaagaagggcttcggcctgcacgagctgctgaacatccacaacagcgccaaggtggtgaacgtgaaggagcccgaggccggcatgtggaccgtgaagaccagcagcagcggcagacacagcgtgagaatcaccggcctgagcaccatcgacttcagagccggcttcagcagaaagcccaccctggacttcaagaagaccgtgagcagacccgtgcagggcatccccacctacgtgctgctgaacaccagcggcatcagcacccccgccagaatcgacctgctggagctgctgagcatcagcggcagcagcctgaagaccatccccgtgaagtactacccccacagaaagccctacggcatctggaacatcagcgacttcgtgccccccaacgaggccttcttcctgaaggtgaccggctacgacaaggacgactacctgttccagagagtgagcagcgtgagcttcagcagcatcgtgcccgacgcccccaaggtgaccatgcccgagaagacccccggctactacctgcagcccggccagatcccctgcagcgtggacagcctgctgcccttcaccctgagcttcgtgagaaacggcgtgaccctgggcgtggaccagtacctgaaggagagcgccagcgtgaacctggacatcgccaaggtgaccctgagcgacgagggcttctacgagtgcatcgccgtgagcagcgccggcaccggcagagcccagaccttcttcgacgtgagcgagcccccccccgtgatccaggtgcccaacaacgtgaccgtgacccccggcgagagagccgtgctgacctgcctgatcatcagcgccgtggactacaacctgacctggcagagaaacgacagagacgtgagactggccgagcccgccagaatcagaaccctggccaacctgagcctggagctgaagagcgtgaagttcaacgacgccggcgagtaccactgcatggtgagcagcgagggcggcagcagcgccgccagcgtgttcctgaccgtgcaggagccccccaaggtgaccgtgatgcccaagaaccagagcttcaccggcggcagcgaggtgagcatcatgtgcagcgccaccggctaccccaagcccaagatcgcctggaccgtgaacgacatgttcatcgtgggcagccacagatacagaatgaccagcgacggcaccctgttcatcaagaacgccgcccccaaggacgccggcatctacggctgcctggccagcaacagcgccggcaccgacaagcagaacagcaccctgagatacatcgaggcccccaagctgatggtggtgcagagcgagctgctggtggccctgggcgacatcaccgtgatggagtgcaagaccagcggcatcccccccccccaggtgaagtggttcaagggcgacctggagctgagacccagcaccttcctgatcatcgaccccctgctgggcctgctgaagatccaggagacccaggacctggacgccggcgactacacctgcgtggccatcaacgaggccggcagagccaccggcaagatcaccctggacgtgggcagcccccccgtgttcatccaggagcccgccgacgtgagcatggagatcggcagcaacgtgaccctgccctgctacgtgcagggctaccccgagcccaccatcaagtggagaagactggacaacatgcccatcttcagcagacccttcagcgtgagcagcatcagccagctgagaaccggcgccctgttcatcctgaacctgtgggccagcgacaagggcacctacatctgcgaggccgagaaccagttcggcaagatccagagcgagaccaccgtgaccgtgaccggcctggtggcccccctgatcggcatcagccccagcgtggccaacgtgatcgagggccagcagctgaccctgccctgcaccctgctggccggcaaccccatccccgagagaagatggatcaagaacagcgccatgctgctgcagaacccctacatcaccgtgagaagcgacggcagcctgcacatcgagagagtgcagctgcaggacggcggcgagtacacctgcgtggccagcaacgtggccggcaccaacaacaagaccaccagcgtggtggtgcacgtgctgcccaccatccagcacggccagcagatcctgagcaccatcgagggcatccccgtgaccctgccctgcaaggccagcggcaaccccaagcccagcgtgatctggagcaagaagggcgagctgatcagcaccagcagcgccaagttcagcgccggcgccgacggcagcctgtacgtggtgagccccggcggcgaggagagcggcgagtacgtgtgcaccgccaccaacaccgccggctacgccaagagaaaggtgcagctgaccgtgtacgtgagacccagagtgttcggcgaccagagaggcctgagccaggacaagcccgtggagatcagcgtgctggccggcgaggaggtgaccctgccctgcgaggtgaagagcctgcccccccccatcatcacctgggccaaggagacccagctgatcagccccttcagccccagacacaccttcctgcccagcggcagcatgaagatcaccgagaccagaaccagcgacagcggcatgtacctgtgcgtggccaccaacatcgccggcaacgtgacccaggccgtgaagctgaacgtgcacgtgccccccaagatccagagaggccccaagcacctgaaggtgcaggtgggccagagagtggacatcccctgcaacgcccagggcacccccctgcccgtgatcacctggagcaagggcggcagcaccatgctggtggacggcgagcaccacgtgagcaaccccgacggcaccctgagcatcgaccaggccacccccagcgacgccggcatctacacctgcgtggccaccaacatcgccggcaccgacgagaccgagatcaccctgcacgtgcaggagccccccaccgtggaggacctggagcccccctacaacaccaccttccaggagagagtggccaaccagagaatcgagttcccctgccccgccaagggcacccccaagcccaccatcaagtggctgcacaacggcagagagctgaccggcagagagcccggcatcagcatcctggaggacggcaccctgctggtgatcgccagcgtgaccccctacgacaacggcgagtacatctgcgtggccgtgaacgaggccggcaccaccgagagaaagtacaacctgaaggtgcacgtgccccccgtgatcaaggacaaggagcaggtgaccaacgtgagcgtgctgctgaaccagctgaccaacctgttctgcgaggtggagggcacccccagccccatcatcatgtggtacaaggacaacgtgcaggtgaccgagagcagcaccatccagaccgtgaacaacggcaagatcctgaagctgttcagagccacccccgaggacgccggcagatacagctgcaaggccatcaacatcgccggcaccagccagaagtacttcaacatcgacgtgctggtgccccccaccatcatcggcaccaacttccccaacgaggtgagcgtggtgctgaacagagacgtggccctggagtgccaggtgaagggcacccccttccccgacatccactggttcaaggacggcaagcccctgttcctgggcgaccccaacgtggagctgctggacagaggccaggtgctgcacctgaagaacgccagaagaaacgacaagggcagataccagtgcaccgtgagcaacgccgccggcaagcaggccaaggacatcaagctgaccatctacatcccccccagcatcaagggcggcaacgtgaccaccgacatcagcgtgctgatcaacagcctgatcaagctggagtgcgagaccagaggcctgcccatgcccgccatcacctggtacaaggacggccagcccatcatgagcagcagccaggccctgtacatcgacaagggccagtacctgcacatccccagagcccaggtgagcgacagcgccacctacacctgccacgtggccaacgtggccggcaccgccgagaagagcttccacgtggacgtgtacgtgccccccatgatcgagggcaacctggccacccccctgaacaagcaggtggtgatcgcccacagcctgaccctggagtgcaaggccgccggcaaccccagccccatcctgacctggctgaaggacggcgtgcccgtgaaggccaacgacaacatcagaatcgaggccggcggcaagaagctggagatcatgagcgcccaggagatcgacagaggccagtacatctgcgtggccaccagcgtggccggcgagaaggagatcaagtacgaggtggacgtgctggtgccccccgccatcgagggcggcgacgagaccagctacttcatcgtgatggtgaacaacctgctggagctggactgccacgtgaccggcagccccccccccaccatcatgtggctgaaggacggccagctgatcgacgagagagacggcttcaagatcctgctgaacggcagaaagctggtgatcgcccaggcccaggtgagcaacaccggcctgtacagatgcatggccgccaacaccgccggcgaccacaagaaggagttcgaggtgaccgtgcacgtgccccccaccatcaagagcagcggcctgagcgagagagtggtggtgaagtacaagcccgtggccctgcagtgcatcgccaacggcatccccaaccccagcatcacctggctgaaggacgaccagcccgtgaacaccgcccagggcaacctgaagatccagagcagcggcagagtgctgcagatcgccaagaccctgctggaggacgccggcagatacacctgcgtggccaccaacgccgccggcgagacccagcagcacatccagctgcacgtgcacgagccccccagcctggaggacgccggcaagatgctgaacgagaccgtgctggtgagcaaccccgtgcagctggagtgcaaggccgccggcaaccccgtgcccgtgatcacctggtacaaggacaacagactgctgagcggcagcaccagcatgaccttcctgaacagaggccagatcatcgacatcgagagcgcccagatcagcgacgccggcatctacaagtgcgtggccatcaacagcgccggcgccaccgagctgttctacagcctgcaggtgcacgtggcccccagcatcagcggcagcaacaacatggtggccgtggtggtgaacaaccccgtgagactggagtgcgaggccagaggcatccccgcccccagcctgacctggctgaaggacggcagccccgtgagcagcttcagcaacggcctgcaggtgctgagcggcggcagaatcctggccctgaccagcgcccagatcagcgacaccggcagatacacctgcgtggccgtgaacgccgccggcgagaagcagagagacatcgacctgagagtgtacgtgccccccaacatcatgggcgaggagcagaacgtgagcgtgctgatcagccaggccgtggagctgctgtgccagagcgacgccatccccccccccaccctgacctggctgaaggacggccaccccctgctgaagaagcccggcctgagcatcagcgagaacagaagcgtgctgaagatcgaggacgcccaggtgcaggacaccggcagatacacctgcgaggccaccaacgtggccggcaagaccgagaagaactacaacgtgaacatctgggtgccccccaacatcggcggcagcgacgagctgacccagctgaccgtgatcgagggcaacctgatcagcctgctgtgcgagagcagcggcatccccccccccaacctgatctggaagaagaagggcagccccgtgctgaccgacagcatgggcagagtgagaatcctgagcggcggcagacagctgcagatcagcatcgccgagaagagcgacgccgccctgtacagctgcgtggccagcaacgtggccggcaccgccaagaaggagtacaacctgcaggtgtacatcagacccaccatcaccaacagcggcagccaccccaccgagatcatcgtgaccagaggcaagagcatcagcctggagtgcgaggtgcagggcatccccccccccaccgtgacctggatgaaggacggccaccccctgatcaaggccaagggcgtggagatcctggacgagggccacatcctgcagctgaagaacatccacgtgagcgacaccggcagatacgtgtgcgtggccgtgaacgtggccggcatgaccgacaagaagtacgacctgagcgtgcacgccccccccagcatcatcggcaaccacagaagccccgagaacatcagcgtggtggagaagaacagcgtgagcctgacctgcgaggccagcggcatccccctgcccagcatcacctggttcaaggacggctggcccgtgagcctgagcaacagcgtgagaatcctgagcggcggcagaatgctgagactgatgcagaccaccatggaggacgccggccagtacacctgcgtggtgagaaacgccgccggcgaggagagaaagatcttcggcctgagcgtgctggtgcccccccacatcgtgggcgagaacaccctggaggacgtgaaggtgaaggagaagcagagcgtgaccctgacctgcgaggtgaccggcaaccccgtgcccgagatcacctggcacaaggacggccagcccctgcaggaggacgaggcccaccacatcatcagcggcggcagattcctgcagatcaccaacgtgcaggtgccccacaccggcagatacacctgcctggccagcagccccgccggccacaagagcagaagcttcagcctgaacgtgttcgtgagccccaccatcgccggcgtgggcagcgacggcaaccccgaggacgtgaccgtgatcctgaacagccccaccagcctggtgtgcgaggcctacagctacccccccgccaccatcacctggttcaaggacggcacccccctggagagcaacagaaacatcagaatcctgcccggcggcagaaccctgcagatcctgaacgcccaggaggacaacgccggcagatacagctgcgtggccaccaacgaggccggcgagatgatcaagcactacgaggtgaaggtgtacatcccccccatcatcaacaagggcgacctgtggggccccggcctgagccccaaggaggtgaagatcaaggtgaacaacaccctgaccctggagtgcgaggcctacgccatccccagcgccagcctgagctggtacaaggacggccagcccctgaagagcgacgaccacgtgaacatcgccgccaacggccacaccctgcagatcaaggaggcccagatcagcgacaccggcagatacacctgcgtggccagcaacatcgccggcgaggacgagctggacttcgacgtgaacatccaggtgccccccagcttccagaagctgtgggagatcggcaacatgctggacaccggcagaaacggcgaggccaaggacgtgatcatcaacaaccccatcagcctgtactgcgagaccaacgccgcccccccccccaccctgacctggtacaaggacggccaccccctgaccagcagcgacaaggtgctgatcctgcccggcggcagagtgctgcagatccccagagccaaggtggaggacgccggcagatacacctgcgtggccgtgaacgaggccggcgaggacagcctgcagtacgacgtgagagtgctggtgccccccatcatcaagggcgccaacagcgacctgcccgaggaggtgaccgtgctggtgaacaagagcgccctgatcgagtgcctgagcagcggcagccccgcccccagaaacagctggcagaaggacggccagcccctgctggaggacgaccaccacaagttcctgagcaacggcagaatcctgcagatcctgaacacccagatcaccgacatcggcagatacgtgtgcgtggccgagaacaccgccggcagcgccaagaagtacttcaacctgaacgtgcacgtgccccccagcgtgatcggccccaagagcgagaacctgaccgtggtggtgaacaacttcatcagcctgacctgcgaggtgagcggcttccccccccccgacctgagctggctgaagaacgagcagcccatcaagctgaacaccaacaccctgatcgtgcccggcggcagaaccctgcagatcatcagagccaaggtgagcgacggcggcgagtacacctgcatcgccatcaaccaggccggcgagagcaagaagaagttcagcctgaccgtgtacgtgccccccagcatcaaggaccacgacagcgagagcctgagcgtggtgaacgtgagagagggcaccagcgtgagcctggagtgcgagagcaacgccgtgcccccccccgtgatcacctggtacaagaacggcagaatgatcaccgagagcacccacgtggagatcctggccgacggccagatgctgcacatcaagaaggccgaggtgagcgacaccggccagtacgtgtgcagagccatcaacgtggccggcagagacgacaagaacttccacctgaacgtgtacgtgccccccagcatcgagggccccgagagagaggtgatcgtggagaccatcagcaaccccgtgaccctgacctgcgacgccaccggcatccccccccccaccatcgcctggctgaagaaccacaagagaatcgagaacagcgacagcctggaggtgagaatcctgagcggcggcagcaagctgcagatcgccagaagccagcacagcgacagcggcaactacacctgcatcgccagcaacatggagggcaaggcccagaagtactacttcctgagcatccaggtgccccccagcgtggccggcgccgagatccccagcgacgtgagcgtgctgctgggcgagaacgtggagctggtgtgcaacgccaacggcatccccacccccctgatccagtggctgaaggacggcaagcccatcgccagcggcgagaccgagagaatcagagtgagcgccaacggcagcaccctgaacatctacggcgccctgaccagcgacaccggcaagtacacctgcgtggccaccaaccccgccggcgaggaggacagaatcttcaacctgaacgtgtacgtgacccccaccatcagaggcaacaaggacgaggccgagaagctgatgaccctggtggacaccagcatcaacatcgagtgcagagccaccggcaccccccccccccagatcaactggctgaagaacggcctgcccctgcccctgagcagccacatcagactgctggccgccggccaggtgatcagaatcgtgagagcccaggtgagcgacgtggccgtgtacacctgcgtggccagcaacagagccggcgtggacaacaagcactacaacctgcaggtgttcgccccccccaacatggacaacagcatgggcaccgaggagatcaccgtgctgaagggcagcagcaccagcatggcctgcatcaccgacggcacccccgcccccagcatggcctggctgagagacggccagcccctgggcctggacgcccacctgaccgtgagcacccacggcatggtgctgcagctgctgaaggccgagaccgaggacagcggcaagtacacctgcatcgccagcaacgaggccggcgaggtgagcaagcacttcatcctgaaggtgctggagcccccccacatcaacggcagcgaggagcacgaggagatcagcgtgatcgtgaacaaccccctggagctgacctgcatcgccagcggcatccccgcccccaagatgacctggatgaaggacggcagacccctgccccagaccgaccaggtgcagaccctgggcggcggcgaggtgctgagaatcagcaccgcccaggtggaggacaccggcagatacacctgcctggccagcagccccgccggcgacgacgacaaggagtacctggtgagagtgcacgtgccccccaacatcgccggcaccgacgagcccagagacatcaccgtgctgagaaacagacaggtgaccctggagtgcaagagcgacgccgtgcccccccccgtgatcacctggctgagaaacggcgagagactgcaggccacccccagagtgagaatcctgagcggcggcagatacctgcagatcaacaacgccgacctgggcgacaccgccaactacacctgcgtggccagcaacatcgccggcaagaccaccagagagttcatcctgaccgtgaacgtgccccccaacatcaagggcggcccccagagcctggtgatcctgctgaacaagagcaccgtgctggagtgcatcgccgagggcgtgcccacccccagaatcacctggagaaaggacggcgccgtgctggccggcaaccacgccagatacagcatcctggagaacggcttcctgcacatccagagcgcccacgtgaccgacaccggcagatacctgtgcatggccaccaacgccgccggcaccgacagaagaagaatcgacctgcaggtgcacgtgccccccagcatcgcccccggccccaccaacatgaccgtgatcgtgaacgtgcagaccaccctggcctgcgaggccaccggcatccccaagcccagcatcaactggagaaagaacggccacctgctgaacgtggaccagaaccagaacagctacagactgctgagcagcggcagcctggtgatcatcagccccagcgtggacgacaccgccacctacgagtgcaccgtgaccaacggcgccggcgacgacaagagaaccgtggacctgaccgtgcaggtgccccccagcatcgccgacgagcccaccgacttcctggtgaccaagcacgcccccgccgtgatcacctgcaccgccagcggcgtgcccttccccagcatccactggaccaagaacggcatcagactgctgcccagaggcgacggctacagaatcctgagcagcggcgccatcgagatcctggccacccagctgaaccacgccggcagatacacctgcgtggccagaaacgccgccggcagcgcccacagacacgtgaccctgcacgtgcacgagccccccgtgatccagccccagcccagcgagctgcacgtgatcctgaacaaccccatcctgctgccctgcgaggccaccggcacccccagccccttcatcacctggcagaaggagggcatcaacgtgaacaccagcggcagaaaccacgccgtgctgcccagcggcggcctgcagatcagcagagccgtgagagaggacgccggcacctacatgtgcgtggcccagaaccccgccggcaccgccctgggcaagatcaagctgaacgtgcaggtgccccccgtgatcagcccccacctgaaggagtacgtgatcgccgtggacaagcccatcaccctgagctgcgaggccgacggcctgcccccccccgacatcacctggcacaaggacggcagagccatcgtggagagcatcagacagagagtgctgagcagcggcagcctgcagatcgccttcgtgcagcccggcgacgccggccactacacctgcatggccgccaacgtggccggcagcagcagcaccagcaccaagctgaccgtgcacgtgccccccagaatcagaagcaccgagggccactacaccgtgaacgagaacagccaggccatcctgccctgcgtggccgacggcatccccacccccgccatcaactggaagaaggacaacgtgctgctggccaacctgctgggcaagtacaccgccgagccctacggcgagctgatcctggagaacgtggtgctggaggacagcggcttctacacctgcgtggccaacaacgccgccggcgaggacacccacaccgtgagcctgaccgtgcacgtgctgcccaccttcaccgagctgcccggcgacgtgagcctgaacaagggcgagcagctgagactgagctgcaaggccaccggcatccccctgcccaagctgacctggaccttcaacaacaacatcatccccgcccacttcgacagcgtgaacggccacagcgagctggtgatcgagagagtgagcaaggaggacagcggcacctacgtgtgcaccgccgagaacagcgtgggcttcgtgaaggccatcggcttcgtgtacgtgaaggagccccccgtgttcaagggcgactaccccagcaactggatcgagcccctgggcggcaacgccatcctgaactgcgaggtgaagggcgaccccacccccaccatccagtggaacagaaagggcgtggacatcgagatcagccacagaatcagacagctgggcaacggcagcctggccatctacggcaccgtgaacgaggacgccggcgactacacctgcgtggccaccaacgaggccggcgtggtggagagaagcatgagcctgaccctgcagagcccccccatcatcaccctggagcccgtggagaccgtgatcaacgccggcggcaagatcatcctgaactgccaggccaccggcgagccccagcccaccatcacctggagcagacagggccacagcatcagctgggacgacagagtgaacgtgctgagcaacaacagcctgtacatcgccgacgcccagaaggaggacaccagcgagttcgagtgcgtggccagaaacctgatgggcagcgtgctggtgagagtgcccgtgatcgtgcaggtgcacggcggcttcagccagtggagcgcctggagagcctgcagcgtgacctgcggcaagggcatccagaagagaagcagactgtgcaaccagcccctgcccgccaacggcggcaagccctgccagggcagcgacctggagatgagaaactgccagaacaagccctgccccgtggacggcagctggagcgagtggagcctgtgggaggagtgcaccagaagctgcggcagaggcaaccagaccagaaccagaacctgcaacaaccccagcgtgcagcacggcggcagaccctgcgagggcaacgccgtggagatcatcatgtgcaacatcagaccctgccccgtgcacggcgcctggagcgcctggcagccctggggcacctgcagcgagagctgcggcaagggcacccagaccagagccagactgtgcaacaaccccccccccgccttcggcggcagctactgcgacggcgccgagacccagatgcaggtgtgcaacgagagaaactgccccatccacggcaagtgggccacctgggccagctggagcgcctgcagcgtgagctgcggcggcggcgccagacagagaaccagaggctgcagcgaccccgtgccccagtacggcggcagaaagtgcgagggcagcgacgtgcagagcgacttctgcaacagcgacccctgccccacccacggcaactggagcccctggagcggctggggcacctgcagcagaacctgcaacggcggccagatgagaagatacagaacctgcgacaaccccccccccagcaacggcggcagagcctgcggcggccccgacagccagatccagagatgcaacaccgacatgtgccccgtggacggcagctggggcagctggcacagctggagccagtgcagcgccagctgcggcggcggcgagaagaccagaaagagactgtgcgaccaccccgtgcccgtgaagggcggcagaccctgccccggcgacaccacccaggtgaccagatgcaacgtgcaggcctgccccggcggcccccagagagccagaggcagcgtgatcggcaacatcaacgacgtggagttcggcatcgccttcctgaacgccaccatcaccgacagccccaacagcgacaccagaatcatcagagccaagatcaccaacgtgcccagaagcctgggcagcgccatgagaaagatcgtgagcatcctgaaccccatctactggaccaccgccaaggagatcggcgaggccgtgaacggcttcaccctgaccaacgccgtgttcaagagagagacccaggtggagttcgccaccggcgagatcctgcagatgagccacatcgccagaggcctggacagcgacggcagcctgctgctggacatcgtggtgagcggctacgtgctgcagctgcagagccccgccgaggtgaccgtgaaggactacaccgaggactacatccagaccggccccggccagctgtacgcctacagcaccagactgttcaccatcgacggcatcagcatcccctacacctggaaccacaccgtgttctacgaccaggcccagggcagaatgcccttcctggtggagaccctgcacgccagcagcgtggagagcgactacaaccagatcgaggagaccctgggcttcaagatccacgccagcatcagcaagggcgacagaagcaaccagtgccccagcggcttcaccctggacagcgtgggccccttctgcgccgacgaggacgagtgcgccgccggcaacccctgcagccacagctgccacaacgccatgggcacctactactgcagctgccccaagggcctgaccatcgccgccgacggcagaacctgccaggacatcgacgagtgcgccctgggcagacacacctgccacgccggccaggactgcgacaacaccatcggcagctacagatgcgtggtgagatgcggcagcggcttcagaagaaccagcgacggcctgagctgccaggacatcaacgagtgccaggagagcagcccctgccaccagagatgcttcaacgccatcggcagcttccactgcggctgcgagcccggctaccagctgaagggcagaaagtgcatggacgtgaacgagtgcagacagaacgtgtgcagacccgaccagcactgcaagaacaccagaggcggctacaagtgcatcgacctgtgccccaacggcatgaccaaggccgagaacggcacctgcatcgacatcgacgagtgcaaggacggcacccaccagtgcagatacaaccagatctgcgagaacaccagaggcagctacagatgcgtgtgccccagaggctacagaagccagggcgtgggcagaccctgcatggacatcaacgagtgcgagcaggtgcccaagccctgcgcccaccagtgcagcaacacccccggcagcttcaagtgcatctgcccccccggccagcacctgctgggcgacggcaagagctgcgccggcctggagagactgcccaactacggcacccagtacagcagctacaacctggccagattcagccccgtgagaaacaactaccagccccagcagcactacagacagtacagccacctgtacagcagctacagcgagtacagaaacagcagaaccagcctgagcagaaccagaagaaccatcagaaagacctgccccgagggcagcgaggccagccacgacacctgcgtggacatcgacgagtgcgagaacaccgacgcctgccagcacgagtgcaagaacaccttcggcagctaccagtgcatctgcccccccggctaccagctgacccacaacggcaagacctgccaggacatcgacgagtgcctggagcagaacgtgcactgcggccccaacagaatgtgcttcaacatgagaggcagctaccagtgcatcgacaccccctgcccccccaactaccagagagaccccgtgagcggcttctgcctgaagaactgcccccccaacgacctggagtgcgccctgagcccctacgccctggagtacaagctggtgagcctgcccttcggcatcgccaccaaccaggacctgatcagactggtggcctacacccaggacggcgtgatgcaccccagaaccaccttcctgatggtggacgaggagcagaccgtgcccttcgccctgagagacgagaacctgaagggcgtggtgtacaccaccagacccctgagagaggccgagacctacagaatgagagtgagagccagcagctacagcgccaacggcaccatcgagtaccagaccaccttcatcgtgtacatcgccgtgagcgcctacccctactag

SEQ ID NO: 84277 - DNA, 16557 bp, Artificial Sequence
  Description of Artificial Sequence: Synthetic coding sequence
atgatcagctgggaggtggtgcacaccgtgttcctgttcgccctgctgtacagcagcctggcccaggacgccagcccccagagcgagatcagagccgaggagatccccgagggcgccagcaccctggccttcgtgttcgacgtgaccggcagcatgtacgacgacctggtgcaggtgatcgagggcgccagcaagatcctggagaccagcctgaagagacccaagagacccctgttcaacttcgccctggtgcccttccacgaccccgagatcggccccgtgaccatcaccaccgaccccaagaagttccagtacgagctgagagagctgtacgtgcagggcggcggcgactgccccgagatgagcatcggcgccatcaagatcgccctggagatcagcctgcccggcagcttcatctacgtgttcaccgacgccagaagcaaggactacagactgacccacgaggtgctgcagctgatccagcagaagcagagccaggtggtgttcgtgctgaccggcgactgcgacgacagaacccacatcggctacaaggtgtacgaggagatcgccagcaccagcagcggccaggtgttccacctggacaagaagcaggtgaacgaggtgctgaagtgggtggaggaggccgtgcaggccagcaaggtgcacctgctgagcaccgaccacctggagcaggccgtgaacacctggagaatccccttcgaccccagcctgaaggaggtgaccgtgagcctgagcggccccagccccatgatcgagatcagaaaccccctgggcaagctgatcaagaagggcttcggcctgcacgagctgctgaacatccacaacagcgccaaggtggtgaacgtgaaggagcccgaggccggcatgtggaccgtgaagaccagcagcagcggcagacacagcgtgagaatcaccggcctgagcaccatcgacttcagagccggcttcagcagaaagcccaccctggacttcaagaagaccgtgagcagacccgtgcagggcatccccacctacgtgctgctgaacaccagcggcatcagcacccccgccagaatcgacctgctggagctgctgagcatcagcggcagcagcctgaagaccatccccgtgaagtactacccccacagaaagccctacggcatctggaacatcagcgacttcgtgccccccaacgaggccttcttcctgaaggtgaccggctacgacaaggacgactacctgttccagagagtgagcagcgtgagcttcagcagcatcgtgcccgacgcccccaaggtgaccatgcccgagaagacccccggctactacctgcagcccggccagatcccctgcagcgtggacagcctgctgcccttcaccctgagcttcgtgagaaacggcgtgaccctgggcgtggaccagtacctgaaggagagcgccagcgtgaacctggacatcgccaaggtgaccctgagcgacgagggcttctacgagtgcatcgccgtgagcagcgccggcaccggcagagcccagaccttcttcgacgtgagcgagcccccccccgtgatccaggtgcccaacaacgtgaccgtgacccccggcgagagagccgtgctgacctgcctgatcatcagcgccgtggactacaacctgacctggcagagaaacgacagagacgtgagactggccgagcccgccagaatcagaaccctggccaacctgagcctggagctgaagagcgtgaagttcaacgacgccggcgagtaccactgcatggtgagcagcgagggcggcagcagcgccgccagcgtgttcctgaccgtgcaggagccccccaaggtgaccgtgatgcccaagaaccagagcttcaccggcggcagcgaggtgagcatcatgtgcagcgccaccggctaccccaagcccaagatcgcctggaccgtgaacgacatgttcatcgtgggcagccacagatacagaatgaccagcgacggcaccctgttcatcaagaacgccgcccccaaggacgccggcatctacggctgcctggccagcaacagcgccggcaccgacaagcagaacagcaccctgagatacatcgaggcccccaagctgatggtggtgcagagcgagctgctggtggccctgggcgacatcaccgtgatggagtgcaagaccagcggcatcccccccccccaggtgaagtggttcaagggcgacctggagctgagacccagcaccttcctgatcatcgaccccctgctgggcctgctgaagatccaggagacccaggacctggacgccggcgactacacctgcgtggccatcaacgaggccggcagagccaccggcaagatcaccctggacgtgggcagcccccccgtgttcatccaggagcccgccgacgtgagcatggagatcggcagcaacgtgaccctgccctgctacgtgcagggctaccccgagcccaccatcaagtggagaagactggacaacatgcccatcttcagcagacccttcagcgtgagcagcatcagccagctgagaaccggcgccctgttcatcctgaacctgtgggccagcgacaagggcacctacatctgcgaggccgagaaccagttcggcaagatccagagcgagaccaccgtgaccgtgaccggcctggtggcccccctgatcggcatcagccccagcgtggccaacgtgatcgagggccagcagctgaccctgccctgcaccctgctggccggcaaccccatccccgagagaagatggatcaagaacagcgccatgctgctgcagaacccctacatcaccgtgagaagcgacggcagcctgcacatcgagagagtgcagctgcaggacggcggcgagtacacctgcgtggccagcaacgtggccggcaccaacaacaagaccaccagcgtggtggtgcacgtgctgcccaccatccagcacggccagcagatcctgagcaccatcgagggcatccccgtgaccctgccctgcaaggccagcggcaaccccaagcccagcgtgatctggagcaagaagggcgagctgatcagcaccagcagcgccaagttcagcgccggcgccgacggcagcctgtacgtggtgagccccggcggcgaggagagcggcgagtacgtgtgcaccgccaccaacaccgccggctacgccaagagaaaggtgcagctgaccgtgtacgtgagacccagagtgttcggcgaccagagaggcctgagccaggacaagcccgtggagatcagcgtgctggccggcgaggaggtgaccctgccctgcgaggtgaagagcctgcccccccccatcatcacctgggccaaggagacccagctgatcagccccttcagccccagacacaccttcctgcccagcggcagcatgaagatcaccgagaccagaaccagcgacagcggcatgtacctgtgcgtggccaccaacatcgccggcaacgtgacccaggccgtgaagctgaacgtgcacgtgccccccaagatccagagaggccccaagcacctgaaggtgcaggtgggccagagagtggacatcccctgcaacgcccagggcacccccctgcccgtgatcacctggagcaagggcggcagcaccatgctggtggacggcgagcaccacgtgagcaaccccgacggcaccctgagcatcgaccaggccacccccagcgacgccggcatctacacctgcgtggccaccaacatcgccggcaccgacgagaccgagatcaccctgcacgtgcaggagccccccaccgtggaggacctggagcccccctacaacaccaccttccaggagagagtggccaaccagagaatcgagttcccctgccccgccaagggcacccccaagcccaccatcaagtggctgcacaacggcagagagctgaccggcagagagcccggcatcagcatcctggaggacggcaccctgctggtgatcgccagcgtgaccccctacgacaacggcgagtacatctgcgtggccgtgaacgaggccggcaccaccgagagaaagtacaacctgaaggtgcacgtgccccccgtgatcaaggacaaggagcaggtgaccaacgtgagcgtgctgctgaaccagctgaccaacctgttctgcgaggtggagggcacccccagccccatcatcatgtggtacaaggacaacgtgcaggtgaccgagagcagcaccatccagaccgtgaacaacggcaagatcctgaagctgttcagagccacccccgaggacgccggcagatacagctgcaaggccatcaacatcgccggcaccagccagaagtacttcaacatcgacgtgctggtgccccccaccatcatcggcaccaacttccccaacgaggtgagcgtggtgctgaacagagacgtggccctggagtgccaggtgaagggcacccccttccccgacatccactggttcaaggacggcaagcccctgttcctgggcgaccccaacgtggagctgctggacagaggccaggtgctgcacctgaagaacgccagaagaaacgacaagggcagataccagtgcaccgtgagcaacgccgccggcaagcaggccaaggacatcaagctgaccatctacatcccccccagcatcaagggcggcaacgtgaccaccgacatcagcgtgctgatcaacagcctgatcaagctggagtgcgagaccagaggcctgcccatgcccgccatcacctggtacaaggacggccagcccatcatgagcagcagccaggccctgtacatcgacaagggccagtacctgcacatccccagagcccaggtgagcgacagcgccacctacacctgccacgtggccaacgtggccggcaccgccgagaagagcttccacgtggacgtgtacgtgccccccatgatcgagggcaacctggccacccccctgaacaagcaggtggtgatcgcccacagcctgaccctggagtgcaaggccgccggcaaccccagccccatcctgacctggctgaaggacggcgtgcccgtgaaggccaacgacaacatcagaatcgaggccggcggcaagaagctggagatcatgagcgcccaggagatcgacagaggccagtacatctgcgtggccaccagcgtggccggcgagaaggagatcaagtacgaggtggacgtgctggtgccccccgccatcgagggcggcgacgagaccagctacttcatcgtgatggtgaacaacctgctggagctggactgccacgtgaccggcagccccccccccaccatcatgtggctgaaggacggccagctgatcgacgagagagacggcttcaagatcctgctgaacggcagaaagctggtgatcgcccaggcccaggtgagcaacaccggcctgtacagatgcatggccgccaacaccgccggcgaccacaagaaggagttcgaggtgaccgtgcacgtgccccccaccatcaagagcagcggcctgagcgagagagtggtggtgaagtacaagcccgtggccctgcagtgcatcgccaacggcatccccaaccccagcatcacctggctgaaggacgaccagcccgtgaacaccgcccagggcaacctgaagatccagagcagcggcagagtgctgcagatcgccaagaccctgctggaggacgccggcagatacacctgcgtggccaccaacgccgccggcgagacccagcagcacatccagctgcacgtgcacgagccccccagcctggaggacgccggcaagatgctgaacgagaccgtgctggtgagcaaccccgtgcagctggagtgcaaggccgccggcaaccccgtgcccgtgatcacctggtacaaggacaacagactgctgagcggcagcaccagcatgaccttcctgaacagaggccagatcatcgacatcgagagcgcccagatcagcgacgccggcatctacaagtgcgtggccatcaacagcgccggcgccaccgagctgttctacagcctgcaggtgcacgtggcccccagcatcagcggcagcaacaacatggtggccgtggtggtgaacaaccccgtgagactggagtgcgaggccagaggcatccccgcccccagcctgacctggctgaaggacggcagccccgtgagcagcttcagcaacggcctgcaggtgctgagcggcggcagaatcctggccctgaccagcgcccagatcagcgacaccggcagatacacctgcgtggccgtgaacgccgccggcgagaagcagagagacatcgacctgagagtgtacgtgccccccaacatcatgggcgaggagcagaacgtgagcgtgctgatcagccaggccgtggagctgctgtgccagagcgacgccatccccccccccaccctgacctggctgaaggacggccaccccctgctgaagaagcccggcctgagcatcagcgagaacagaagcgtgctgaagatcgaggacgcccaggtgcaggacaccggcagatacacctgcgaggccaccaacgtggccggcaagaccgagaagaactacaacgtgaacatctgggtgccccccaacatcggcggcagcgacgagctgacccagctgaccgtgatcgagggcaacctgatcagcctgctgtgcgagagcagcggcatccccccccccaacctgatctggaagaagaagggcagccccgtgctgaccgacagcatgggcagagtgagaatcctgagcggcggcagacagctgcagatcagcatcgccgagaagagcgacgccgccctgtacagctgcgtggccagcaacgtggccggcaccgccaagaaggagtacaacctgcaggtgtacatcagacccaccatcaccaacagcggcagccaccccaccgagatcatcgtgaccagaggcaagagcatcagcctggagtgcgaggtgcagggcatccccccccccaccgtgacctggatgaaggacggccaccccctgatcaaggccaagggcgtggagatcctggacgagggccacatcctgcagctgaagaacatccacgtgagcgacaccggcagatacgtgtgcgtggccgtgaacgtggccggcatgaccgacaagaagtacgacctgagcgtgcacgccccccccagcatcatcggcaaccacagaagccccgagaacatcagcgtggtggagaagaacagcgtgagcctgacctgcgaggccagcggcatccccctgcccagcatcacctggttcaaggacggctggcccgtgagcctgagcaacagcgtgagaatcctgagcggcggcagaatgctgagactgatgcagaccaccatggaggacgccggccagtacacctgcgtggtgagaaacgccgccggcgaggagagaaagatcttcggcctgagcgtgctggtgcccccccacatcgtgggcgagaacaccctggaggacgtgaaggtgaaggagaagcagagcgtgaccctgacctgcgaggtgaccggcaaccccgtgcccgagatcacctggcacaaggacggccagcccctgcaggaggacgaggcccaccacatcatcagcggcggcagattcctgcagatcaccaacgtgcaggtgccccacaccggcagatacacctgcctggccagcagccccgccggccacaagagcagaagcttcagcctgaacgtgttcgtgagccccaccatcgccggcgtgggcagcgacggcaaccccgaggacgtgaccgtgatcctgaacagccccaccagcctggtgtgcgaggcctacagctacccccccgccaccatcacctggttcaaggacggcacccccctggagagcaacagaaacatcagaatcctgcccggcggcagaaccctgcagatcctgaacgcccaggaggacaacgccggcagatacagctgcgtggccaccaacgaggccggcgagatgatcaagcactacgaggtgaaggtgtacatcccccccatcatcaacaagggcgacctgtggggccccggcctgagccccaaggaggtgaagatcaaggtgaacaacaccctgaccctggagtgcgaggcctacgccatccccagcgccagcctgagctggtacaaggacggccagcccctgaagagcgacgaccacgtgaacatcgccgccaacggccacaccctgcagatcaaggaggcccagatcagcgacaccggcagatacacctgcgtggccagcaacatcgccggcgaggacgagctggacttcgacgtgaacatccaggtgccccccagcttccagaagctgtgggagatcggcaacatgctggacaccggcagaaacggcgaggccaaggacgtgatcatcaacaaccccatcagcctgtactgcgagaccaacgccgcccccccccccaccctgacctggtacaaggacggccaccccctgaccagcagcgacaaggtgctgatcctgcccggcggcagagtgctgcagatccccagagccaaggtggaggacgccggcagatacacctgcgtggccgtgaacgaggccggcgaggacagcctgcagtacgacgtgagagtgctggtgccccccatcatcaagggcgccaacagcgacctgcccgaggaggtgaccgtgctggtgaacaagagcgccctgatcgagtgcctgagcagcggcagccccgcccccagaaacagctggcagaaggacggccagcccctgctggaggacgaccaccacaagttcctgagcaacggcagaatcctgcagatcctgaacacccagatcaccgacatcggcagatacgtgtgcgtggccgagaacaccgccggcagcgccaagaagtacttcaacctgaacgtgcacgtgccccccagcgtgatcggccccaagagcgagaacctgaccgtggtggtgaacaacttcatcagcctgacctgcgaggtgagcggcttccccccccccgacctgagctggctgaagaacgagcagcccatcaagctgaacaccaacaccctgatcgtgcccggcggcagaaccctgcagatcatcagagccaaggtgagcgacggcggcgagtacacctgcatcgccatcaaccaggccggcgagagcaagaagaagttcagcctgaccgtgtacgtgccccccagcatcaaggaccacgacagcgagagcctgagcgtggtgaacgtgagagagggcaccagcgtgagcctggagtgcgagagcaacgccgtgcccccccccgtgatcacctggtacaagaacggcagaatgatcaccgagagcacccacgtggagatcctggccgacggccagatgctgcacatcaagaaggccgaggtgagcgacaccggccagtacgtgtgcagagccatcaacgtggccggcagagacgacaagaacttccacctgaacgtgtacgtgccccccagcatcgagggccccgagagagaggtgatcgtggagaccatcagcaaccccgtgaccctgacctgcgacgccaccggcatccccccccccaccatcgcctggctgaagaaccacaagagaatcgagaacagcgacagcctggaggtgagaatcctgagcggcggcagcaagctgcagatcgccagaagccagcacagcgacagcggcaactacacctgcatcgccagcaacatggagggcaaggcccagaagtactacttcctgagcatccaggtgccccccagcgtggccggcgccgagatccccagcgacgtgagcgtgctgctgggcgagaacgtggagctggtgtgcaacgccaacggcatccccacccccctgatccagtggctgaaggacggcaagcccatcgccagcggcgagaccgagagaatcagagtgagcgccaacggcagcaccctgaacatctacggcgccctgaccagcgacaccggcaagtacacctgcgtggccaccaaccccgccggcgaggaggacagaatcttcaacctgaacgtgtacgtgacccccaccatcagaggcaacaaggacgaggccgagaagctgatgaccctggtggacaccagcatcaacatcgagtgcagagccaccggcaccccccccccccagatcaactggctgaagaacggcctgcccctgcccctgagcagccacatcagactgctggccgccggccaggtgatcagaatcgtgagagcccaggtgagcgacgtggccgtgtacacctgcgtggccagcaacagagccggcgtggacaacaagcactacaacctgcaggtgttcgccccccccaacatggacaacagcatgggcaccgaggagatcaccgtgctgaagggcagcagcaccagcatggcctgcatcaccgacggcacccccgcccccagcatggcctggctgagagacggccagcccctgggcctggacgcccacctgaccgtgagcacccacggcatggtgctgcagctgctgaaggccgagaccgaggacagcggcaagtacacctgcatcgccagcaacgaggccggcgaggtgagcaagcacttcatcctgaaggtgctggagcccccccacatcaacggcagcgaggagcacgaggagatcagcgtgatcgtgaacaaccccctggagctgacctgcatcgccagcggcatccccgcccccaagatgacctggatgaaggacggcagacccctgccccagaccgaccaggtgcagaccctgggcggcggcgaggtgctgagaatcagcaccgcccaggtggaggacaccggcagatacacctgcctggccagcagccccgccggcgacgacgacaaggagtacctggtgagagtgcacgtgccccccaacatcgccggcaccgacgagcccagagacatcaccgtgctgagaaacagacaggtgaccctggagtgcaagagcgacgccgtgcccccccccgtgatcacctggctgagaaacggcgagagactgcaggccacccccagagtgagaatcctgagcggcggcagatacctgcagatcaacaacgccgacctgggcgacaccgccaactacacctgcgtggccagcaacatcgccggcaagaccaccagagagttcatcctgaccgtgaacgtgccccccaacatcaagggcggcccccagagcctggtgatcctgctgaacaagagcaccgtgctggagtgcatcgccgagggcgtgcccacccccagaatcacctggagaaaggacggcgccgtgctggccggcaaccacgccagatacagcatcctggagaacggcttcctgcacatccagagcgcccacgtgaccgacaccggcagatacctgtgcatggccaccaacgccgccggcaccgacagaagaagaatcgacctgcaggtgcacgtgccccccagcatcgcccccggccccaccaacatgaccgtgatcgtgaacgtgcagaccaccctggcctgcgaggccaccggcatccccaagcccagcatcaactggagaaagaacggccacctgctgaacgtggaccagaaccagaacagctacagactgctgagcagcggcagcctggtgatcatcagccccagcgtggacgacaccgccacctacgagtgcaccgtgaccaacggcgccggcgacgacaagagaaccgtggacctgaccgtgcaggtgccccccagcatcgccgacgagcccaccgacttcctggtgaccaagcacgcccccgccgtgatcacctgcaccgccagcggcgtgcccttccccagcatccactggaccaagaacggcatcagactgctgcccagaggcgacggctacagaatcctgagcagcggcgccatcgagatcctggccacccagctgaaccacgccggcagatacacctgcgtggccagaaacgccgccggcagcgcccacagacacgtgaccctgcacgtgcacgagccccccgtgatccagccccagcccagcgagctgcacgtgatcctgaacaaccccatcctgctgccctgcgaggccaccggcacccccagccccttcatcacctggcagaaggagggcatcaacgtgaacaccagcggcagaaaccacgccgtgctgcccagcggcggcctgcagatcagcagagccgtgagagaggacgccggcacctacatgtgcgtggcccagaaccccgccggcaccgccctgggcaagatcaagctgaacgtgcaggtgccccccgtgatcagcccccacctgaaggagtacgtgatcgccgtggacaagcccatcaccctgagctgcgaggccgacggcctgcccccccccgacatcacctggcacaaggacggcagagccatcgtggagagcatcagacagagagtgctgagcagcggcagcctgcagatcgccttcgtgcagcccggcgacgccggccactacacctgcatggccgccaacgtggccggcagcagcagcaccagcaccaagctgaccgtgcacgtgccccccagaatcagaagcaccgagggccactacaccgtgaacgagaacagccaggccatcctgccctgcgtggccgacggcatccccacccccgccatcaactggaagaaggacaacgtgctgctggccaacctgctgggcaagtacaccgccgagccctacggcgagctgatcctggagaacgtggtgctggaggacagcggcttctacacctgcgtggccaacaacgccgccggcgaggacacccacaccgtgagcctgaccgtgcacgtgctgcccaccttcaccgagctgcccggcgacgtgagcctgaacaagggcgagcagctgagactgagctgcaaggccaccggcatccccctgcccaagctgacctggaccttcaacaacaacatcatccccgcccacttcgacagcgtgaacggccacagcgagctggtgatcgagagagtgagcaaggaggacagcggcacctacgtgtgcaccgccgagaacagcgtgggcttcgtgaaggccatcggcttcgtgtacgtgaaggagccccccgtgttcaagggcgactaccccagcaactggatcgagcccctgggcggcaacgccatcctgaactgcgaggtgaagggcgaccccacccccaccatccagtggaacagaaagggcgtggacatcgagatcagccacagaatcagacagctgggcaacggcagcctggccatctacggcaccgtgaacgaggacgccggcgactacacctgcgtggccaccaacgaggccggcgtggtggagagaagcatgagcctgaccctgcagagcccccccatcatcaccctggagcccgtggagaccgtgatcaacgccggcggcaagatcatcctgaactgccaggccaccggcgagccccagcccaccatcacctggagcagacagggccacagcatcagctgggacgacagagtgaacgtgctgagcaacaacagcctgtacatcgccgacgcccagaaggaggacaccagcgagttcgagtgcgtggccagaaacctgatgggcagcgtgctggtgagagtgcccgtgatcgtgcaggtgcacggcggcttcagccagtggagcgcctggagagcctgcagcgtgacctgcggcaagggcatccagaagagaagcagactgtgcaaccagcccctgcccgccaacggcggcaagccctgccagggcagcgacctggagatgagaaactgccagaacaagccctgccccgtggacggcagctggagcgagtggagcctgtgggaggagtgcaccagaagctgcggcagaggcaaccagaccagaaccagaacctgcaacaaccccagcgtgcagcacggcggcagaccctgcgagggcaacgccgtggagatcatcatgtgcaacatcagaccctgccccgtgcacggcgcctggagcgcctggcagccctggggcacctgcagcgagagctgcggcaagggcacccagaccagagccagactgtgcaacaaccccccccccgccttcggcggcagctactgcgacggcgccgagacccagatgcaggtgtgcaacgagagaaactgccccatccacggcaagtgggccacctgggccagctggagcgcctgcagcgtgagctgcggcggcggcgccagacagagaaccagaggctgcagcgaccccgtgccccagtacggcggcagaaagtgcgagggcagcgacgtgcagagcgacttctgcaacagcgacccctgccccacccacggcaactggagcccctggagcggctggggcacctgcagcagaacctgcaacggcggccagatgagaagatacagaacctgcgacaaccccccccccagcaacggcggcagagcctgcggcggccccgacagccagatccagagatgcaacaccgacatgtgccccgtggacggcagctggggcagctggcacagctggagccagtgcagcgccagctgcggcggcggcgagaagaccagaaagagactgtgcgaccaccccgtgcccgtgaagggcggcagaccctgccccggcgacaccacccaggtgaccagatgcaacgtgcaggcctgccccggcggcccccagagagccagaggcagcgtgatcggcaacatcaacgacgtggagttcggcatcgccttcctgaacgccaccatcaccgacagccccaacagcgacaccagaatcatcagagccaagatcaccaacgtgcccagaagcctgggcagcgccatgagaaagatcgtgagcatcctgaaccccatctactggaccaccgccaaggagatcggcgaggccgtgaacggcttcaccctgaccaacgccgtgttcaagagagagacccaggtggagttcgccaccggcgagatcctgcagatgagccacatcgccagaggcctggacagcgacggcagcctgctgctggacatcgtggtgagcggctacgtgctgcagctgcagagccccgccgaggtgaccgtgaaggactacaccgaggactacatccagaccggccccggccagctgtacgcctacagcaccagactgttcaccatcgacggcatcagcatcccctacacctggaaccacaccgtgttctacgaccaggcccagggcagaatgcccttcctggtggagaccctgcacgccagcagcgtggagagcgactacaaccagatcgaggagaccctgggcttcaagatccacgccagcatcagcaagggcgacagaagcaaccagtgccccagcggcttcaccctggacagcgtgggccccttctgcgccgacgaggacgagtgcgccgccggcaacccctgcagccacagctgccacaacgccatgggcacctactactgcagctgccccaagggcctgaccatcgccgccgacggcagaacctgccaggacatcgacgagtgcgccctgggcagacacacctgccacgccggccaggactgcgacaacaccatcggcagctacagatgcgtggtgagatgcggcagcggcttcagaagaaccagcgacggcctgagctgccaggacatcaacgagtgccaggagagcagcccctgccaccagagatgcttcaacgccatcggcagcttccactgcggctgcgagcccggctaccagctgaagggcagaaagtgcatggacgtgaacgagtgcagacagaacgtgtgcagacccgaccagcactgcaagaacaccagaggcggctacaagtgcatcgacctgtgccccaacggcatgaccaaggccgagaacggcacctgcatcgacatcgacgagtgcaaggacggcacccaccagtgcagatacaaccagatctgcgagaacaccagaggcagctacagatgcgtgtgccccagaggctacagaagccagggcgtgggcagaccctgcatggacatcgacgagtgcgagaacaccgacgcctgccagcacgagtgcaagaacaccttcggcagctaccagtgcatctgcccccccggctaccagctgacccacaacggcaagacctgccaggacatcgacgagtgcctggagcagaacgtgcactgcggccccaacagaatgtgcttcaacatgagaggcagctaccagtgcatcgacaccccctgcccccccaactaccagagagaccccgtgagcggcttctgcctgaagaactgcccccccaacgacctggagtgcgccctgagcccctacgccctggagtacaagctggtgagcctgcccttcggcatcgccaccaaccaggacctgatcagactggtggcctacacccaggacggcgtgatgcaccccagaaccaccttcctgatggtggacgaggagcagaccgtgcccttcgccctgagagacgagaacctgaagggcgtggtgtacaccaccagacccctgagagaggccgagacctacagaatgagagtgagagccagcagctacagcgccaacggcaccatcgagtaccagaccaccttcatcgtgtacatcgccgtgagcgcctacccctactag

SEQ ID NO: 84278 - DNA, 723 bp, Artificial Sequence
  Description of Artificial Sequence: Synthetic coding sequence
gccatcggcagcttccactgcggctgcgagcccggctaccagctgaagggcagaaagtgcatggacgtgaacgagtgcagacagaacgtgtgcagacccgaccagcactgcaagaacaccagaggcggctacaagtgcatcgacctgtgccccaacggcatgaccaaggccgagaacggcacctgcatcgacatcgacgagtgcaaggacggcacccaccagtgcagatacaaccagatctgcgagaacaccagaggcagctacagatgcgtgtgccccagaggctacagaagccagggcgtgggcagaccctgcatggacatcgacgagtgcgagaacaccgacgcctgccagcacgagtgcaagaacaccttcggcagctaccagtgcatctgcccccccggctaccagctgacccacaacggcaagacctgccaggacatcgacgagtgcctggagcagaacgtgcactgcggccccaacagaatgtgcttcaacatgagaggcagctaccagtgcatcgacaccccctgcccccccaactaccagagagaccccgtgagcggcttctgcctgaagaactgcccccccaacgacctggagtgcgccctgagcccctacgccctggagtacaagctggtgagcctgcccttcggcatcgccaccaaccaggacctgatcagactggtggcctacacccaggacggcgtgatgcacccctag

SEQ ID NO: 84279 - DNA, 1455 bp, Artificial Sequence
  Description of Artificial Sequence: Synthetic coding sequence
atggacctgggcaaggaccagagccacctgaagcaccaccagacccccgacccccaccaggaggagaaccacagccccgaggtgatcggcacctggagcctgagaaacagagagctgctgagaaagagaaaggccgaggtgcacgagaaggagaccagccagtggctgttcggcgagcagaagaagagaaagcagcagagaaccggcaagggcaacagaagaggcagaaagagacagcagaacaccgagctgaaggtggagccccagccccagatcgagaaggagatcgtggagaaggccctggcccccatcgagaagaagaccgagccccccggcagcatcaccaaggtgttccccagcgtggccagcccccagaaggtggtgcccgaggagcacttcagcgagatctgccaggagagcaacatctaccaggagaacttcagcgagtaccaggagatcgccgtgcagaaccacagcagcgagacctgccagcacgtgagcgagcccgaggacctgagccccaagatgtaccaggagatcagcgtgctgcaggacaacagcagcaagatctgccaggacatgaaggagcccgaggacaacagccccaacacctgccaggtgatcagcgtgatccaggaccaccccttcaagatgtaccaggacatggccaagagagaggacctggcccccaagatgtgccaggaggccgccgtgcccaagatcctgccctgccccaccagcgaggacaccgccgacctggccggctgcagcctgcaggcctaccccaagcccgacgtgcccaagggctacatcctggacaccgaccagaaccccgccgagcccgaggagtacaacgagaccgaccagggcatcgccgagaccgagggcctgttccccaagatccaggagatcgccgagcccaaggacctgagcaccaagacccaccaggagagcgccgagcccaagtacctgccccacaagacctgcaacgagatcatcgtgcccaaggcccccagccacaagaccatccaggagaccccccacagcgaggactacagcatcgagatcaaccaggagacccccggcagcgagaagtacagccccgagacctaccaggagatccccggcctggaggagtacagccccgagatctaccaggagaccagccagctggaggagtacagccccgagatctaccaggagacccccggccccgaggacctgagcaccgagacctacaagaacaaggacgtgcccaaggagtgcttccccgagccccaccaggagaccggcggcccccagggccaggaccccaaggcccaccaggaggacgccaaggacgcctacaccttcccccaggagatgaaggagaagcccaaggaggagcccggcatccccgccatcctgaacgagagccaccccgagaacgacgtgtacagctacgtgctgttctag

SEQ ID NO: 84280 - DNA, 1455 bp, Artificial Sequence; identical to SEQ ID NO: 84279
  Description of Artificial Sequence: Synthetic coding sequence

SEQ ID NO: 84281 - DNA, 429 bp, Artificial Sequence
  Description of Artificial Sequence: Synthetic coding sequence
atggtgctgagccccgccgacaagaccaacgtgaaggccgcctggggcaaggtgggcgcccacgccggcgagtacggcgccgaggccctggagagaatgttcctgagcttccccaccaccaagacctacttcccccacttcgacctgagccacggcagcgcccaggtgaagggccacggcaagaaggtggccgacgccctgaccaacgccgtggcccacgtggacgacatgcccaacgccctgagcgccctgagcgacctgcacgcccacaagctgagagtggaccccgtgaacttcaagctgctgagccactgcctgctggtgaccctggccgcccacctgcccgccgagttcacccccgccgtgcacgccagcctggacaagttcctggccagcgtgagcaccgtgctgaccagcaagtacagatag

SEQ ID NO: 84282 - DNA, 429 bp, Artificial Sequence; identical to SEQ ID NO: 84281
  Description of Artificial Sequence: Synthetic coding sequence

SEQ ID NO: 84283 - DNA, 333 bp, Artificial Sequence
  Description of Artificial Sequence: Synthetic coding sequence
atgttcctgagcttccccaccaccaagacctacttcccccacttcgacctgagccacggcagcgcccaggtgaagggccacggcaagaaggtggccgacgccctgaccaacgccgtggcccacgtggacgacatgcccaacgccctgagcgccctgagcgacctgcacgcccacaagctgagagtggaccccgtgaacttcaagctgctgagccactgcctgctggtgaccctggccgcccacctgcccgccgagttcacccccgccgtgcacgccagcctggacaagttcctggccagcgtgagcaccgtgctgaccagcaagtacagatag

SEQ ID NO: 84284 - DNA, 444 bp, Artificial Sequence
  Description of Artificial Sequence: Synthetic coding sequence
atggtgcacctgacccccgaggagaagagcgccgtgaccgccctgtggggcaaggtgaacgtggacgaggtgggcggcgaggccctgggcagactgctggtggtgtacccctggacccagagattcttcgagagcttcggcgacctgagcacccccgacgccgtgatgggcaaccccaaggtgaaggcccacggcaagaaggtgctgggcgccttcagcgacggcctggcccacctggacaacctgaagggcaccttcgccaccctgagcgagctgcactgcgacaagctgcacgtggaccccgagaacttcagactgctgggcaacgtgctggtgtgcgtgctggcccaccacttcggcaaggagttcaccccccccgtgcaggccgcctaccagaaggtggtggccggcgtggccaacgccctggcccacaagtaccactag

SEQ ID NO: 84285 - DNA, 273 bp, Artificial Sequence
  Description of Artificial Sequence: Synthetic coding sequence
atggtgcacctgacccccgaggagaagagcgccgtgaccgccctgtggggcaaggtgaacgtggacgaggtgggcggcgaggccctgggcagactgctggtggtgtacccctggacccagagattcttcgagagcttcggcgacctgagcacccccgacgccgtgatgggcaaccccaaggtgaaggcccacggcaagaaggtgctgggcgccttcagcgacggcctggcccacctggacaacctgaagggcaccttcgccaccctgagctag

SEQ ID NO: 84286 - DNA, 426 bp, Artificial Sequence
  Description of Artificial Sequence: Synthetic coding sequence
atggtgcacctgacccccgaggagaagaccgccgtgaacgccctgtggggcaaggtgaacgtggacgccgtgggcggcgaggccctgggcagactgctggtggtgtacccctggacccagagattcttcgagagcttcggcgacctgagcagccccgacgccgtgatgggcaaccccaaggtgaaggcccacggcaagaaggtgctgggcgccttcagcgacggcctggcccacctggacaacctgaagggcaccttcagccagctgagcgagctgcactgcgacaagctgcacgtggaccccgagaacttcagagtgtgcaagaaggtgcccgaggccctgcagatcggcagcacctgcctgttctacaaggagtacatgggcaaggagaagagcaagggcaccgtgcagggcatcaacggctag

SEQ ID NO: 84287 - DNA, 444 bp, Artificial Sequence
  Description of Artificial Sequence: Synthetic coding sequence
atggtgcacctgacccccgaggagaagaccgccgtgaacgccctgtggggcaaggtgaacgtggacgccgtgggcggcgaggccctgggcagactgctggtggtgtacccctggacccagagattcttcgagagcttcggcgacctgagcagccccgacgccgtgatgggcaaccccaaggtgaaggcccacggcaagaaggtgctgggcgccttcagcgacggcctggcccacctggacaacctgaagggcaccttcagccagctgagcgagctgcactgcgacaagctgcacgtggaccccgagaacttcagactgctgggcaacgtgctggtgtgcgtgctggccagaaacttcggcaaggagttcaccccccagatgcaggccgcctaccagaaggtggtggccggcgtggccaacgccctggcccacaagtaccactag

SEQ ID NO: 84288 - DNA, 315 bp, Artificial Sequence
  Description of Artificial Sequence: Synthetic coding sequence
atggtgcacctgacccccgaggagaagaccgccgtgaacgccctgtggggcaaggtgaacgtggacgccgtgggcggcgaggccctgggcagactgctggtggtgtacccctggacccagagattcttcgagagcttcggcgacctgagcagccccgacgccgtgatgggcaaccccaaggtgaaggcccacggcaagaaggtgctgggcgccttcagcgacggcctggcccacctggacaacctgaagggcaccttcagccagctgagcgagctgcactgcgacaagctgcacgtggaccccgagaacttctag

SEQ ID NO: 84289 - DNA, 444 bp, Artificial Sequence
  Description of Artificial Sequence: Synthetic coding sequence
atggtgcacttcaccgccgaggagaaggccgccgtgaccagcctgtggagcaagatgaacgtggaggaggccggcggcgaggccctgggcagactgctggtggtgtacccctggacccagagattcttcgacagcttcggcaacctgagcagccccagcgccatcctgggcaaccccaaggtgaaggcccacggcaagaaggtgctgaccagcttcggcgacgccatcaagaacatggacaacctgaagcccgccttcgccaagctgagcgagctgcactgcgacaagctgcacgtggaccccgagaacttcaagctgctgggcaacgtgatggtgatcatcctggccacccacttcggcaaggagttcacccccgaggtgcaggccgcctggcagaagctggtgagcgccgtggccatcgccctggcccacaagtaccactag

SEQ ID NO: 84290 - DNA, 444 bp, Artificial Sequence; identical to SEQ ID NO: 84289
  Description of Artificial Sequence: Synthetic coding sequence

SEQ ID NO: 84291 - DNA, 264 bp, Artificial Sequence
  Description of Artificial Sequence: Synthetic coding sequence
atggtgcacttcaccgccgaggagaaggccgccgtgaccagcctgtggagcaagatgaacgtggaggaggccggcggcgaggccctgggcagactgctggtggtgtacccctggacccagagattcttcgacagcttcggcaacctgagcagccccagcgccatcctgggcaaccccaaggtgaaggcccacggcaagaaggtgctgaccagcttcggcgacgccatcaagaacatggacaacctgaagcccgccttcgcctag

SEQ ID NO: 84292 - DNA, 444 bp, Artificial Sequence
  Description of Artificial Sequence: Synthetic coding sequence
atgggccacttcaccgaggaggacaaggccaccatcaccagcctgtggggcaaggtgaacgtggaggacgccggcggcgagaccctgggcagactgctggtggtgtacccctggacccagagattcttcgacagcttcggcaacctgagcagcgccagcgccatcatgggcaaccccaaggtgaaggcccacggcaagaaggtgctgaccagcctgggcgacgccaccaagcacctggacgacctgaagggcaccttcgcccagctgagcgagctgcactgcgacaagctgcacgtggaccccgagaacttcaagctgctgggcaacgtgctggtgaccgtgctggccatccacttcggcaaggagttcacccccgaggtgcaggccagctggcagaagatggtgaccgccgtggccagcgccctgagcagcagataccactag

SEQ ID NO: 84293 - DNA, 444 bp, Artificial Sequence
  Description of Artificial Sequence: Synthetic coding sequence
atgggccacttcaccgaggaggacaaggccaccatcaccagcctgtggggcaaggtgaacgtggaggacgccggcggcgagaccctgggcagactgctggtggtgtacccctggacccagagattcttcgacagcttcggcaacctgagcagcgccagcgccatcatgggcaaccccaaggtgaaggcccacggcaagaaggtgctgaccagcctgggcgacgccatcaagcacctggacgacctgaagggcaccttcgcccagctgagcgagctgcactgcgacaagctgcacgtggaccccgagaacttcaagctgctgggcaacgtgctggtgaccgtgctggccatccacttcggcaaggagttcacccccgaggtgcaggccagctggcagaagatggtgaccggcgtggccagcgccctgagcagcagataccactag

SEQ ID NO: 84294 - DNA, 477 bp, Artificial Sequence
  Description of Artificial Sequence: Synthetic coding sequence
atgggccacttcaccgaggaggacaaggccaccatcaccagcctgtggggcaaggtgaacgtggaggacgccggcggcgagaccctgggcagactgctggtggtgtacccctggacccagagattcttcgacagcttcggcaacctgagcagcgccagcgccatcatgggcaaccccaaggtgaaggcccacggcaagaaggtgctgaccagcctgggcgacgccatcaagcacctggacgacctgaagggcaccttcgcccagctgagcgagctgcactgcgacaagctgcacgtggaccccgagaacttcaagctgctgggcaacgtgctggtgaccgtgctggccatccacttcggcaaggagttcacccccgaggtgcaggccagctggcagaagatggactggagcggccagtgccccgtgctgcagatccccctgagcagcctgcccatgatgcagagcttccagggctag

SEQ ID NO: 84295 - DNA, 414 bp, Artificial Sequence
  Description of Artificial Sequence: Synthetic coding sequence
atggtggtgctgggcgagatgaagagaaaggtgctgcccctgcacttcctgcccttcatgagactgctggtggtgtacccctggacccagagattcttcgacagcttcggcaacctgagcagcgccagcgccatcatgggcaaccccaaggtgaaggcccacggcaagaaggtgctgaccagcctgggcgacgccatcaagcacctggacgacctgaagggcaccttcgcccagctgagcgagctgcactgcgacaagctgcacgtggaccccgagaacttcaagctgctgggcaacgtgctggtgaccgtgctggccatccacttcggcaaggagttcacccccgaggtgcaggccagctggcagaagatggtgaccggcgtggccagcgccctgagcagcagataccactag

SEQ ID NO: 84296 - DNA, 444 bp, Artificial Sequence; identical to SEQ ID NO: 84293
  Description of Artificial Sequence: Synthetic coding sequence

SEQ ID NO: 84297 - DNA, 426 bp, Artificial Sequence
  Description of Artificial Sequence: Synthetic coding sequence
atgctgagcgcccaggagagagcccagatcgcccaggtgtgggacctgatcgccggccacgaggcccagttcggcgccgagctgctgctgagactgttcaccgtgtaccccagcaccaaggtgtacttcccccacctgagcgcctgccaggacgccacccagctgctgagccacggccagagaatgctggccgccgtgggcgccgccgtgcagcacgtggacaacctgagagccgccctgagccccctggccgacctgcacgccctggtgctgagagtggaccccgccaacttccccctgctgatccagtgcttccacgtggtgctggccagccacctgcaggacgagttcaccgtgcagatgcaggccgcctgggacaagttcctgaccggcgtggccgtggtgctgaccgagaagtacagatag

SEQ ID NO: 84298 - DNA, 429 bp, Artificial Sequence
  Description of Artificial Sequence: Synthetic coding sequence
atggccctgagcgccgaggacagagccctggtgagagccctgtggaagaagctgggcagcaacgtgggcgtgtacaccaccgaggccctggagagaaccttcctggccttccccgccaccaagacctacttcagccacctggacctgagccccggcagcagccaggtgagagcccacggccagaaggtggccgacgccctgagcctggccgtggagagactggacgacctgccccacgccctgagcgccctgagccacctgcacgcctgccagctgagagtggaccccgccagcttccagctgctgggccactgcctgctggtgaccctggccagacactaccccggcgacttcagccccgccctgcaggccagcctggacaagttcctgagccacgtgatcagcgccctggtgagcgagtacagatag

SEQ ID NO: 84299 - DNA, 429 bp, Artificial Sequence
  Description of Artificial Sequence: Synthetic coding sequence
atgagcctgaccaagaccgagagaaccatcatcgtgagcatgtgggccaagatcagcacccaggccgacaccatcggcaccgagaccctggagagactgttcctgagccacccccagaccaagacctacttcccccacttcgacctgcaccccggcagcgcccagctgagagcccacggcagcaaggtggtggccgccgtgggcgacgccgtgaagagcatcgacgacatcggcggcgccctgagcaagctgagcgagctgcacgcctacatcctgagagtggaccccgtgaacttcaagctgctgagccactgcctgctggtgaccctggccgccagattccccgccgacttcaccgccgaggcccacgccgcctgggacaagttcctgagcgtggtgagcagcgtgctgaccgagaagtacagatag

SEQ ID NO: 84300 - DNA, 1389 bp, Artificial Sequence
  Description of Artificial Sequence: Synthetic coding sequence
atggccagagtgctgggcgcccccgtggccctgggcctgtggagcctgtgctggagcctggccatcgccacccccctgccccccaccagcgcccacggcaacgtggccgagggcgagaccaagcccgaccccgacgtgaccgagagatgcagcgacggctggagcttcgacgccaccaccctggacgacaacggcaccatgctgttcttcaagggcgagttcgtgtggaagagccacaagtgggacagagagctgatcagcgagagatggaagaacttccccagccccgtggacgccgccttcagacagggccacaacagcgtgttcctgatcaagggcgacaaggtgtgggtgtacccccccgagaagaaggagaagggctaccccaagctgctgcaggacgagttccccggcatccccagccccctggacgccgccgtggagtgccacagaggcgagtgccaggccgagggcgtgctgttcttccagggcgacagagagtggttctgggacctggccaccggcaccatgaaggagagaagctggcccgccgtgggcaactgcagcagcgccctgagatggctgggcagatactactgcttccagggcaaccagttcctgagattcgaccccgtgagaggcgaggtgccccccagataccccagagacgtgagagactacttcatgccctgccccggcagaggccacggccacagaaacggcaccggccacggcaacagcacccaccacggccccgagtacatgagatgcagcccccacctggtgctgagcgccctgaccagcgacaaccacggcgccacctacgccttcagcggcacccactactggagactggacaccagcagagacggctggcacagctggcccatcgcccaccagtggccccagggccccagcgccgtggacgccgccttcagctgggaggagaagctgtacctggtgcagggcacccaggtgtacgtgttcctgaccaagggcggctacaccctggtgagcggctaccccaagagactggagaaggaggtgggcaccccccacggcatcatcctggacagcgtggacgccgccttcatctgccccggcagcagcagactgcacatcatggccggcagaagactgtggtggctggacctgaagagcggcgcccaggccacctggaccgagctgccctggccccacgagaaggtggacggcgccctgtgcatggagaagagcctgggccccaacagctgcagcgccaacggccccggcctgtacctgatccacggccccaacctgtactgctacagcgacgtggagaagctgaacgccgccaaggccctgccccagccccagaacgtgaccagcctgctgggctgcacccactag

SEQ ID NO: 84301 - DNA, 765 bp, Artificial Sequence
  Description of Artificial Sequence: Synthetic coding sequence
atggccagagtgctgggcgcccccgtggccctgggcctgtggagcctgtgctggagcctggccatcgccacccccctgccccccaccagcgcccacggcaacgtggccgagggcgagaccaagcccgaccccgacgtgaccgagagatgcagcgacggctggagcttcgacgccaccaccctggacgacaacggcaccatgctgttcttcaagggcgagttcgtgtggaagagccacaagtgggacagagagctgatcagcgagagatggaagaacttccccagccccgtggacgccgccttcagacagggccacaacagcgtgttcctgatcaagggcgacaaggtgtgggtgtacccccccgagaagaaggagaagggctaccccaagctgctgcaggacgagttccccggcatccccagccccctggacgccgccgtggagtgccacagaggcgagtgccaggccgagggcgtgctgttcttccagggcgacagagagtggttctgggacctggccaccggcaccatgaaggagagaagctggcccgccgtgggcaactgcagcagcgccctgagatggctgggcagatactactgcttccagggcaaccagttcctgagattcgaccccgtgagaggcgaggtgccccccagataccccagagacgtgagagactacttcatgccctgccccggcagaggccacggccacagaaacggcaccggccacggcaacagcatctgcgccgtggcccacatctag

SEQ ID NO: 84302 - DNA, 1353 bp, Artificial Sequence
  Description of Artificial Sequence: Synthetic coding sequence
atgtggctgaaggtgttcaccaccttcctgagcttcgccaccggcgcctgcagcggcctgaaggtgaccgtgcccagccacaccgtgcacggcgtgagaggccaggccctgtacctgcccgtgcactacggcttccacacccccgccagcgacatccagatcatctggctgttcgagagaccccacaccatgcccaagtacctgctgggcagcgtgaacaagagcgtggtgcccgacctggagtaccagcacaagttcaccatgatgccccccaacgccagcctgctgatcaaccccctgcagttccccgacgagggcaactacatcgtgaaggtgaacatccagggcaacggcaccctgagcgccagccagaagatccaggtgaccgtggacgaccccgtgaccaagcccgtggtgcagatccacccccccagcggcgccgtggagtacgtgggcaacatgaccctgacctgccacgtggagggcggcaccagactggcctaccagtggctgaagaacggcagacccgtgcacaccagcagcacctacagcttcagcccccagaacaacaccctgcacatcgcccccgtgaccaaggaggacatcggcaactacagctgcctggtgagaaaccccgtgagcgagatggagagcgacatcatcatgcccatcatctactacggcccctacggcctgcaggtgaacagcgacaagggcctgaaggtgggcgaggtgttcaccgtggacctgggcgaggccatcctgttcgactgcagcgccgacagccacccccccaacacctacagctggatcagaagaaccgacaacaccacctacatcatcaagcacggccccagactggaggtggccagcgagaaggtggcccagaagaccatggactacgtgtgctgcgcctacaacaacatcaccggcagacaggacgagacccacttcaccgtgatcatcaccagcgtgggcctggagaagctggcccagaagggcaagagcctgagccccctggccagcatcaccggcatcagcctgttcctgatcatcagcatgtgcctgctgttcctgtggaagaagtaccagccctacaaggtgatcaagcagaagctggagggcagacccgagaccgagtacagaaaggcccagaccttcagcggccacgaggacgccctggacgacttcggcatctacgagttcgtggccttccccgacgtgagcggcgtgagcagaatccccagcagaagcgtgcccgccagcgactgcgtgagcggccaggacctgcacagcaccgtgtacgaggtgatccagcacatccccgcccagcagcaggaccaccccgagtag

SEQ ID NO: 84303 - DNA, 1389 bp, Artificial Sequence
  Description of Artificial Sequence: Synthetic coding sequence
atgggccaggacgccttcatggagcccttcggcgacaccctgggcgtgttccagtgcaagatctacctgctgctgttcggcgcctgcagcggcctgaaggtgaccgtgcccagccacaccgtgcacggcgtgagaggccaggccctgtacctgcccgtgcactacggcttccacacccccgccagcgacatccagatcatctggctgttcgagagaccccacaccatgcccaagtacctgctgggcagcgtgaacaagagcgtggtgcccgacctggagtaccagcacaagttcaccatgatgccccccaacgccagcctgctgatcaaccccctgcagttccccgacgagggcaactacatcgtgaaggtgaacatccagggcaacggcaccctgagcgccagccagaagatccaggtgaccgtggacgaccccgtgaccaagcccgtggtgcagatccacccccccagcggcgccgtggagtacgtgggcaacatgaccctgacctgccacgtggagggcggcaccagactggcctaccagtggctgaagaacggcagacccgtgcacaccagcagcacctacagcttcagcccccagaacaacaccctgcacatcgcccccgtgaccaaggaggacatcggcaactacagctgcctggtgagaaaccccgtgagcgagatggagagcgacatcatcatgcccatcatctactacggcccctacggcctgcaggtgaacagcgacaagggcctgaaggtgggcgaggtgttcaccgtggacctgggcgaggccatcctgttcgactgcagcgccgacagccacccccccaacacctacagctggatcagaagaaccgacaacaccacctacatcatcaagcacggccccagactggaggtggccagcgagaaggtggcccagaagaccatggactacgtgtgctgcgcctacaacaacatcaccggcagacaggacgagacccacttcaccgtgatcatcaccagcgtgggcctggagaagctggcccagaagggcaagagcctgagccccctggccagcatcaccggcatcagcctgttcctgatcatcagcatgtgcctgctgttcctgtggaagaagtaccagccctacaaggtgatcaagcagaagctggagggcagacccgagaccgagtacagaaaggcccagaccttcagcggccacgaggacgccctggacgacttcggcatctacgagttcgtggccttccccgacgtgagcggcgtgagcagaatccccagcagaagcgtgcccgccagcgactgcgtgagcggccaggacctgcacagcaccgtgtacgaggtgatccagcacatccccgcccagcagcaggaccaccccgagtag

SEQ ID NO: 84304 - DNA, 1104 bp, Artificial Sequence
  Description of Artificial Sequence: Synthetic coding sequence
atggcctacagagtgctgggcagagccggccccccccagcccagaagagccagaagactgctgttcgccttcaccctgagcctgagctgcacctacctgtgctacagcttcctgtgctgctgcgacgacctgggcagaagcagactgctgggcgcccccagatgcctgagaggccccagcgccggcggccagaagctgctgcagaagagcagaccctgcgaccccagcggccccacccccagcgagcccagcgcccccagcgcccccgccgccgccgtgcccgcccccagactgagcggcagcaaccacagcggcagccccaagctgggcaccaagagactgccccaggccctgatcgtgggcgtgaagaagggcggcaccagagccgtgctggagttcatcagagtgcaccccgacgtgagagccctgggcaccgagccccacttcttcgacagaaactacggcagaggcctggactggtacagaagcctgatgcccagaaccctggagagccagatcaccctggagaagacccccagctacttcgtgacccaggaggcccccagaagaatcttcaacatgagcagagacaccaagctgatcgtggtggtgagaaaccccgtgaccagagccatcagcgactacacccagaccctgagcaagaagcccgacatccccaccttcgagggcctgagcttcagaaacagaaccctgggcctggtggacgtgagctggaacgccatcagaatcggcatgtacgtgctgcacctggagagctggctgcagtacttccccctggcccagatccacttcgtgagcggcgagagactgatcaccgaccccgccggcgagatgggcagagtgcaggacttcctgggcatcaagagattcatcaccgacaagcacttctacttcaacaagaccaagggcttcccctgcctgaagaagaccgagagcagcctgctgcccagatgcctgggcaagagcaagggcagaacccacgtgcagatcgaccccgaggtgatcgaccagctgagagagttctacagaccctacaacatcaagttctacgagaccgtgggccaggacttcagatgggagtag

SEQ ID NO: 84305 - DNA, 1035 bp, Artificial Sequence
  Description of Artificial Sequence: Synthetic coding sequence
ccccccgccagagcccacggcgccatggcctacagagtgctgggcagagccggccccccccagcccagaagagccagaagactgctgttcgccttcaccctgagcctgagctgcacctacctgtgctacagcttcctgtgctgctgcgacgacctgggcagaagcagactgctgggcgcccccagatgcctgagaggccccagcgccggcggccagaagctgctgcagaagagcagaccctgcgaccccagcggccccacccccagcgagcccagcgcccccagcgcccccgccgccgccgtgcccgcccccagactgagcggcagcaaccacagcggcagccccaagctgggcaccaagagactgccccaggccctgatcgtgggcgtgaagaagggcggcaccagagccgtgctggagttcatcagagtgcaccccgacgtgagagccctgggcaccgagccccacttcttcgacagaaactacggcagaggcctggactggtacagaagcctgatgcccagaaccctggagagccagatcaccctggagaagacccccagctacttcgtgacccaggaggcccccagaagaatcttcaacatgagcagagacaccaagctgatcgtggtggtgagaaaccccgtgaccagagccatcagcgactacacccagaccctgagcaagaagcccgacatccccaccttcgagggcctgagcttcagaaacagaaccctgggcctggtggacgtgagctggaacgccatcagaatcggcatgtacgtgctgcacctggagagctggctgcagtacttccccctggcccagatccacttcgtgagcggcgagagactgatcaccgaccccgccggcgagatgggcagagtgcaggacttcctgggcatcaagagattcatcaccgacaagcacttctacttcaacaagaccaagggcttcccctgcctgaagaacagaatcgagccccccgccagcatgctgggccagatcaagagagagaacagctgcaccgactag

SEQ ID NO: 84306 - DNA, 1221 bp, Artificial Sequence
  Description of Artificial Sequence: Synthetic coding sequence
atggccccccccggccccgccagcgccctgagcaccagcgccgagcccctgagcagaagcatcttcagaaagttcctgctgatgctgtgcagcctgctgaccagcctgtacgtgttctactgcctggccgagagatgccagaccctgagcggccccgtggtgggcctgagcggcggcggcgaggaggccggcgcccccggcggcggcgtgctggccggcggccccagagagctggccgtgtggcccgccgccgcccagagaaagagactgctgcagctgccccagtggagaagaagaagaccccccgcccccagagacgacggcgaggaggccgcctgggaggaggagagccccggcctgagcggcggccccggcggcagcggcgccggcagcaccgtggccgaggccccccccggcaccctggccctgctgctggacgagggcagcaagcagctgccccaggccatcatcatcggcgtgaagaagggcggcaccagagccctgctggagttcctgagagtgcaccccgacgtgagagccgtgggcgccgagccccacttcttcgacagaagctacgacaagggcctggcctggtacagagacctgatgcccagaaccctggacggccagatcaccatggagaagacccccagctacttcgtgaccagagaggcccccgccagaatcagcgccatgagcaaggacaccaagctgatcgtggtggtgagagaccccgtgaccagagccatcagcgactacacccagaccctgagcaagagacccgacatccccaccttcgagagcctgaccttcaagaacagaaccgccggcctgatcgacaccagctggagcgccatccagatcggcatctacgccaagcacctggagcactggctgagacacttccccatcagacagatgctgttcgtgagcggcgagagactgatcagcgaccccgccggcgagctgggcagagtgcaggacttcctgggcctgaagagaatcatcaccgacaagcacttctacttcaacaagaccaagggcttcccctgcctgaagaaggccgagggcagcagcagaccccactgcctgggcaagaccaagggcagaacccaccccgagatcgacagagaggtggtgagaagactgagagagttctacagacccttcaacctgaagttctaccagatgaccggccacgacttcggctgggacggctag

SEQ ID NO: 84307 - DNA, 1173 bp, Artificial Sequence
  Description of Artificial Sequence: Synthetic coding sequence
atgggccagagactgagcggcggcagaagctgcctggacgtgcccggcagactgctgccccagcccccccccccccccccccccgtgagaagaaagctggccctgctgttcgccatgctgtgcgtgtggctgtacatgttcctgtacagctgcgccggcagctgcgccgccgcccccggcctgctgctgctgggcagcggcagcagagccgcccacgacccccccgccctggccaccgcccccgacggcaccccccccagactgcccttcagagccccccccgccacccccctggccagcggcaaggagatggccgagggcgccgccagccccgaggagcagagccccgaggtgcccgacagccccagccccatcagcagcttcttcagcggcagcggcagcaagcagctgccccaggccatcatcatcggcgtgaagaagggcggcaccagagccctgctggagttcctgagagtgcaccccgacgtgagagccgtgggcgccgagccccacttcttcgacagaagctacgacaagggcctggcctggtacagagacctgatgcccagaaccctggacggccagatcaccatggagaagacccccagctacttcgtgaccagagaggcccccgccagaatcagcgccatgagcaaggacaccaagctgatcgtggtggtgagagaccccgtgaccagagccatcagcgactacacccagaccctgagcaagagacccgacatccccaccttcgagagcctgaccttcaagaacagaaccgccggcctgatcgacaccagctggagcgccatccagatcggcatctacgccaagcacctggagcactggctgagacacttccccatcagacagatgctgttcgtgagcggcgagagactgatcagcgaccccgccggcgagctgggcagagtgcaggacttcctgggcctgaagagaatcatcaccgacaagcacttctacttcaacaagaccaagggcttcccctgcctgaagaaggccgagggcagcagcagaccccactgcctgggcaagaccaagggcagaacccaccccgagatcgacagagaggtggtgagaagactgagagagttctacagacccttcaacctgaagttctaccagatgaccggccacgacttcggctgggactag

SEQ ID NO: 84308 - DNA, 1173 bp, Artificial Sequence; identical to SEQ ID NO: 84307
  Description of Artificial Sequence: Synthetic coding sequence

SEQ ID NO: 84309 - DNA, 1371 bp, Artificial Sequence
  Description of Artificial Sequence: Synthetic coding sequence
atggccagatggcccgccccccccccccccccccccccccccccccccctggccgccccccccccccccggcgccagcgccaagggcccccccgccagaaagctgctgttcatgtgcaccctgagcctgagcgtgacctacctgtgctacagcctgctgggcggcagcggcagcctgcagttccccctggccctgcaggagagccccggcgccgccgccgagcccccccccagcccccccccccccagcctgctgcccacccccgtgagactgggcgcccccagccagccccccgcccccccccccctggacaacgccagccacggcgagccccccgagccccccgagcagcccgccgcccccggcaccgacggctggggcctgcccagcggcggcggcggcgcccaggacgcctggctgagaacccccctggcccccagcgagatgatcaccgcccagagcgccctgcccgagagagaggcccaggagagcagcaccaccgacgaggacctggccggcagaagagccgccaacggcagcagcgagagaggcggcgccgtgagcacccccgactacggcgagaagaagctgccccaggccctgatcatcggcgtgaagaagggcggcaccagagccctgctggaggccatcagagtgcaccccgacgtgagagccgtgggcgtggagccccacttcttcgacagaaactacgagaagggcctggagtggtacagaaacgtgatgcccaagaccctggacggccagatcaccatggagaagacccccagctacttcgtgaccaacgaggcccccaagagaatccacagcatggccaaggacatcaagctgatcgtggtggtgagaaaccccgtgaccagagccatcagcgactacacccagaccctgagcaagaagcccgagatccccaccttcgaggtgctggccttcaagaacagaaccctgggcctgatcgacgccagctggagcgccatcagaatcggcatctacgccctgcacctggagaactggctgcagtacttccccctgagccagatcctgttcgtgagcggcgagagactgatcgtggaccccgccggcgagatggccaaggtgcaggacttcctgggcctgaagagagtggtgaccgagaagcacttctacttcaacaagaccaagggcttcccctgcctgaagaagcccgaggacagcagcgcccccagatgcctgggcaagagcaagggcagaacccaccccagaatcgaccccgacgtgatccacagactgagaaagttctacaagcccttcaacctgatgttctaccagatgaccggccaggacttccagtgggagcaggaggagggcgacaagtag

SEQ ID NO: 84310 - DNA, 1041 bp, Artificial Sequence
  Description of Artificial Sequence: Synthetic coding sequence
atgctgttcaagcagcaggcctggctgagacagaagctgctggtgctgggcagcctggccgtgggcagcctgctgtacctggtggccagagtgggcagcctggacagactgcagcccatctgccccatcgagggcagactgggcggcgccagaacccaggccgagttccccctgagagccctgcagttcaagagaggcctgctgcacgagttcagaaagggcaacgccagcaaggagcaggtgagactgcacgacctggtgcagcagctgcccaaggccatcatcatcggcgtgagaaagggcggcaccagagccctgctggagatgctgaacctgcaccccgccgtggtgaaggccagccaggagatccacttcttcgacaacgacgagaactacggcaagggcatcgagtggtacagaaagaagatgcccttcagctacccccagcagatcaccatcgagaagagccccgcctacttcatcaccgaggaggtgcccgagagaatctacaagatgaacagcagcatcaagctgctgatcatcgtgagagagcccaccaccagagccatcagcgactacacccaggtgctggagggcaaggagagaaagaacaagacctactacaagttcgagaagctggccatcgaccccaacacctgcgaggtgaacaccaagtacaaggccgtgagaaccagcatctacaccaagcacctggagagatggctgaagtacttccccatcgagcagttccacgtggtggacggcgacagactgatcaccgagcccctgcccgagctgcagctggtggagaagttcctgaacctgccccccagaatcagccagtacaacctgtacttcaacgccaccagaggcttctactgcctgagattcaacatcatcttcaacaagtgcctggccggcagcaagggcagaatccaccccgaggtggaccccagcgtgatcaccaagctgagaaagttcttccaccccttcaaccagaagttctaccagatcaccggcagaaccctgaactggccctag

SEQ ID NO: 84311 - DNA, 1041 bp, Artificial Sequence; identical to SEQ ID NO: 84310
  Description of Artificial Sequence: Synthetic coding sequence

SEQ ID NO: 84312 - DNA, 969 bp, Artificial Sequence
  Description of Artificial Sequence: Synthetic coding sequence
atgctgttcatcaagttcatccacctggaggtgttcagcatgcccgagagagccatcgccagacacgaggtgagagagatcgagcagagacacaccatggacggccccagacaggacgccaccctggacgaggaggaggacatggtgatcatctacaacagagtgcccaagaccgccagcaccagcttcaccaacatcgcctacgacctgtgcgccaagaacaagtaccacgtgctgcacatcaacaccaccaagaacaaccccgtgatgagcctgcaggaccaggtgagattcgtgaagaacatcaccagctggaaggagatgaagcccggcttctaccacggccacgtgagctacctggacttcgccaagttcggcgtgaagaagaagcccatctacatcaacgtgatcagagaccccatcgagagactggtgagctactactacttcctgagattcggcgacgactacagacccggcctgagaagaagaaagcagggcgacaagaagaccttcgacgagtgcgtggccgagggcggcagcgactgcgcccccgagaagctgtggctgcagatccccttcttctgcggccacagcagcgagtgctggaacgtgggcagcagatgggccatggaccaggccaagtacaacctgatcaacgagtacttcctggtgggcgtgaccgaggagctggaggacttcatcatgctgctggaggccgccctgcccagattcttcagaggcgccaccgagctgtacagaaccgcccccgacaccgccacccccagccacagacacggccccatctgcggcagcaagagcatcagcagcctgctggtgaaggtgagccccgtgtgcaaggacagccactgccactgcagaagaggcaccggcacccccaagggcgagaccctggccaccctggccccctgcagccagagctggagcagcgtgacccacagatggtag

SEQ ID NO: 84313 - DNA, 912 bp, Artificial Sequence
  Description of Artificial Sequence: Synthetic coding sequence
atgctgttcatcaagttcatccacctggaggtgttcagcatgcccgagagagccatcgccagacacgaggtgagagagatcgagcagagacacaccatggacggccccagacaggacgccaccctggacgaggaggaggacatggtgatcatctacaacagagtgcccaagaccgccagcaccagcttcaccaacatcgcctacgacctgtgcgccaagaacaagtaccacgtgctgcacatcaacaccaccaagaacaaccccgtgatgagcctgcaggaccaggtgagattcgtgaagaacatcaccagctggaaggagatgaagcccggcttctaccacggccacgtgagctacctggacttcgccaagttcggcgtgaagaagaagcccatctacatcaacgtgatcagagaccccatcgagagactggtgagctactactacttcctgagattcggcgacgactacagacccggcctgagaagaagaaagcagggcgacaagaagaccttcgacgagtgcgtggccgagggcggcagcgactgcgcccccgagaagctgtggctgcagatccccttcttctgcggccacagcagcgagtgctggaacgtgggcagcagatgggccatggaccaggccaagtacaacctgatcaacgagtacttcctggtgggcgtgaccgaggagctggaggacttcatcatgctgctggaggccgccctgcccagattcttcagaggcgccaccgagctgtacagaaccgcccccgacaccgccacccccagccacagacacggccccatctgcggcagcaagagcatcagcagcctgctggtgaaggtgagccccgtgtgcaaggacagccactgcctgggcaagtgcagcagaaacggcctgagcgccgtgtag

SEQ ID NO: 84314 - DNA, 1071 bp, Artificial Sequence
  Description of Artificial Sequence: Synthetic coding sequence
atgggcctgctgagaatcatgatgccccccaagctgcagctgctggccgtggtggccttcgccgtggccatgctgttcctggagaaccagatccagaagctggaggagagcagaagcaagctggagagagccatcgccagacacgaggtgagagagatcgagcagagacacaccatggacggccccagacaggacgccaccctggacgaggaggaggacatggtgatcatctacaacagagtgcccaagaccgccagcaccagcttcaccaacatcgcctacgacctgtgcgccaagaacaagtaccacgtgctgcacatcaacaccaccaagaacaaccccgtgatgagcctgcaggaccaggtgagattcgtgaagaacatcaccagctggaaggagatgaagcccggcttctaccacggccacgtgagctacctggacttcgccaagttcggcgtgaagaagaagcccatctacatcaacgtgatcagagaccccatcgagagactggtgagctactactacttcctgagattcggcgacgactacagacccggcctgagaagaagaaagcagggcgacaagaagaccttcgacgagtgcgtggccgagggcggcagcgactgcgcccccgagaagctgtggctgcagatccccttcttctgcggccacagcagcgagtgctggaacgtgggcagcagatgggccatggaccaggccaagtacaacctgatcaacgagtacttcctggtgggcgtgaccgaggagctggaggacttcatcatgctgctggaggccgccctgcccagattcttcagaggcgccaccgagctgtacagaaccggcaagaagagccacctgagaaagaccaccgagaagaagctgcccaccaagcagaccatcgccaagctgcagcagagcgacatctggaagatggagaacgagttctacgagttcgccctggagcagttccagttcatcagagcccacgccgtgagagagaaggacggcgacctgtacatcctggcccagaacttcttctacgagaagatctaccccaagagcaactag

SEQ ID NO: 84315 - DNA, 690 bp, Artificial Sequence
  Description of Artificial Sequence: Synthetic coding sequence
atgggcctgctgagaatcatgatgccccccaagctgcagctgctggccgtggtggccttcgccgtggccatgctgttcctggagaaccagatccagaagctggaggagagcagaagcaagctggagagagccatcgccagacacgaggtgagagagatcgagcagagacacaccatggacggccccagacaggacgccaccctggacgaggaggaggacatggtgatcatctacaacagagtgcccaagaccgccagcaccagcttcaccaacatcgcctacgacctgtgcgccaagaacaagtaccacgtgctgcacatcaacaccaccaagaacaaccccgtgatgagcctgcaggaccaggtgagattcgtgaagaacatcaccagctggaaggagatgaagcccggcttctaccacggccacgtgagctacctggacttcgccaagttcggcgtgaagaagaagcccatctacatcaacgtgatcagagaccccatcgagagactggtgagctactactacttcctgagattcggcgacgactacagacccggcctgagaagaagaaagcagggcgacaagaagaccttcgacgagtgcgtggccgagggcggcagcgactgcgcccccgagaagctgtggctgcagatccccttcttctgcggccacagcagcgagtgctggtag

SEQ ID NO: 84316 - DNA, 1236 bp, Artificial Sequence
  Description of Artificial Sequence: Synthetic coding sequence
atgagaagaagaagagccggcggcagaaccatggtggagagagccagcaagttcgtgctggtggtggccggcagcgtgtgcttcatgctgatcctgtaccagtacgccggccccggcctgagcctgggcgcccccggcggcagagccccccccgacgacctggacctgttccccacccccgacccccactacgagaagaagtactacttccccgtgagagagctggagagaagcctgagattcgacatgaagggcgacgacgtgatcgtgttcctgcacatccagaagaccggcggcaccaccttcggcagacacctggtgcagaacgtgagactggaggtgccctgcgactgcagacccggccagaagaagtgcacctgctacagacccaacagaagagagacctggctgttcagcagattcagcaccggctggagctgcggcctgcacgccgactggaccgagctgaccaactgcgtgcccggcgtgctggacagaagagacagcgccgccctgagaacccccagaaagttctactacatcaccctgctgagagaccccgtgagcagatacctgagcgagtggagacacgtgcagagaggcgccacctggaagaccagcctgcacatgtgcgacggcagaacccccacccccgaggagctgcccccctgctacgagggcaccgactggagcggctgcaccctgcaggagttcatggactgcccctacaacctggccaacaacagacaggtgagaatgctggccgacctgagcctggtgggctgctacaacctgagcttcatccccgagggcaagagagcccagctgctgctggagagcgccaagaagaacctgagaggcatggccttcttcggcctgaccgagttccagagaaagacccagtacctgttcgagagaaccttcaacctgaagttcatcagacccttcatgcagtacaacagcaccagagccggcggcgtggaggtggacgaggacaccatcagaagaatcgaggagctgaacgacctggacatgcagctgtacgactacgccaaggacctgttccagcagagataccagtacaagagacagctggagagaagagagcagagactgagaagcagagaggagagactgctgcacagagccaaggaggccctgcccagagaggacgccgacgagcccggcagagtgcccaccgaggactacatgagccacatcatcgagaagtggtag

SEQ ID NO: 84317 - DNA, 831 bp, Artificial Sequence
  Description of Artificial Sequence: Synthetic coding sequence
atgctgttcctgttcgccgtgatcgtgctgcagtacgtgtgccccggcaccgagtgccagctgctgagactgcaggccttcagcagccccgtgcccgacccctacagaagcgaggacgagagcagcgccagattcgtgcccagatacaacttcaccagaggcgacctgctgagaaaggtggacttcgacatcaagggcgacgacctgatcgtgttcctgcacatccagaagaccggcggcaccaccttcggcagacacctggtgagaaacatccagctggagcagccctgcgagtgcagagtgggccagaagaagtgcacctgccacagacccggcaagagagagacctggctgttcagcagattcagcaccggctggagctgcggcctgcacgccgactggaccgagctgaccagctgcgtgcccagcgtggtggacggcaagagagacgccagactgagacccagcagatggagaatcttccagatcctggacgccgccagcaaggacaagagaggcagccccaacaccaacgccggcgccaacagccccagcagcaccaagaccagaaacaccagcaagagcggcaagaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagatgcgcctgcagccccacctag

SEQ ID NO: 84318 - DNA, 1389 bp, Artificial Sequence
  Description of Artificial Sequence: Synthetic coding sequence
atggacgagaagagcaacaagctgctgctggccctggtgatgctgttcctgttcgccgtgatcgtgctgcagtacgtgtgccccggcaccgagtgccagctgctgagactgcaggccttcagcagccccgtgcccgacccctacagaagcgaggacgagagcagcgccagattcgtgcccagatacaacttcaccagaggcgacctgctgagaaaggtggacttcgacatcaagggcgacgacctgatcgtgttcctgcacatccagaagaccggcggcaccaccttcggcagacacctggtgagaaacatccagctggagcagccctgcgagtgcagagtgggccagaagaagtgcacctgccacagacccggcaagagagagacctggctgttcagcagattcagcaccggctggagctgcggcctgcacgccgactggaccgagctgaccagctgcgtgcccagcgtggtggacggcaagagagacgccagactgagacccagcagatggagaatcttccagatcctggacgccgccagcaaggacaagagaggcagccccaacaccaacgccggcgccaacagccccagcagcaccaagaccagaaacaccagcaagagcggcaagaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagacaggtgagaatgctgagcgacctgaccctggtgggctgctacaacctgagcgtgatgcccgagaagcagagaaacaaggtgctgctggagagcgccaagagcaacctgaagcacatggccttcttcggcctgaccgagttccagagaaagacccagtacctgttcgagaagaccttcaacatgaacttcatcagccccttcacccagtacaacaccaccagagccagcagcgtggagatcaacgaggagatccagaagagaatcgagggcctgaacttcctggacatggagctgtacagctacgccaaggacctgttcctgcagagataccagttcatgagacagaaggagcaccaggaggccagaagaaagagacaggagcagagaaagttcctgaagggcagactgctgcagacccacttccagagccagggccagggccagagccagaaccccaaccagaaccagagcaaggagcagaacgacaacaccagcaacggcaccaacgactacatcggcagcgtggagaagtggagatag

SEQ ID NO: 84319 - DNA, 1818 bp, Artificial Sequence
  Description of Artificial Sequence: Synthetic coding sequence
atggccctgcccgcctgcgccgtgagagagttcgagccccccagacagcccgagagaggcgcccccgtgagaaccacctgccccagaagacacagcagagtggaggccgagctggccgccagcagacccggcagcgtggccgccagcgtgagagccggcccccccagaggcgtgagccacggcttccacaccagacccctgctggacaagcccagaaaggccagcagcagcctggccggcgccgcctgcgcccccctgttcgccctgctgagcagaggcagaagaagaagaatgcacgtgctgagaagaagatgggacctgggcagcctgtgcagagccctgctgaccagaggcctggccgccctgggccacagcctgaagcacgtgctgggcgccatcttcagcaagatcttcggccccatggccagcgtgggcaacatggacgagaagagcaacaagctgctgctggccctggtgatgctgttcctgttcgccgtgatcgtgctgcagtacgtgtgccccggcaccgagtgccagctgctgagactgcaggccttcagcagccccgtgcccgacccctacagaagcgaggacgagagcagcgccagattcgtgcccagatacaacttcaccagaggcgacctgctgagaaaggtggacttcgacatcaagggcgacgacctgatcgtgttcctgcacatccagaagaccggcggcaccaccttcggcagacacctggtgagaaacatccagctggagcagccctgcgagtgcagagtgggccagaagaagtgcacctgccacagacccggcaagagagagacctggctgttcagcagattcagcaccggctggagctgcggcctgcacgccgactggaccgagctgaccagctgcgtgcccagcgtggtggacggcaagagagacgccagactgagacccagcagaaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagacaggtgagaatgctgagcgacctgaccctggtgggctgctacaacctgagcgtgatgcccgagaagcagagaaacaaggtgctgctggagagcgccaagagcaacctgaagcacatggccttcttcggcctgaccgagttccagagaaagacccagtacctgttcgagaagaccttcaacatgaacttcatcagccccttcacccagtacaacaccaccagagccagcagcgtggagatcaacgaggagatccagaagagaatcgagggcctgaacttcctggacatggagctgtacagctacgccaaggacctgttcctgcagagataccagttcatgagacagaaggagcaccaggaggccagaagaaagagacaggagcagagaaagttcctgaagggcagactgctgcagacccacttccagagccagggccagggccagagccagaaccccaaccagaaccagagccagaaccccaaccccaacgccaaccagaacctgacccagaacctgatgcagaacctgacccagagcctgagccagaaggagaacagagagagccccaagcagaacagcggcaaggagcagaacgacaacaccagcaacggcaccaacgactacatcggcagcgtggagaagtggagatag

SEQ ID NO: 84320 - DNA, 1380 bp, Artificial Sequence
  Description of Artificial Sequence: Synthetic coding sequence
atggacgagaagagcaacaagctgctgctggccctggtgatgctgttcctgttcgccgtgatcgtgctgcagtacgtgtgccccggcaccgagtgccagctgctgagactgcaggccttcagcagccccgtgcccgacccctacagaagcgaggacgagagcagcgccagattcgtgcccagatacaacttcaccagaggcgacctgctgagaaaggtggacttcgacatcaagggcgacgacctgatcgtgttcctgcacatccagaagaccggcggcaccaccttcggcagacacctggtgagaaacatccagctggagcagccctgcgagtgcagagtgggccagaagaagtgcacctgccacagacccggcaagagagagacctggctgttcagcagattcagcaccggctggagctgcggcctgcacgccgactggaccgagctgaccagctgcgtgcccagcgtggtggacggcaagagagacgccagactgagacccagcagaaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagacaggtgagaatgctgagcgacctgaccctggtgggctgctacaacctgagcgtgatgcccgagaagcagagaaacaaggtgctgctggagagcgccaagagcaacctgaagcacatggccttcttcggcctgaccgagttccagagaaagacccagtacctgttcgagaagaccttcaacatgaacttcatcagccccttcacccagtacaacaccaccagagccagcagcgtggagatcaacgaggagatccagaagagaatcgagggcctgaacttcctggacatggagctgtacagctacgccaaggacctgttcctgcagagataccagttcatgagacagaaggagcaccaggaggccagaagaaagagacaggagcagagaaagttcctgaagggcagactgctgcagacccacttccagagccagggccagggccagagccagaaccccaaccagaaccagagccagaaccccaaccccaacgccaaccagaacctgacccagaacctgatgcagaacctgacccagagcctgagccagaaggagaacagagagagccccaagcagaacagcggcaaggagcagaacgacaacaccagcaacggcaccaacgactacatcggcagcgtggagaagtggagatag

SEQ ID NO: 84321 - DNA, 996 bp, Artificial Sequence
  Description of Artificial Sequence: Synthetic coding sequence
atgctgctgaagcacaacggcaagctgctgctgttctacctgctgagctaccaggccctggccagcgactggttctactgcagcttcaacagatggagaatcttccagatcctggacgccgccagaaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagacaggtgagaatgctgagcgacctgaccctggtgggctgctacaacctgagcgtgatgcccgagaagcagagaaacaaggtgctgctggagagcgccaagagcaacctgaagcacatggccttcttcggcctgaccgagttccagagaaagacccagtacctgttcgagaagaccttcaacatgaacttcatcagccccttcacccagtacaacaccaccagagccagcagcgtggagatcaacgaggagatccagaagagaatcgagggcctgaacttcctggacatggagctgtacagctacgccaaggacctgttcctgcagagataccagttcatgagacagaaggagcaccaggaggccagaagaaagagacaggagcagagaaagttcctgaagggcagactgctgcagacccacttccagagccagggccagggccagagccagaaccccaaccagaaccagagccagaaccccaaccccaacgccaaccagaacctgacccagaacctgatgcagaacctgacccagagcctgagccagaaggagaacagagagagccccaagcagaacagcggcaaggagcagaacgacaacaccagcaacggcaccaacgactacatcggcagcgtggagaagtggagatag

SEQ ID NO: 84322 - DNA, 1938 bp, Artificial Sequence
  Description of Artificial Sequence: Synthetic coding sequence
atggccctgcccgcctgcgccgtgagagagttcgagccccccagacagcccgagagaggcgcccccgtgagaaccacctgccccagaagacacagcagagtggaggccgagctggccgccagcagacccggcagcgtggccgccagcgtgagagccggcccccccagaggcgtgagccacggcttccacaccagacccctgctggacaagcccagaaaggccagcagcagcctggccggcgccgcctgcgcccccctgttcgccctgctgagcagaggcagaagaagaagaatgcacgtgctgagaagaagatgggacctgggcagcctgtgcagagccctgctgaccagaggcctggccgccctgggccacagcctgaagcacgtgctgggcgccatcttcagcaagatcttcggccccatggccagcgtgggcaacatggacgagaagagcaacaagctgctgctggccctggtgatgctgttcctgttcgccgtgatcgtgctgcagtacgtgtgccccggcaccgagtgccagctgctgagactgcaggccttcagcagccccgtgcccgacccctacagaagcgaggacgagagcagcgccagattcgtgcccagatacaacttcaccagaggcgacctgctgagaaaggtggacttcgacatcaagggcgacgacctgatcgtgttcctgcacatccagaagaccggcggcaccaccttcggcagacacctggtgagaaacatccagctggagcagccctgcgagtgcagagtgggccagaagaagtgcacctgccacagacccggcaagagagagacctggctgttcagcagattcagcaccggctggagctgcggcctgcacgccgactggaccgagctgaccagctgcgtgcccagcgtggtggacggcaagagagacgccagactgagacccagcagatggagaatcttccagatcctggacgccgccagcaaggacaagagaggcagccccaacaccaacgccggcgccaacagccccagcagcaccaagaccagaaacaccagcaagagcggcaagaacttccactacatcaccatcctgagagaccccgtgagcagatacctgagcgagtggagacacgtgcagagaggcgccacctggaaggccagcctgcacgtgtgcgacggcagaccccccaccagcgaggagctgcccagctgctacaccggcgacgactggagcggctgccccctgaaggagttcatggactgcccctacaacctggccaacaacagacaggtgagaatgctgagcgacctgaccctggtgggctgctacaacctgagcgtgatgcccgagaagcagagaaacaaggtgctgctggagagcgccaagagcaacctgaagcacatggccttcttcggcctgaccgagttccagagaaagacccagtacctgttcgagaagaccttcaacatgaacttcatcagccccttcacccagtacaacaccaccagagccagcagcgtggagatcaacgaggagatccagaagagaatcgagggcctgaacttcctggacatggagctgtacagctacgccaaggacctgttcctgcagagataccagttcatgagacagaaggagcaccaggaggccagaagaaagagacaggagcagagaaagttcctgaagggcagactgctgcagacccacttccagagccagggccagggccagagccagaaccccaaccagaaccagagccagaaccccaaccccaacgccaaccagaacctgacccagaacctgatgcagaacctgacccagagcctgagccagaaggagaacagagagagccccaagcagaacagcggcaaggagcagaacgacaacaccagcaacggcaccaacgactacatcggcagcgtggagaagtggagatag

SEQ ID NO: 84323 - DNA, 1416 bp, Artificial Sequence
  Description of Artificial Sequence: Synthetic coding sequence
atggacgagagattcaacaagtggctgctgacccccgtgctgaccctgctgttcgtggtgatcatgtaccagtacgtgagccccagctgcaccagcagctgcaccaacttcggcgagcagcccagagccggcgaggccggcccccccgccgtgcccggccccgccagaagagcccaggccccccccgaggagtgggagagaagaccccagctgccccccccccccagaggcccccccgagggccccagaggcgccgccgcccccgaggaggaggacgaggagcccggcgaccccagagagggcgaggaggaggaggaggaggacgagcccgaccccgaggcccccgagaacggcagcctgcccagattcgtgcccagattcaacttcagcctgaaggacctgaccagattcgtggacttcaacatcaagggcagagacgtgatcgtgttcctgcacatccagaagaccggcggcaccaccttcggcagacacctggtgaagaacatcagactggagcagccctgcagctgcaaggccggccagaagaagtgcacctgccacagacccggcaagaaggagacctggctgttcagcagattcagcaccggctggagctgcggcctgcacgccgactggaccgagctgaccaactgcgtgcccgccatcatggagaagaaggactgccccagaaaccacagccacaccagaaacttctactacatcaccatgctgagagaccccgtgagcagatacctgagcgagtggaagcacgtgcagagaggcgccacctggaagaccagcctgcacatgtgcgacggcagaagccccacccccgacgagctgcccacctgctaccccggcgacgactggagcggcgtgagcctgagagagttcatggactgcacctacaacctggccaacaacagacaggtgagaatgctggccgacctgagcctggtgggctgctacaacctgaccttcatgaacgagagcgagagaaacaccatcctgctgcagagcgccaagaacaacctgaagaacatggccttcttcggcctgaccgagttccagagaaagacccagttcctgttcgagagaaccttcaacctgaagttcatcagccccttcacccagttcaacatcaccagagccagcaacgtggagatcaacgagggcgccagacagagaatcgaggacctgaacttcctggacatgcagctgtacgagtacgccaaggacctgttccagcagagataccaccacaccaagcagctggagcaccagagagacagacagaagagaagagaggagagaagactgcagagagagcacagagaccaccagtggcccaaggaggacggcgccgccgagggcaccgtgaccgaggactacaacagccaggtggtgagatggtag

SEQ ID NO: 84324 - DNA, 543 bp, Artificial Sequence
  Description of Artificial Sequence: Synthetic coding sequence
tgagcccagacccccccccccccccccgccgccgtggccgtggccgtgacccccgtgccccagttccccagagcctgcaccgaggccgagttcgcctgccacagctacaacgagtgcgtggccctggagtacagatgcgacagaagacccgactgcagagacatgagcgacgagctgaactgcgaggagcccgtgctgggcatcagccccaccttcagcctgctggtggagaccaccagcctgccccccagacccgagaccaccatcatgagacagccccccgtgacccacgccccccagcccctgctgcccggcagcgtgagacccctgccctgcggcccccaggaggccgcctgcagaaacggccactgcatccccagagactacctgtgcgacggccaggaggactgcgaggacggcagcgacgagctggactgcggccccccccccccctgcgagcccaacgagttcccctgcggcaacggccactgcgccctgaagctgtggagatgcgacggcgacttcgactgcgaggacagatag

SEQ ID NO: 84325 - DNA, 285 bp, Artificial Sequence
  Description of Artificial Sequence: Synthetic coding sequence
tgaggccacccccacagccccagcagcggcgccgcctgggccgccgccttcctgggcggcagaccccccggcaccagctgctgcaccctgagcgtgcagcccctgagaacccaggccgccaccgccgccggcagccccaccagatgggcccagcccagacccctgcccagctgcagcagcaagaaccccgagctgggccccgagctgcccagagacgtgtacatgcccggcccctggaccctgggcgagggccccggccagtgccccgccggctaccccagatag

SEQ ID NO: 84326 - DNA, 13176 bp, Artificial Sequence
  Description of Artificial Sequence: Synthetic coding sequence
atgggctggagagccgccggcgccctgctgctggccctgctgctgcacggcagactgctggccgtgacccacggcctgagagcctacgacggcctgagcctgcccgaggacatcgagaccgtgaccgccagccagatgagatggacccacagctacctgagcgacgacgaggacatgctggccgacagcatcagcggcgacgacctgggcagcggcgacctgggcagcggcgacttccagatggtgtacttcagagccctggtgaacttcaccagaagcatcgagtacagcccccagctggaggacgccggcagcagagagttcagagaggtgagcgaggccgtggtggacaccctggagagcgagtacctgaagatccccggcgaccaggtggtgagcgtggtgttcatcaaggagctggacggctgggtgttcgtggagctggacgtgggcagcgagggcaacgccgacggcgcccagatccaggagatgctgctgagagtgatcagcagcggcagcgtggccagctacgtgaccagcccccagggcttccagttcagaagactgggcaccgtgccccagttccccagagcctgcaccgaggccgagttcgcctgccacagctacaacgagtgcgtggccctggagtacagatgcgacagaagacccgactgcagagacatgagcgacgagctgaactgcgaggagcccgtgctgggcatcagccccaccttcagcctgctggtggagaccaccagcctgccccccagacccgagaccaccatcatgagacagccccccgtgacccacgccccccagcccctgctgcccggcagcgtgagacccctgccctgcggcccccaggaggccgcctgcagaaacggccactgcatccccagagactacctgtgcgacggccaggaggactgcgaggacggcagcgacgagctggactgcggccccccccccccctgcgagcccaacgagttcccctgcggcaacggccactgcgccctgaagctgtggagatgcgacggcgacttcgactgcgaggacagaaccgacgaggccaactgccccaccaagagacccgaggaggtgtgcggccccacccagttcagatgcgtgagcaccaacatgtgcatccccgccagcttccactgcgacgaggagagcgactgccccgacagaagcgacgagttcggctgcatgcccccccaggtggtgaccccccccagagagagcatccaggccagcagaggccagaccgtgaccttcacctgcgtggccatcggcgtgcccacccccatcatcaactggagactgaactggggccacatccccagccaccccagagtgaccgtgaccagcgagggcggcagaggcaccctgatcatcagagacgtgaaggagagcgaccagggcgcctacacctgcgaggccatgaacgccagaggcatggtgttcggcatccccgacggcgtgctggagctggtgccccagagaggcccctgccccgacggccacttctacctggagcacagcgccgcctgcctgccctgcttctgcttcggcatcaccagcgtgtgccagagcaccagaagattcagagaccagatcagactgagattcgaccagcccgacgacttcaagggcgtgaacgtgaccatgcccgcccagcccggcaccccccccctgagcagcacccagctgcagatcgaccccagcctgcacgagttccagctggtggacctgagcagaagattcctggtgcacgacagcttctgggccctgcccgagcagttcctgggcaacaaggtggacagctacggcggcagcctgagatacaacgtgagatacgagctggccagaggcatgctggagcccgtgcagagacccgacgtggtgctgatgggcgccggctacagactgctgagcagaggccacacccccacccagcccggcgccctgaaccagagacaggtgcagttcagcgaggagcactgggtgcacgagagcggcagacccgtgcagagagccgagctgctgcaggtgctgcagagcctggaggccgtgctgatccagaccgtgtacaacaccaagatggccagcgtgggcctgagcgacatcgccatggacaccaccgtgacccacgccaccagccacggcagagcccacagcgtggaggagtgcagatgccccatcggctacagcggcctgagctgcgagagctgcgacgcccacttcaccagagtgcccggcggcccctacctgggcacctgcagcggctgcaactgcaacggccacgccagcagctgcgaccccgtgtacggccactgcctgaactgccagcacaacaccgagggcccccagtgcaacaagtgcaaggccggcttcttcggcgacgccatgaaggccaccgccaccagctgcagaccctgcccctgcccctacatcgacgccagcagaagattcagcgacacctgcttcctggacaccgacggccaggccacctgcgacgcctgcgcccccggctacaccggcagaagatgcgagagctgcgcccccggctacgagggcaaccccatccagcccggcggcaagtgcagacccgtgaaccaggagatcgtgagatgcgacgagagaggcagcatgggcaccagcggcgaggcctgcagatgcaagaacaacgtggtgggcagactgtgcaacgagtgcgccgacggcagcttccacctgagcaccagaaaccccgacggctgcctgaagtgcttctgcatgggcgtgagcagacactgcaccagcagcagctggagcagagcccagctgcacggcgccagcgaggagcccggccacttcagcctgaccaacgccgccagcacccacaccaccaacgagggcatcttcagccccacccccggcgagctgggcttcagcagcttccacagactgctgagcggcccctacttctggagcctgcccagcagattcctgggcgacaaggtgaccagctacggcggcgagctgagattcaccgtgacccagagaagccagcccggcagcacccccctgcacggccagcccctggtggtgctgcagggcaacaacatcatcctggagcaccacgtggcccaggagcccagccccggccagcccagcaccttcatcgtgcccttcagagagcaggcctggcagagacccgacggccagcccgccaccagagagcacctgctgatggccctggccggcatcgacaccctgctgatcagagccagctacgcccagcagcccgccgagagcagagtgagcggcatcagcatggacgtggccgtgcccgaggagaccggccaggaccccgccctggaggtggagcagtgcagctgcccccccggctacagaggccccagctgccaggactgcgacaccggctacaccagaacccccagcggcctgtacctgggcacctgcgagagatgcagctgccacggccacagcgaggcctgcgagcccgagaccggcgcctgccagggctgccagcaccacaccgagggccccagatgcgagcagtgccagcccggctactacggcgacgcccagagaggcaccccccaggactgccagctgtgcccctgctacggcgaccccgccgccggccaggccgcccacacctgcttcctggacaccgacggccaccccacctgcgacgcctgcagccccggccacagcggcagacactgcgagagatgcgcccccggctactacggcaaccccagccagggccagccctgccagagagacagccaggtgcccggccccatcggctgcaactgcgacccccagggcagcgtgagcagccagtgcgacgccgccggccagtgccagtgcaaggcccaggtggagggcctgacctgcagccactgcagaccccaccacttccacctgagcgccagcaaccccgacggctgcctgccctgcttctgcatgggcatcacccagcagtgcgccagcagcgcctacaccagacacctgatcagcacccacttcgcccccggcgacttccagggcttcgccctggtgaacccccagagaaacagcagactgaccggcgagttcaccgtggagcccgtgcccgagggcgcccagctgagcttcggcaacttcgcccagctgggccacgagagcttctactggcagctgcccgagacctaccagggcgacaaggtggccgcctacggcggcaagctgagatacaccctgagctacaccgccggcccccagggcagccccctgagcgaccccgacgtgcagatcaccggcaacaacatcatgctggtggccagccagcccgccctgcagggccccgagagaagaagctacgagatcatgttcagagaggagttctggagaagacccgacggccagcccgccaccagagagcacctgctgatggccctggccgacctggacgagctgctgatcagagccaccttcagcagcgtgcccctggccgccagcatcagcgccgtgagcctggaggtggcccagcccggccccagcaacagacccagagccctggaggtggaggagtgcagatgcccccccggctacatcggcctgagctgccaggactgcgcccccggctacaccagaaccggcagcggcctgtacctgggccactgcgagctgtgcgagtgcaacggccacagcgacctgtgccaccccgagaccggcgcctgcagccagtgccagcacaacgccgccggcgagttctgcgagctgtgcgcccccggctactacggcgacgccaccgccggcacccccgaggactgccagccctgcgcctgccccctgaccaaccccgagaacatgttcagcagaacctgcgagagcctgggcgccggcggctacagatgcaccgcctgcgagcccggctacaccggccagtactgcgagcagtgcggccccggctacgtgggcaaccccagcgtgcagggcggccagtgcctgcccgagaccaaccaggcccccctggtggtggaggtgcaccccgccagaagcatcgtgccccagggcggcagccacagcctgagatgccaggtgagcggcagccccccccactacttctactggagcagagaggacggcagacccgtgcccagcggcacccagcagagacaccagggcagcgagctgcacttccccagcgtgcagcccagcgacgccggcgtgtacatctgcacctgcagaaacctgcaccagagcaacaccagcagagccgagctgctggtgaccgaggcccccagcaagcccatcaccgtgaccgtggaggagcagagaagccagagcgtgagacccggcgccgacgtgaccttcatctgcaccgccaagagcaagagccccgcctacaccctggtgtggaccagactgcacaacggcaagctgcccaccagagccatggacttcaacggcatcctgaccatcagaaacgtgcagctgagcgacgccggcacctacgtgtgcaccggcagcaacatgttcgccatggaccagggcaccgccaccctgcacgtgcaggccagcggcaccctgagcgcccccgtggtgagcatccaccccccccagctgaccgtgcagcccggccagctggccgagttcagatgcagcgccaccggcagccccacccccaccctggagtggaccggcggccccggcggccagctgcccgccaaggcccagatccacggcggcatcctgagactgcccgccgtggagcccaccgaccaggcccagtacctgtgcagagcccacagcagcgccggccagcaggtggccagagccgtgctgcacgtgcacggcggcggcggccccagagtgcaggtgagccccgagagaacccaggtgcacgccggcagaaccgtgagactgtactgcagagccgccggcgtgcccagcgccaccatcacctggagaaaggagggcggcagcctgcccccccaggccagaagcgagagaaccgacatcgccaccctgctgatccccgccatcaccaccgccgacgccggcttctacctgtgcgtggccaccagccccgccggcaccgcccaggccagaatccaggtggtggtgctgagcgccagcgacgccagccccccccccgtgaagatcgagagcagcagccccagcgtgaccgagggccagaccctggacctgaactgcgtggtggccggcagcgcccacgcccaggtgacctggtacagaagaggcggcagcctgcccccccacacccaggtgcacggcagcagactgagactgccccaggtgagccccgccgacagcggcgagtacgtgtgcagagtggagaacggcagcggccccaaggaggccagcatcaccgtgagcgtgctgcacggcacccacagcggccccagctacacccccgtgcccggcagcaccagacccatcagaatcgagcccagcagcagccacgtggccgagggccagaccctggacctgaactgcgtggtgcccggccaggcccacgcccaggtgacctggcacaagagaggcggcagcctgcccgccagacaccagacccacggcagcctgctgagactgcaccaggtgacccccgccgacagcggcgagtacgtgtgccacgtggtgggcaccagcggccccctggaggccagcgtgctggtgaccatcgaggccagcgtgatccccggccccatcccccccgtgagaatcgagagcagcagcagcaccgtggccgagggccagaccctggacctgagctgcgtggtggccggccaggcccacgcccaggtgacctggtacaagagaggcggcagcctgcccgccagacaccaggtgagaggcagcagactgtacatcttccaggccagccccgccgacgccggccagtacgtgtgcagagccagcaacggcatggaggccagcatcaccgtgaccgtgaccggcacccagggcgccaacctggcctaccccgccggcagcacccagcccatcagaatcgagcccagcagcagccaggtggccgagggccagaccctggacctgaactgcgtggtgcccggccagagccacgcccaggtgacctggcacaagagaggcggcagcctgcccgtgagacaccagacccacggcagcctgctgagactgtaccaggccagccccgccgacagcggcgagtacgtgtgcagagtgctgggcagcagcgtgcccctggaggccagcgtgctggtgaccatcgagcccgccggcagcgtgcccgccctgggcgtgacccccaccgtgagaatcgagagcagcagcagccaggtggccgagggccagaccctggacctgaactgcctggtggccggccaggcccacgcccaggtgacctggcacaagagaggcggcagcctgcccgccagacaccaggtgcacggcagcagactgagactgctgcaggtgacccccgccgacagcggcgagtacgtgtgcagagtggtgggcagcagcggcacccaggaggccagcgtgctggtgaccatccagcagagactgagcggcagccacagccagggcgtggcctaccccgtgagaatcgagagcagcagcgccagcctggccaacggccacaccctggacctgaactgcctggtggccagccaggccccccacaccatcacctggtacaagagaggcggcagcctgcccagcagacaccagatcgtgggcagcagactgagaatcccccaggtgacccccgccgacagcggcgagtacgtgtgccacgtgagcaacggcgccggcagcagagagaccagcctgatcgtgaccatccagggcagcggcagcagccacgtgcccagcgtgagcccccccatcagaatcgagagcagcagccccaccgtggtggagggccagaccctggacctgaactgcgtggtggccagacagccccaggccatcatcacctggtacaagagaggcggcagcctgcccagcagacaccagacccacggcagccacctgagactgcaccagatgagcgtggccgacagcggcgagtacgtgtgcagagccaacaacaacatcgacgccctggaggccagcatcgtgatcagcgtgagccccagcgccggcagccccagcgcccccggcagcagcatgcccatcagaatcgagagcagcagcagccacgtggccgagggcgagaccctggacctgaactgcgtggtgcccggccaggcccacgcccaggtgacctggcacaagagaggcggcagcctgcccagccaccaccagaccagaggcagcagactgagactgcaccacgtgagccccgccgacagcggcgagtacgtgtgcagagtgatgggcagcagcggccccctggaggccagcgtgctggtgaccatcgaggccagcggcagcagcgccgtgcacgtgcccgcccccggcggcgccccccccatcagaatcgagcccagcagcagcagagtggccgagggccagaccctggacctgaagtgcgtggtgcccggccaggcccacgcccaggtgacctggcacaagagaggcggcaacctgcccgccagacaccaggtgcacggccccctgctgagactgaaccaggtgagccccgccgacagcggcgagtacagctgccaggtgaccggcagcagcggcaccctggaggccagcgtgctggtgaccatcgagcccagcagccccggccccatccccgcccccggcctggcccagcccatctacatcgaggccagcagcagccacgtgaccgagggccagaccctggacctgaactgcgtggtgcccggccaggcccacgcccaggtgacctggtacaagagaggcggcagcctgcccgccagacaccagacccacggcagccagctgagactgcacctggtgagccccgccgacagcggcgagtacgtgtgcagagccgccagcggccccggccccgagcaggaggccagcttcaccgtgaccgtgccccccagcgagggcagcagctacagactgagaagccccgtgatcagcatcgacccccccagcagcaccgtgcagcagggccaggacgccagcttcaagtgcctgatccacgacggcgccgcccccatcagcctggagtggaagaccagaaaccaggagctggaggacaacgtgcacatcagccccaacggcagcatcatcaccatcgtgggcaccagacccagcaaccacggcacctacagatgcgtggccagcaacgcctacggcgtggcccagagcgtggtgaacctgagcgtgcacggcccccccaccgtgagcgtgctgcccgagggccccgtgtgggtgaaggtgggcaaggccgtgaccctggagtgcgtgagcgccggcgagcccagaagcagcgccagatggaccagaatcagcagcacccccgccaagctggagcagagaacctacggcctgatggacagccacgccgtgctgcagatcagcagcgccaagcccagcgacgccggcacctacgtgtgcctggcccagaacgccctgggcaccgcccagaagcaggtggaggtgatcgtggacaccggcgccatggcccccggcgccccccaggtgcaggccgaggaggccgagctgaccgtggaggccggccacaccgccaccctgagatgcagcgccaccggcagccccgcccccaccatccactggagcaagctgagaagccccctgccctggcagcacagactggagggcgacaccctgatcatccccagagtggcccagcaggacagcggccagtacatctgcaacgccaccagccccgccggccacgccgaggccaccatcatcctgcacgtggagagccccccctacgccaccaccgtgcccgagcacgccagcgtgcaggccggcgagaccgtgcagctgcagtgcctggcccacggcaccccccccctgaccttccagtggagcagagtgggcagcagcctgcccggcagagccaccgccagaaacgagctgctgcacttcgagagagccgcccccgaggacagcggcagatacagatgcagagtgaccaacaaggtgggcagcgccgaggccttcgcccagctgctggtgcagggcccccccggcagcctgcccgccaccagcatccccgccggcagcacccccaccgtgcaggtgaccccccagctggagaccaagagcatcggcgccagcgtggagttccactgcgccgtgcccagcgacagaggcacccagctgagatggttcaaggagggcggccagctgccccccggccacagcgtgcaggacggcgtgctgagaatccagaacctggaccagagctgccagggcacctacatctgccaggcccacggcccctggggcaaggcccaggccagcgcccagctggtgatccaggccctgcccagcgtgctgatcaacatcagaaccagcgtgcagaccgtggtggtgggccacgccgtggagttcgagtgcctggccctgggcgaccccaagccccaggtgacctggagcaaggtgggcggccacctgagacccggcatcgtgcagagcggcggcgtggtgagaatcgcccacgtggagctggccgacgccggccagtacagatgcaccgccaccaacgccgccggcaccacccagagccacgtgctgctgctggtgcaggccctgccccagatcagcatgccccaggaggtgagagtgcccgccggcagcgccgccgtgttcccctgcatcgccagcggctaccccacccccgacatcagctggagcaagctggacggcagcctgccccccgacagcagactggagaacaacatgctgatgctgcccagcgtgagaccccaggacgccggcacctacgtgtgcaccgccaccaacagacagggcaaggtgaaggccttcgcccacctgcaggtgcccgagagagtggtgccctacttcacccagaccccctacagcttcctgcccctgcccaccatcaaggacgcctacagaaagttcgagatcaagatcaccttcagacccgacagcgccgacggcatgctgctgtacaacggccagaagagagtgcccggcagccccaccaacctggccaacagacagcccgacttcatcagcttcggcctggtgggcggcagacccgagttcagattcgacgccggcagcggcatggccaccatcagacaccccacccccctggccctgggccacttccacaccgtgaccctgctgagaagcctgacccagggcagcctgatcgtgggcgacctggcccccgtgaacggcaccagccagggcaagttccagggcctggacctgaacgaggagctgtacctgggcggctaccccgactacggcgccatccccaaggccggcctgagcagcggcttcatcggctgcgtgagagagctgagaatccagggcgaggagatcgtgttccacgacctgaacctgaccgcccacggcatcagccactgccccacctgcagagacagaccctgccagaacggcggccagtgccacgacagcgagagcagcagctacgtgtgcgtgtgccccgccggcttcaccggcagcagatgcgagcacagccaggccctgcactgccaccccgaggcctgcggccccgacgccacctgcgtgaacagacccgacggcagaggctacacctgcagatgccacctgggcagaagcggcctgagatgcgaggagggcgtgaccgtgaccacccccagcctgagcggcgccggcagctacctggccctgcccgccctgaccaacacccaccacgagctgagactggacgtggagttcaagcccctggcccccgacggcgtgctgctgttcagcggcggcaagagcggccccgtggaggacttcgtgagcctggccatggtgggcggccacctggagttcagatacgagctgggcagcggcctggccgtgctgagaagcgccgagcccctggccctgggcagatggcacagagtgagcgccgagagactgaacaaggacggcagcctgagagtgaacggcggcagacccgtgctgagaagcagccccggcaagagccagggcctgaacctgcacaccctgctgtacctgggcggcgtggagcccagcgtgcccctgagccccgccaccaacatgagcgcccacttcagaggctgcgtgggcgaggtgagcgtgaacggcaagagactggacctgacctacagcttcctgggcagccagggcatcggccagtgctacgacagcagcccctgcgagagacagccctgccagcacggcgccacctgcatgcccgccggcgagtacgagttccagtgcctgtgcagagacggcttcaagggcgacctgtgcgagcacgaggagaacccctgccagctgagagagccctgcctgcacggcggcacctgccagggcaccagatgcctgtgcctgcccggcttcagcggccccagatgccagcagggcagcggccacggcatcgccgagagcgactggcacctggagggcagcggcggcaacgacgcccccggccagtacggcgcctacttccacgacgacggcttcctggccttccccggccacgtgttcagcagaagcctgcccgaggtgcccgagaccatcgagctggaggtgagaaccagcaccgccagcggcctgctgctgtggcagggcgtggaggtgggcgaggccggccagggcaaggacttcatcagcctgggcctgcaggacggccacctggtgttcagataccagctgggcagcggcgaggccagactggtgagcgaggaccccatcaacgacggcgagtggcacagagtgaccgccctgagagagggcagaagaggcagcatccaggtggacggcgaggagctggtgagcggcagaagccccggccccaacgtggccgtgaacgccaagggcagcgtgtacatcggcggcgcccccgacgtggccaccctgaccggcggcagattcagcagcggcatcaccggctgcgtgaagaacctggtgctgcacagcgccagacccggcgccccccccccccagcccctggacctgcagcacagagcccaggccggcgccaacaccagaccctgccccagctag

SEQ ID NO: 84327 - DNA, 720 bp, Artificial Sequence
  Description of Artificial Sequence: Synthetic coding sequence
gtgacccacggcctgagagcctacgacggcctgagcctgcccgaggacatcgagaccgtgaccgccagccagatgagatggacccacagctacctgagcgacgacgaggacatgctggccgacagcatcagcggcgacgacctgggcagcggcgacctgggcagcggcgacttccagatgggcagctggatggccggcttcctgtggagctggatgtgggccagaaagggcatgagaatgggcctgagattcagaagatgctgcagcggcagcagccccgccgccctgtggccccccaccagccccctgcccagagacagcagcagcgacgcctgggcccagtgccccagcagccaggagcccgccagaagacccagcctgcccgccaccgccaccatgagcgtgtggccctggagcatcgccgtgaccggcggccccaccgccggcacctgcctgatgagcagcatcgtgagaagccagagctgggtgagcgccccccacagcctgagcctgtggagaagacacctgtacagacccggccagagacagcccagctgcgacagccaccagagccccaccctgctgagcccctgcttccccgtgcccagcggcccctgccccgtgggccccagaagaccccacgccgccatgggcaccgccagccccgagaccaccagcgccaccgacagaagaaccgccagaaccgccgccatgagctag

SEQ ID NO: 84328 - DNA, 567 bp, Artificial Sequence
  Description of Artificial Sequence: Synthetic coding sequence
atgaacgccggcgccagcgtgctgaccttcccctgggccgtgtacggcctgcccagagccagacccgccgtgaccgacctgaccggccccctgccccccagcagccccgccctgcccagcgtgctgatcaacatcagaaccagcgtgcagaccgtggtggtgggccacgccgtggagttcgagtgcctggccctgggcgaccccaagccccaggtgacctggagcaaggtgggcggccacctgagacccggcatcgtgcagagcggcggcgtggtgagaatcgcccacgtggagctggccgacgccggccagtacagatgcaccgccaccaacgccgccggcaccacccagagccacgtgctgctgctggtgcaggccctgccccagatcagcatgccccaggaggtgagagtgcccgccggcagcgccgccgtgttcccctgcatcgccagcggctaccccacccccgacatcagctggagcaagctggacggcagcctgccccccgacagcagactggagaacaacatgctgatgctgcccagcgtgagaccccaggacgcctag

SEQ ID NO: 84329 - DNA, 594 bp, Artificial Sequence
  Description of Artificial Sequence: Synthetic coding sequence
tgaacccccagcggcctgtacctgggcacctgcgagagatgcagctgccacggccacagcgaggcctgcgagcccgagaccggcgcctgccagggctgccagcaccacaccgagggccccagatgcgagcagtgccagcccggctactacggcgacgcccagagaggcaccccccaggactgccagctgtgcccctgctacggcgaccccgccgccggccaggccgcccacacctgcttcctggacaccgacggccaccccacctgcgacgcctgcagccccggccacagcggcagacactgcgagagatgcgcccccggctactacggcaaccccagccagggccagccctgccagagagacagccaggtgcccggccccatcggctgcaactgcgacccccagggcagcgtgagcagccagtgcgacgccgccggccagtgccagtgcaaggtgagccccaacccctgcccctgcggcgcctgcagcgcccccctgcccagaccctgcggcgagatcagacagcacctggtggaggccgagacctgggcctggggcgccggccacggcggccagggcagaggctgcccctag

SEQ ID NO: 84330 - DNA, 492 bp, Artificial Sequence
  Description of Artificial Sequence: Synthetic coding sequence
ccccccgtgaagatcgagagcagcagccccagcgtgaccgagggccagaccctggacctgaactgcgtggtggccggcagcgcccacgcccaggtgacctggtacagaagaggcggcagcctgcccccccacacccaggtgcacggcagcagactgagactgccccaggtgagccccgccgacagcggcgagtacgtgtgcagagtggagaacggcagcggccccaaggaggccagcatcaccgtgagctactgcccccccgcctggagctggtgcgtgcccggcagcaccagacccatcagaatcgagcccagcagcagccacgtggccgagggccagaccctggacctgaactgcgtggtgcccggccaggcccacgcccaggtgacctggcacaagagaggcggcagcctgcccgccagacaccagacccacggcagcctgctgagactgcaccaggtgacccccgccgacagcggcgagtacgtgtag

SEQ ID NO: 84331 - DNA, 573 bp, Artificial Sequence
  Description of Artificial Sequence: Synthetic coding sequence
cccgaggacatcgagaccgtgaccgccagccagatgagatggacccacagctacctgagcgacgacgaggacatgctggccgacagcatcagcggcgacgacctgggcagcggcgacctgggcagcggcgacttccagatggtgtacttcagagccctggtgaacttcaccagaagcatcgagtacagcccccagctggaggacgccggcagcagagagttcagagaggtgagcgaggccgtggtggacaccctggagagcgagtacctgaagatccccggcgaccaggtggtgagcgtggtgttcatcaaggagctggacggctgggtgttcgtggagctggacgtgggcagcgagggcaacgccgacggcgcccagatccaggagatgctgctgagagtgatcagcagcggcagcgtggccagctacgtgaccagcccccagggcttccagttcagaagactgggcaccggcgagcccatcctggtgagcggcatcgccagcagcagactggtgggcagccccttcagcgtgagcgccatcggcagccagctgggcctggcccaccactag

SEQ ID NO: 84332 - DNA, 624 bp, Artificial Sequence
  Description of Artificial Sequence: Synthetic coding sequence
ggcgagagcagagagggcagaggctacagacaggtggcccagagagtggccgagagaagccccgtgcccagcctgctgagccacagcggctgcgtggtgcacaccagactgagccccgtgcccagcgtgagcccccccatcagaatcgagagcagcagccccaccgtggtggagggccagaccctggacctgaactgcgtggtggccagacagccccaggccatcatcacctggtacaagagaggcggcagcctgcccagcagacaccagacccacggcagccacctgagactgcaccagatgagcgtggccgacagcggcgagtacgtgtgcagagccaacaacaacatcgacgccctggaggccagcatcgtgatcagcgtgagccccagcgccggcagccccagcgcccccggcagcagcatgcccatcagaatcgagagcagcagcagccacgtggccgagggcgagaccctggacctgaactgcgtggtgcccggccaggcccacgcccaggtgacctggcacaagagaggcggcagcctgcccagccaccaccagaccagaggcagcagactgagactgcaccacgtgagccccgccgacagcggcgagtacgtgtag

SEQ ID NO: 84333 - DNA, 1104 bp, Artificial Sequence
  Description of Artificial Sequence: Synthetic coding sequence
atgggctggagaagaggcagaggcgcccccagattccccgacggcatggccgccggccagagaagaagcagcctgagcagactgggcagccaggccgagggcctgctgaccagccagaccatgggcggccaggccgagaccctgctgaccagccagaccggctggctgctgggcagaggctgcaacctgggcagccccggcggccaggtgagctgggacaaggtgagaatccccggcgtgctgcagagactgggcgtgacctacttcgtggtggccgtgctggagctgctgttcgccaagcccgtgcccgagcactgcgccagcgagagaagctgcctgagcctgagagacatcaccagcagctggccccagtggctgctgatcctggtgctggagggcctgtggctgggcctgaccttcctgctgcccgtgcccggctgccccaccggctacctgggccccggcggcatcggcgacttcggcaagtaccccaactgcaccggcggcgccgccggctacatcgacagactgctgctgggcgacgaccacctgtaccagcaccccagcagcgccgtgctgtaccacaccgaggtggcctacgaccccgagggcatcctgggcaccatcaacagcatcgtgatggccttcctgggcgtgcaggccggcaagatcctgctgtactacaaggccagaaccaaggacatcctgatcagattcaccgcctggtgctgcatcctgggcctgatcagcgtggccctgaccaaggtgagcgagaacgagggcttcatccccgtgaacaagaacctgtggagcctgagctacgtgaccaccctgagcagcttcgccttcttcatcctgctggtgctgtaccccgtggtggacgtgaagggcctgtggaccggcacccccttcttctaccccggcatgaacagcatcctggtgtacgtgggccacgaggtgttcgagaactacttccccttccagtggaagctgaaggacaaccagagccacaaggagcacctgacccagaacatcgtggccaccgccctgtgggtgctgatcgcctacatcctgtacagaaagaagatcttctggaagatctag

SEQ ID NO: 84334 - DNA, 669 bp, Artificial Sequence
  Description of Artificial Sequence: Synthetic coding sequence
atgagcggcgccggcagagccctggccgccctgctgctggccgccagcgtgctgagcgccgccctgctggcccccggcggcagcagcggcagagacgcccaggccgccccccccagagacctggacaagaagagacacgccgagctgaagatggaccaggccctgctgctgatccacaacgagctgctgtggaccaacctgaccgtgtactggaagagcgagtgctgctaccactgcctgttccaggtgctggtgaacgtgccccagagccccaaggccggcaagcccagcgccgccgccgccagcgtgagcacccagcacggcagcatcctgcagctgaacgacaccctggaggagaaggaggtgtgcagactggagtacagattcggcgagttcggcaactacagcctgctggtgaagaacatccacaacggcgtgagcgagatcgcctgcgacctggccgtgaacgaggaccccgtggacagcaacctgcccgtgagcatcgccttcctgatcggcctggccgtgatcatcgtgatcagcttcctgagactgctgctgagagtgctgctgtgccaccccggctggagcgccgtggcccccagcagactgacccccagcagcgccagcagagtgcacaccatcctgctgccccagccccccgagtag

SEQ ID NO: 84335 - DNA, 1908 bp, Artificial Sequence
  Description of Artificial Sequence: Synthetic coding sequence
atgagcggcgccggcagagccctggccgccctgctgctggccgccagcgtgctgagcgccgccctgctggcccccggcggcagcagcggcagagacgcccaggccgccccccccagagacctggacaagaagagacacgccgagctgaagatggaccaggccctgctgctgatccacaacgagctgctgtggaccaacctgaccgtgtactggaagagcgagtgctgctaccactgcctgttccaggtgctggtgaacgtgccccagagccccaaggccggcaagcccagcgccgccgccgccagcgtgagcacccagcacggcagcatcctgcagctgaacgacaccctggaggagaaggaggtgtgcagactggagtacagattcggcgagttcggcaactacagcctgctggtgaagaacatccacaacggcgtgagcgagatcgcctgcgacctggccgtgaacgaggaccccgtggacagcaacctgcccgtgagcatcgccttcctgatcggcctggccgtgatcatcgtgatcagcttcctgagactgctgctgagcctggacgacttcaacaactggatcagcaaggccatcagcagcagagagaccgacagactgatcaacagcgagctgggcagccccagcagaaccgaccccctggacggcgacgtgcagcccgccacctggagactgagcgccctgccccccagactgagaagcgtggacaccttcagaggcatcgccctgatcctgatggtgttcgtgaactacggcggcggcaagtactggtacttcaagcacgccagctggaacggcctgaccgtggccgacctggtgttcccctggttcgtgttcatcatgggcagcagcatcttcctgagcatgaccagcatcctgcagagaggctgcagcaagttcagactgctgggcaagatcgcctggagaagcttcctgctgatctgcatcggcatcatcatcgtgaaccccaactactgcctgggccccctgagctgggacaaggtgagaatccccggcgtgctgcagagactgggcgtgacctacttcgtggtggccgtgctggagctgctgttcgccaagcccgtgcccgagcactgcgccagcgagagaagctgcctgagcctgagagacatcaccagcagctggccccagtggctgctgatcctggtgctggagggcctgtggctgggcctgaccttcctgctgcccgtgcccggctgccccaccggctacctgggccccggcggcatcggcgacttcggcaagtaccccaactgcaccggcggcgccgccggctacatcgacagactgctgctgggcgacgaccacctgtaccagcaccccagcagcgccgtgctgtaccacaccgaggtggcctacgaccccgagggcatcctgggcaccatcaacagcatcgtgatggccttcctgggcgtgcaggccggcaagatcctgctgtactacaaggccagaaccaaggacatcctgatcagattcaccgcctggtgctgcatcctgggcctgatcagcgtggccctgaccaaggtgagcgagaacgagggcttcatccccgtgaacaagaacctgtggagcctgagctacgtgaccaccctgagcagcttcgccttcttcatcctgctggtgctgtaccccgtggtggacgtgaagggcctgtggaccggcacccccttcttctaccccggcatgaacagcatcctggtgtacgtgggccacgaggtgttcgagaactacttccccttccagtggaagctgaaggacaaccagagccacaaggagcacctgacccagaacatcgtggccaccgccctgtgggtgctgatcgcctacatcctgtacagaaagaagatcttctggaagatctag

SEQ ID NO: 84336 - DNA, 1992 bp, Artificial Sequence
  Description of Artificial Sequence: Synthetic coding sequence
atgaccggcgccagagccagcgccgccgagcagagaagagccggcagaagcggccaggccagagccgccgagagagccgccggcatgagcggcgccggcagagccctggccgccctgctgctggccgccagcgtgctgagcgccgccctgctggcccccggcggcagcagcggcagagacgcccaggccgccccccccagagacctggacaagaagagacacgccgagctgaagatggaccaggccctgctgctgatccacaacgagctgctgtggaccaacctgaccgtgtactggaagagcgagtgctgctaccactgcctgttccaggtgctggtgaacgtgccccagagccccaaggccggcaagcccagcgccgccgccgccagcgtgagcacccagcacggcagcatcctgcagctgaacgacaccctggaggagaaggaggtgtgcagactggagtacagattcggcgagttcggcaactacagcctgctggtgaagaacatccacaacggcgtgagcgagatcgcctgcgacctggccgtgaacgaggaccccgtggacagcaacctgcccgtgagcatcgccttcctgatcggcctggccgtgatcatcgtgatcagcttcctgagactgctgctgagcctggacgacttcaacaactggatcagcaaggccatcagcagcagagagaccgacagactgatcaacagcgagctgggcagccccagcagaaccgaccccctggacggcgacgtgcagcccgccacctggagactgagcgccctgccccccagactgagaagcgtggacaccttcagaggcatcgccctgatcctgatggtgttcgtgaactacggcggcggcaagtactggtacttcaagcacgccagctggaacggcctgaccgtggccgacctggtgttcccctggttcgtgttcatcatgggcagcagcatcttcctgagcatgaccagcatcctgcagagaggctgcagcaagttcagactgctgggcaagatcgcctggagaagcttcctgctgatctgcatcggcatcatcatcgtgaaccccaactactgcctgggccccctgagctgggacaaggtgagaatccccggcgtgctgcagagactgggcgtgacctacttcgtggtggccgtgctggagctgctgttcgccaagcccgtgcccgagcactgcgccagcgagagaagctgcctgagcctgagagacatcaccagcagctggccccagtggctgctgatcctggtgctggagggcctgtggctgggcctgaccttcctgctgcccgtgcccggctgccccaccggctacctgggccccggcggcatcggcgacttcggcaagtaccccaactgcaccggcggcgccgccggctacatcgacagactgctgctgggcgacgaccacctgtaccagcaccccagcagcgccgtgctgtaccacaccgaggtggcctacgaccccgagggcatcctgggcaccatcaacagcatcgtgatggccttcctgggcgtgcaggccggcaagatcctgctgtactacaaggccagaaccaaggacatcctgatcagattcaccgcctggtgctgcatcctgggcctgatcagcgtggccctgaccaaggtgagcgagaacgagggcttcatccccgtgaacaagaacctgtggagcctgagctacgtgaccaccctgagcagcttcgccttcttcatcctgctggtgctgtaccccgtggtggacgtgaagggcctgtggaccggcacccccttcttctaccccggcatgaacagcatcctggtgtacgtgggccacgaggtgttcgagaactacttccccttccagtggaagctgaaggacaaccagagccacaaggagcacctgacccagaacatcgtggccaccgccctgtgggtgctgatcgcctacatcctgtacagaaagaagatcttctggaagatctag

SEQ ID NO: 84337 - DNA, 1647 bp, Artificial Sequence
  Description of Artificial Sequence: Synthetic coding sequence
atgagagtgctgtgcgccttccccgaggccatgcccagcagcaacagcagaccccccgcctgcctggcccccggcgccctgtacctggccctgctgctgcacctgagcctgagcagccaggccggcgacagaagacccctgcccgtggacagagccgccggcctgaaggagaagaccctgatcctgctggacgtgagcaccaagaaccccgtgagaaccgtgaacgagaacttcctgagcctgcagctggaccccagcatcatccacgacggctggctggacttcctgagcagcaagagactggtgaccctggccagaggcctgagccccgccttcctgagattcggcggcaagagaaccgacttcctgcagttccagaacctgagaaaccccgccaagagcagaggcggccccggccccgactactacctgaagaactacgaggacgacatcgtgagaagcgacgtggccctggacaagcagaagggctgcaagatcgcccagcaccccgacgtgatgctggagctgcagagagagaaggccgcccagatgcacctggtgctgctgaaggagcagttcagcaacacctacagcaacctgatcctgaccgccagaagcctggacaagctgtacaacttcgccgactgcagcggcctgcacctgatcttcgccctgaacgccctgagaagaaaccccaacaacagctggaacagcagcagcgccctgagcctgctgaagtacagcgccagcaagaagtacaacatcagctgggagctgggcaacgagcccaacaactacagaaccatgcacggcagagccgtgaacggcagccagctgggcaaggactacatccagctgaagagcctgctgcagcccatcagaatctacagcagagccagcctgtacggccccaacatcggcagacccagaaagaacgtgatcgccctgctggacggcttcatgaaggtggccggcagcaccgtggacgccgtgacctggcagcactgctacatcgacggcagagtggtgaaggtgatggacttcctgaagaccagactgctggacaccctgagcgaccagatcagaaagatccagaaggtggtgaacacctacacccccggcaagaagatctggctggagggcgtggtgaccaccagcgccggcggcaccaacaacctgagcgacagctacgccgccggcttcctgtggctgaacaccctgggcatgctggccaaccagggcatcgacgtggtgatcagacacagcttcttcgaccacggctacaaccacctggtggaccagaacttcaaccccctgcccgactactggctgagcctgctgtacaagagactgatcggccccaaggtgctggccgtgcacgtggccggcctgcagagaaagcccagacccggcagagtgatcagagacaagctgagaatctacgcccactgcaccaaccaccacaaccacaactacgtgagaggcagcatcaccctgttcatcatcaacctgcacagaagcagaaagaagatcaagctggccggcaccctgagagacaagctggtgcaccagtacctgctgcagccctacggccaggagggcctgaagagcaagacccagagatgccagtactgcggcatcatctag

SEQ ID NO: 84338 - DNA, 1605 bp, Artificial Sequence
  Description of Artificial Sequence: Synthetic coding sequence
atgagagtgctgtgcgccttccccgaggccatgcccagcagcaacagcagaccccccgcctgcctggcccccggcgccctgtacctggccctgctgctgcacctgagcctgagcagccaggccggcgacagaagacccctgcccgtggacagagccgccggcctgaaggagaagaccctgatcctgctggacgtgagcaccaagaaccccgtgagaaccgtgaacgagaacttcctgagcctgcagctggaccccagcatcatccacgacggctggctggacttcctgagcagcaagagactggtgaccctggccagaggcctgagccccgccttcctgagattcggcggcaagagaaccgacttcctgcagttccagaacctgagaaaccccgccaagagcagaggcggccccggccccgactactacctgaagaactacgaggacgacatcgtgagaagcgacgtggccctggacaagcagaagggctgcaagatcgcccagcaccccgacgtgatgctggagctgcagagagagaaggccgcccagatgcacctggtgctgctgaaggagcagttcagcaacacctacagcaacctgatcctgaccgagcccaacaactacagaaccatgcacggcagagccgtgaacggcagccagctgggcaaggactacatccagctgaagagcctgctgcagcccatcagaatctacagcagagccagcctgtacggccccaacatcggcagacccagaaagaacgtgatcgccctgctggacggcttcatgaaggtggccggcagcaccgtggacgccgtgacctggcagcactgctacatcgacggcagagtggtgaaggtgatggacttcctgaagaccagactgctggacaccctgagcgaccagatcagaaagatccagaaggtggtgaacacctacacccccggcaagaagatctggctggagggcgtggtgaccaccagcgccggcggcaccaacaacctgagcgacagctacgccgccggcttcctgtggctgaacaccctgggcatgctggccaaccagggcatcgacgtggtgatcagacacagcttcttcgaccacggctacaaccacctggtggaccagaacttcaaccccctgcccgactactggctgagcctgctgtacaagagactgatcggccccaaggtgctggccgtgcacgtggccggcctgcagagaaagcccagacccggcagagtgatcagagacaagctgagaatctacgcccactgcaccaaccaccacaaccacaactacgtgagaggcagcatcaccctgttcatcatcaacctgcacagaagcagaaagaagatcaagctggccggcaccctgagagacaagctggtgcaccagtacctgctgcagccctacggccaggagggcctgaagagcaagagcgtgcagctgaacggccagcccctggtgatggtggacgacggcaccctgcccgagctgaagcccagacccctgagagccggcagaaccctggtgatcccccccgtgaccatgggcttctacgtggtgaagaacgtgaacgccctggcctgcagatacagatag

SEQ ID NO: 84339 - DNA, 1779 bp, Artificial Sequence
  Description of Artificial Sequence: Synthetic coding sequence
atgagagtgctgtgcgccttccccgaggccatgcccagcagcaacagcagaccccccgcctgcctggcccccggcgccctgtacctggccctgctgctgcacctgagcctgagcagccaggccggcgacagaagacccctgcccgtggacagagccgccggcctgaaggagaagaccctgatcctgctggacgtgagcaccaagaaccccgtgagaaccgtgaacgagaacttcctgagcctgcagctggaccccagcatcatccacgacggctggctggacttcctgagcagcaagagactggtgaccctggccagaggcctgagccccgccttcctgagattcggcggcaagagaaccgacttcctgcagttccagaacctgagaaaccccgccaagagcagaggcggccccggccccgactactacctgaagaactacgaggacgacatcgtgagaagcgacgtggccctggacaagcagaagggctgcaagatcgcccagcaccccgacgtgatgctggagctgcagagagagaaggccgcccagatgcacctggtgctgctgaaggagcagttcagcaacacctacagcaacctgatcctgaccgccagaagcctggacaagctgtacaacttcgccgactgcagcggcctgcacctgatcttcgccctgaacgccctgagaagaaaccccaacaacagctggaacagcagcagcgccctgagcctgctgaagtacagcgccagcaagaagtacaacatcagctgggagctgggcaacgagcccaacaactacagaaccatgcacggcagagccgtgaacggcagccagctgggcaaggactacatccagctgaagagcctgctgcagcccatcagaatctacagcagagccagcctgtacggccccaacatcggcagacccagaaagaacgtgatcgccctgctggacggcttcatgaaggtggccggcagcaccgtggacgccgtgacctggcagcactgctacatcgacggcagagtggtgaaggtgatggacttcctgaagaccagactgctggacaccctgagcgaccagatcagaaagatccagaaggtggtgaacacctacacccccggcaagaagatctggctggagggcgtggtgaccaccagcgccggcggcaccaacaacctgagcgacagctacgccgccggcttcctgtggctgaacaccctgggcatgctggccaaccagggcatcgacgtggtgatcagacacagcttcttcgaccacggctacaaccacctggtggaccagaacttcaaccccctgcccgactactggctgagcctgctgtacaagagactgatcggccccaaggtgctggccgtgcacgtggccggcctgcagagaaagcccagacccggcagagtgatcagagacaagctgagaatctacgcccactgcaccaaccaccacaaccacaactacgtgagaggcagcatcaccctgttcatcatcaacctgcacagaagcagaaagaagatcaagctggccggcaccctgagagacaagctggtgcaccagtacctgctgcagccctacggccaggagggcctgaagagcaagagcgtgcagctgaacggccagcccctggtgatggtggacgacggcaccctgcccgagctgaagcccagacccctgagagccggcagaaccctggtgatcccccccgtgaccatgggcttctacgtggtgaagaacgtgaacgccctggcctgcagatacagatag

SEQ ID NO: 84340 - DNA, 1443 bp, Artificial Sequence
  Description of Artificial Sequence: Synthetic coding sequence
atgagagtgctgtgcgccttccccgaggccatgcccagcagcaacagcagaccccccgcctgcctggcccccggcgccctgtacctggccctgctgctgcacctgagcctgagcagccaggccggcgacagaagacccctgcccgtggacagagccgccggcctgaaggagaagaccctgatcctgctggacgtgagcaccaagaaccccgtgagaaccgtgaacgagaacttcctgagcctgcagctggaccccagcatcatccacgacggctggctggacttcctgagcagcaagagactggtgaccctggccagaggcctgagccccgccttcctgagattcggcggcaagagaaccgacttcctgcagttccagaacctgagaaaccccgccaagagcagaggcggccccggccccgactactacctgaagaactacgaggacgagcccaacaactacagaaccatgcacggcagagccgtgaacggcagccagctgggcaaggactacatccagctgaagagcctgctgcagcccatcagaatctacagcagagccagcctgtacggccccaacatcggcagacccagaaagaacgtgatcgccctgctggacggcttcatgaaggtggccggcagcaccgtggacgccgtgacctggcagcactgctacatcgacggcagagtggtgaaggtgatggacttcctgaagaccagactgctggacaccctgagcgaccagatcagaaagatccagaaggtggtgaacacctacacccccggcaagaagatctggctggagggcgtggtgaccaccagcgccggcggcaccaacaacctgagcgacagctacgccgccggcttcctgtggctgaacaccctgggcatgctggccaaccagggcatcgacgtggtgatcagacacagcttcttcgaccacggctacaaccacctggtggaccagaacttcaaccccctgcccgactactggctgagcctgctgtacaagagactgatcggccccaaggtgctggccgtgcacgtggccggcctgcagagaaagcccagacccggcagagtgatcagagacaagctgagaatctacgcccactgcaccaaccaccacaaccacaactacgtgagaggcagcatcaccctgttcatcatcaacctgcacagaagcagaaagaagatcaagctggccggcaccctgagagacaagctggtgcaccagtacctgctgcagccctacggccaggagggcctgaagagcaagagcgtgcagctgaacggccagcccctggtgatggtggacgacggcaccctgcccgagctgaagcccagacccctgagagccggcagaaccctggtgatcccccccgtgaccatgggcttctacgtggtgaagaacgtgaacgccctggcctgcagatacagatag

SEQ ID NO: 84341 - DNA, 1251 bp, Artificial Sequence
  Description of Artificial Sequence: Synthetic coding sequence
atgaagagagagagaggcgccctgagcagagccagcagagccctgagactggcccccttcgtgtacctgctgctgatccagaccgaccccctggagggcgtgaacatcaccagccccgtgagactgatccacggcaccgtgggcaagagcgccctgctgagcgtgcagtacagcagcaccagcagcgacagacccgtggtgaagtggcagctgaagagagacaagcccgtgaccgtggtgcagagcatcggcaccgaggtgatcggcaccctgagacccgactacagagacagaatcagactgttcgagaacggcagcctgctgctgagcgacctgcagctggccgacgagggcacctacgaggtggagatcagcatcaccgacgacaccttcaccggcgagaagaccatcaacctgaccgtggacgtgcccatcagcagaccccaggtgctggtggccagcaccaccgtgctggagctgagcgaggccttcaccctgaactgcagccacgagaacggcaccaagcccagctacacctggctgaaggacggcaagcccctgctgaacgacagcagaatgctgctgagccccgaccagaaggtgctgaccatcaccagagtgctgatggaggacgacgacctgtacagctgcatggtggagaaccccatcagccagggcagaagcctgcccgtgaagatcaccgtgtacagaagaagcagcctgtacatcatcctgagcaccggcggcatcttcctgctggtgaccctggtgaccgtgtgcgcctgctggaagcccagcaagagaaagcagaagaagctggagaagcagaacagcctggagtacatggaccagaacgacgacagactgaagcccgaggccgacaccctgcccagaagcggcgagcaggagagaaagaaccccatggccctgtacatcctgaaggacaaggacagccccgagaccgaggagaaccccgcccccgagcccagaagcgccaccgagcccggcccccccggctacagcgtgagccccgccgtgcccggcagaagccccggcctgcccatcagaagcgccagaagataccccagaagccccgccagaagccccgccaccggcagaacccacagcagcccccccagagcccccagcagccccggcagaagcagaagcgccagcagaaccctgagaaccgccggcgtgcacatcatcagagagcaggacgaggccggccccgtggagatcagcgcctag

SEQ ID NO: 84342 - DNA, 1104 bp, Artificial Sequence
  Description of Artificial Sequence: Synthetic coding sequence
atgaagagagagagaggcgccctgagcagagccagcagagccctgagactggcccccttcgtgtacctgctgctgatccagaccgaccccctggagggcgtgaacatcaccagccccgtgagactgatccacggcaccgtgggcaagagcgccctgctgagcgtgcagtacagcagcaccagcagcgacagacccgtggtgaagtggcagctgaagagagacaagcccgtgaccgtggtgcagagcatcggcaccgaggtgatcggcaccctgagacccgactacagagacagaatcagactgttcgagaacggcagcctgctgctgagcgacctgcagctggccgacgagggcacctacgaggtggagatcagcatcaccgacgacaccttcaccggcgagaagaccatcaacctgaccgtggacgtgcccatcagcagaccccaggtgctggtggccagcaccaccgtgctggagctgagcgaggccttcaccctgaactgcagccacgagaacggcaccaagcccagctacacctggctgaaggacggcaagcccctgctgaacgacagcagaatgctgctgagccccgaccagaaggtgctgaccatcaccagagtgctgatggaggacgacgacctgtacagctgcatggtggagaaccccatcagccagggcagaagcctgcccgtgaagatcaccgtgtacagaagaagcagcctgtacatcatcctgagcaccggcggcatcttcctgctggtgaccctggtgaccgtgtgcgcctgctggaagcccagcaagagaaagcagaagaagctggagaagcagaacagcctggagtacatggaccagaacgacgacagactgaagcccgagggcgagctgcccgccacccagagccccatccccagcaccatcagaagcgtgggctgctgggagaaggccgagctgggcgacaaggagaacagcagcgccggcaccctgcccagcgacctgggcgccagcaagggcaaggagcccgagcccgccagcctggccagcagccacagcctgcccagaagacacgccatgcccagcaccctgagcgtgagcgtgcacgagtag

SEQ ID NO: 84343 - DNA, 669 bp, Artificial Sequence
  Description of Artificial Sequence: Synthetic coding sequence
atgagccagaccaagatgctgaaggtgagagtgaccctgttctgcatcctggccggcatcgtgctggccatgaccgccgtggtgaccgaccactgggccgtgctgagcccccacatggagcaccacaacaccacctgcgaggccgcccacttcggcctgtggagaatctgcaccaagagaatccccatggacgacagcaagacctgcggccccatcaccctgcccggcgagaagaactgcagctacttcagacacttcaaccccggcgagagcagcgagatcttcgagttcaccacccagaaggagtacagcatcagcgccgccgccatcgccatcttcagcctgggcttcatcatcctgggcagcctgtgcgtgctgctgagcctgggcaagaagagagactacctgctgagacccgccagcatgttctacgccttcgccggcctgtgcatcctggtgagcgtggaggtgatgagacagagcgtgaagagaatgatcgacagcgaggacaccgtgtggatcgagtactactacagctggagcttcgcctgcgcctgcgccgccttcatcctgctgttcctgggcggcctggccctgctgctgttcagcctgcccagaatgcccagaaacccctgggagagctgcatggacgccgagcccgagcactag

SEQ ID NO: 84344 - DNA, 633 bp, Artificial Sequence
  Description of Artificial Sequence: Synthetic coding sequence
atggacctggaggagttcctgagcgagaacggcatcccccccagccccagccagcacgaccacagcccccacccccccggcctgcagcccgccagcagcgccgcccccagcgtgatggacctgagcagcagagccagcgcccccctgcaccccggcatccccagccccaactgcatgcagagccccatcagacccggccagctgctgcccgccaacagaaacacccccagccccatcgaccccgacaccatccaggtgcccgtgggctacgagcccgaccccgccgacctggccctgagcagcatccccggccaggagatgttcgaccccagaaagagaaagttcagcgaggaggagctgaagccccagcccatgatcaagaaggccagaaaggtgttcatccccgacgacctgaaggacgacaagtactgggccagaagaagaaagaacaacatggccgccaagagaagcagagacgccagaagactgaaggagaaccagatcgccatcagagccagcttcctggagaaggagaacagcgccctgagacaggaggtggccgacctgagaaaggagctgggcaagtgcaagaacatcctggccaagtacgaggccagacacggccccctgtag

SEQ ID NO: 84345 - DNA, 1095 bp, Artificial Sequence
  Description of Artificial Sequence: Synthetic coding sequence
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagcccgtggccaccagccccagcagcccccagcccgccgagacccaccccaccaccctgcagggcgccatcagaagagagcccaccagcagccccctgtacagctacaccaccgacggcaacgacaccgtgaccgagagcagcgacggcctgtggaacaacaaccagacccagctgttcctggagcacagcctgctgaccgccaacaccaccaagggcatctacgccggcgtgtgcatcagcgtgctggtgctgctggccctgctgggcgtgatcatcgccaagaagtacttcttcaagaaggaggtgcagcagctgagcgtgagcttcagcagcctgcagatcaaggccctgcagaacgccgtggagaaggaggtgcaggccgaggacaacatctacatcgagaacagcctgtacgccaccgactag

SEQ ID NO: 84346 - DNA, 1206 bp, Artificial Sequence
  Description of Artificial Sequence: Synthetic coding sequence
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagcccgtggccaccagccccagcagcccccagcccgccgagacccaccccaccaccctgcagggcgccatcagaagagagcccaccagcagccccctgtacagctacaccaccgacggcaacgacaccgtgaccgagagcagcgacggcctgtggaacaacaaccagacccagctgttcctggagcacagcctgctgaccgccaacaccaccaagggcatctacgccggcgtgtgcatcagcgtgctggtgctgctggccctgctgggcgtgatcatcgccaagatgttccacctggccgccttcaagctgaagctgtgcaagatgcagctgaagagaaagagcaagcagaagaccatcagcaccctgagaatcgtgttcatgcccagaaccaagacccagtggtgcagcctgagagtgtacgcccacgagtgcagaagactgaacagacaccagcacatcagaagactgctggaccccaagaccatcttcctgttccagttccacctggccttccagcacgtgagcgacaccggctag

SEQ ID NO: 84347 - DNA, 672 bp, Artificial Sequence
  Description of Artificial Sequence: Synthetic coding sequence
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagtag

SEQ ID NO: 84348 - DNA, 1095 bp, Artificial Sequence; identical to SEQ ID NO: 84345
  Description of Artificial Sequence: Synthetic coding sequence

SEQ ID NO: 84349 - DNA, 1095 bp, Artificial Sequence; identical to SEQ ID NO: 84345
  Description of Artificial Sequence: Synthetic coding sequence

SEQ ID NO: 84350 - DNA, 522 bp, Artificial Sequence
  Description of Artificial Sequence: Synthetic coding sequence
atggagcccggcgccggccacctggacggccacagagccggcagccccagcctgagacaggccctgtgcgacggcagcgccgtgatgttcagcagcaaggagagaggcagatgcaccgtgatcaacttcgtgcccctggaggcccccctgagaagcacccccagaagcagacaggtgaccgaggcctgcggcggcgagggcagagccgtgcccctgggcagcgagcccgagtggagcgtgggcggcatggaggccaccctggagcagcacctggaggacaccatgaagaaccccagcatcgtgggcgtgctgtgcaccgacagccagggcctgaacctgggctgcagaggcaccctgagcgacgagcacgccggcgtgatcagcgtgctggcccagcaggccgccaagctgaccagcgaccccaccgacatccccgtggtgtgcctggagagcgacaacggcaacatcatgatccagaagcacgacggcatcaccgtggccgtgcacaagatggccagctag

SEQ ID NO: 84351 - DNA, 267 bp, Artificial Sequence
  Description of Artificial Sequence: Synthetic coding sequence
atgggcaactggggcctgggcatcgccccctgggtggacggcgagagcgagctggagttcagaagactgggcatgcagggccccctggaggccctgagaagaagagagtggaacacccagagagccagcttcagcttcagcttcctgatcgccctgagcccccacaccgtggactactgccacagctacgagctgttcaacagaagatggcacggccacgtgctggccacccagagacccagcctgttcatcctgatgctggtgtag

SEQ ID NO: 84352 - DNA, 2334 bp, Artificial Sequence
  Description of Artificial Sequence: Synthetic coding sequence
atgggcagaggcagcggcaccttcgagagactgctggacaaggccaccagccagctgctgctggagaccgactgggagagcatcctgcagatctgcgacctgatcagacagggcgacacccaggccaagtacgccgtgaacagcatcaagaagaaggtgaacgacaagaacccccacgtggccctgtacgccctggaggtgatggagagcgtggtgaagaactgcggccagaccgtgcacgacgaggtggccaacaagcagaccatggaggagctgaaggacctgctgaagagacaggtggaggtgaacgtgagaaacaagatcctgtacctgatccaggcctgggcccacgccttcagaaacgagcccaagtacaaggtggtgcaggacacctaccagatcatgaaggtggagggccacgtgttccccgagttcaaggagagcgacgccatgttcgccgccgagagagcccccgactgggtggacgccgaggagtgccacagatgcagagtgcagttcggcgtgatgaccagaaagcaccactgcagagcctgcggccagatcttctgcggcaagtgcagcagcaagtacagcaccatccccaagttcggcatcgagaaggaggtgagagtgtgcgagccctgctacgagcagctgaacagaaaggccgagggcaaggccaccagcaccaccgagctgccccccgagtacctgaccagccccctgagccagcagagccagctgccccccaagagagacgagaccgccctgcaggaggaggaggagctgcagctggccctggccctgagccagagcgaggccgaggagaaggagagactgagacagaagagcacctacaccagctaccccaaggccgagcccatgcccagcgccagcagcgccccccccgccagcagcctgtacagcagccccgtgaacagcagcgcccccctggccgaggacatcgaccccgagctggccagatacctgaacagaaactactgggagaagaagcaggaggaggccagaaagagccccacccccagcgcccccgtgcccctgaccgagcccgccgcccagcccggcgagggccacgccgcccccaccaacgtggtggagaaccccctgcccgagaccgacagccagcccatcccccccagcggcggccccttcagcgagccccagttccacaacggcgagagcgaggagagccacgagcagttcctgaaggccctgcagaacgccgtgaccaccttcgtgaacagaatgaagagcaaccacatgagaggcagaagcatcaccaacgacagcgccgtgctgagcctgttccagagcatcaacggcatgcacccccagctgctggagctgctgaaccagctggacgagagaagactgtactacgagggcctgcaggacaagctggcccagatcagagacgccagaggcgccctgagcgccctgagagaggagcacagagagaagctgagaagagccgccgaggaggccgagagacagagacagatccagctggcccagaagctggagatcatgagacagaagaagcaggagtacctggaggtgcagagacagctggccatccagagactgcaggagcaggagaaggagagacagatgagactggagcagcagaagcagaccgtgcagatgagagcccagatgcccgccttccccctgccctacgcccagctgcaggccatgcccgccgccggcggcgtgctgtaccagcccagcggccccgccagcttccccagcaccttcagccccgccggcagcgtggagggcagccccatgcacggcgtgtacatgagccagcccgcccccgccgccggcccctaccccagcatgcccagcaccgccgccgaccccagcatggtgagcgcctacatgtaccccgccggcgccaccggcgcccaggccgccccccaggcccaggccggccccaccgccagccccgcctacagcagctaccagcccacccccaccgccggctaccagaacgtggccagccaggccccccagagcctgcccgccatcagccagcccccccagagcagcaccatgggctacatgggcagccagagcgtgagcatgggctaccagccctacaacatgcagaacctgatgaccaccctgcccagccaggacgccagcctgcccccccagcagccctacatcgccggccagcagcccatgtaccagcagatggcccccagcggcggccccccccagcagcagccccccgtggcccagcagccccaggcccagggcccccccgcccagggcagcgaggcccagctgatcagcttcgactag

SEQ ID NO: 84353 - DNA, 2076 bp, Artificial Sequence
  Description of Artificial Sequence: Synthetic coding sequence
atgggcagaggcagcggcaccttcgagagactgctggacaaggccaccagccagctgctgctggagaccgactgggagagcatcctgcagatctgcgacctgatcagacagggcgacacccaggccaagtacgccgtgaacagcatcaagaagaaggtgaacgacaagaacccccacgtggccctgtacgccctggaggtgatggagagcgtggtgaagaactgcggccagaccgtgcacgacgaggtggccaacaagcagaccatggaggagctgaaggacctgctgaagagacaggtggaggtgaacgtgagaaacaagatcctgtacctgatccaggcctgggcccacgccttcagaaacgagcccaagtacaaggtggtgcaggacacctaccagatcatgaaggtggagggccacgtgttccccgagttcaaggagagcgacgccatgttcgccgccgagagagcccccgactgggtggacgccgaggagtgccacagatgcagagtgcagttcggcgtgatgaccagaaagcaccactgcagagcctgcggccagatcttctgcggcaagtgcagcagcaagtacagcaccatccccaagttcggcatcgagaaggaggtgagagtgtgcgagccctgctacgagcagctgaacagaaaggccgagggcaaggccaccagcaccaccgagctgccccccgagtacctgaccagccccctgagccagcagagccagctgccccccaagagagacgagaccgccctgcaggaggaggaggagctgcagctggccctggccctgagccagagcgaggccgaggagaaggagagactgagacagaagagcacctacaccagctaccccaaggccgagcccatgcccagcgccagcagcgccccccccgccagcagcctgtacagcagccccgtgaacagcagcgcccccctggccgaggacatcgaccccgagctggccagatacctgaacagaaactactgggagaagaagcaggaggaggccagaaagagccccacccccagcgcccccgtgcccctgaccgagcccgccgcccagcccggcgagggccacgccgcccccaccaacgtggtggagaaccccctgcccgagaccgacagccagcccatcccccccagcggcggccccttcagcgagccccagttccacaacggcgagagcgaggagagccacgagcagttcctgaaggccctgcagaacgccgtgaccaccttcgtgaacagaatgaagagcaaccacatgagaggcagaagcatcaccaacgacagcgccgtgctgagcctgttccagagcatcaacggcatgcacccccagctgctggagctgctgaaccagctggacgagagaagactgtactacgagggcctgcaggacaagctggcccagatcagagacgccagaggcgccctgagcgccctgagagaggagcacagagagaagctgagaagagccgccgaggaggccgagagacagagacagatccagctggcccagaagctggagatcatgatgcacggcgtgtacatgagccagcccgcccccgccgccggcccctaccccagcatgcccagcaccgccgccgaccccagcatggtgagcgcctacatgtaccccgccggcgccaccggcgcccaggccgccccccaggcccaggccggccccaccgccagccccgcctacagcagctaccagcccacccccaccgccggctaccagaacgtggccagccaggccccccagagcctgcccgccatcagccagcccccccagagcagcaccatgggctacatgggcagccagagcgtgagcatgggctaccagccctacaacatgcagaacctgatgaccaccctgcccagccaggacgccagcctgcccccccagcagccctacatcgccggccagcagcccatgtaccagcagatggcccccagcggcggccccccccagcagcagccccccgtggcccagcagccccaggcccagggcccccccgcccagggcagcgaggcccagctgatcagcttcgactag

SEQ ID NO: 84354 - DNA, 324 bp, Artificial Sequence
  Description of Artificial Sequence: Synthetic coding sequence
atgagactgagcaagaccctggtggacatggacatggccgactacagcgccgccctggaccccgcctacaccaccctggagttcgagaacgtgcaggtgctgaccatgggcaacgacttcgtggccgccgccagcagacagatcgaggccagcccccccaccagcctggagcacatctggagaggcggccagttcagcaccggcagacacgtgcccatcagaagacaccagccccagagagcccagcagcccggctgccagagacccgtgtgccacctgagaggccccggccacggccagaccctgagatgcctggagctgtag

SEQ ID NO: 84355 - DNA, 1425 bp, Artificial Sequence
  Description of Artificial Sequence: Synthetic coding sequence
atgagactgagcaagaccctggtggacatggacatggccgactacagcgccgccctggaccccgcctacaccaccctggagttcgagaacgtgcaggtgctgaccatgggcaacgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcagccccagcgacgccccccacgcccaccaccccctgcacccccacctgatgcaggagcacatgggcaccaacgtgatcgtggccaacaccatgcccacccacctgagcaacggccagatgtgcgagtggcccagacccagaggccaggccgccacccccgagaccccccagcccagcccccccggcggcagcggcagcgagccctacaagctgctgcccggcgccgtggccaccatcgtgaagcccctgagcgccatcccccagcccaccatcaccaagcaggaggtgatctag

SEQ ID NO: 84356 - DNA, 1359 bp, Artificial Sequence
  Description of Artificial Sequence: Synthetic coding sequence
atggtgagcgtgaacgcccccctgggcgcccccgtggagagcagctacgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcagccccagcgacgccccccacgcccaccaccccctgcacccccacctgatgcaggagcacatgggcaccaacgtgatcgtggccaacaccatgcccacccacctgagcaacggccagatgtgcgagtggcccagacccagaggccaggccgccacccccgagaccccccagcccagcccccccggcggcagcggcagcgagccctacaagctgctgcccggcgccgtggccaccatcgtgaagcccctgagcgccatcccccagcccaccatcaccaagcaggaggtgatctag

SEQ ID NO: 84357 - DNA, 1515 bp, Artificial Sequence
  Description of Artificial Sequence: Synthetic coding sequence
atgagactgagcaagaccctggtggacatggacatggccgactacagcgccgccctggaccccgcctacaccaccctggagttcgagaacgtgcaggtgctgaccatgggcaacgtgctgctgcccctgagactggccagactgagacaccccctgagacaccactggagcatcagcggcggcgtggacagcagcccccagggcgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcagccccagcgacgccccccacgcccaccaccccctgcacccccacctgatgcaggagcacatgggcaccaacgtgatcgtggccaacaccatgcccacccacctgagcaacggccagatgtgcgagtggcccagacccagaggccaggccgccacccccgagaccccccagcccagcccccccggcggcagcggcagcgagccctacaagctgctgcccggcgccgtggccaccatcgtgaagcccctgagcgccatcccccagcccaccatcaccaagcaggaggtgatctag

SEQ ID NO: 84358 - DNA, 1395 bp, Artificial Sequence
  Description of Artificial Sequence: Synthetic coding sequence
atgagactgagcaagaccctggtggacatggacatggccgactacagcgccgccctggaccccgcctacaccaccctggagttcgagaacgtgcaggtgctgaccatgggcaacgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcagccccagcgacgccccccacgcccaccaccccctgcacccccacctgatgcaggagcacatgggcaccaacgtgatcgtggccaacaccatgcccacccacctgagcaacggccagatgagcacccccgagaccccccagcccagcccccccggcggcagcggcagcgagccctacaagctgctgcccggcgccgtggccaccatcgtgaagcccctgagcgccatcccccagcccaccatcaccaagcaggaggtgatctag

SEQ ID NO: 84359 - DNA, 1254 bp, Artificial Sequence
  Description of Artificial Sequence: Synthetic coding sequence
atgagactgagcaagaccctggtggacatggacatggccgactacagcgccgccctggaccccgcctacaccaccctggagttcgagaacgtgcaggtgctgaccatgggcaacgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcccctgccaggcccaggagggcagaggctggagcggcgacagccccggcgacagaccccacaccgtgagcagccccctgagcagcctggccagccccctgtgcagattcggccaggtggcctag

SEQ ID NO: 84360 - DNA, 1329 bp, Artificial Sequence
  Description of Artificial Sequence: Synthetic coding sequence
atggtgagcgtgaacgcccccctgggcgcccccgtggagagcagctacgacaccagccccagcgagggcaccaacctgaacgcccccaacagcctgggcgtgagcgccctgtgcgccatctgcggcgacagagccaccggcaagcactacggcgccagcagctgcgacggctgcaagggcttcttcagaagaagcgtgagaaagaaccacatgtacagctgcagattcagcagacagtgcgtggtggacaaggacaagagaaaccagtgcagatactgcagactgaagaagtgcttcagagccggcatgaagaaggaggccgtgcagaacgagagagacagaatcagcaccagaagaagcagctacgaggacagcagcctgcccagcatcaacgccctgctgcaggccgaggtgctgagcagacagatcaccagccccgtgagcggcatcaacggcgacatcagagccaagaagatcgccagcatcgccgacgtgtgcgagagcatgaaggagcagctgctggtgctggtggagtgggccaagtacatccccgccttctgcgagctgcccctggacgaccaggtggccctgctgagagcccacgccggcgagcacctgctgctgggcgccaccaagagaagcatggtgttcaaggacgtgctgctgctgggcaacgactacatcgtgcccagacactgccccgagctggccgagatgagcagagtgagcatcagaatcctggacgagctggtgctgcccttccaggagctgcagatcgacgacaacgagtacgcctacctgaaggccatcatcttcttcgaccccgacgccaagggcctgagcgaccccggcaagatcaagagactgagaagccaggtgcaggtgagcctggaggactacatcaacgacagacagtacgacagcagaggcagattcggcgagctgctgctgctgctgcccaccctgcagagcatcacctggcagatgatcgagcagatccagttcatcaagctgttcggcatggccaagatcgacaacctgctgcaggagatgctgctgggcggcagccccagcgacgccccccacgcccaccaccccctgcacccccacctgatgcaggagcacatgggcaccaacgtgatcgtggccaacaccatgcccacccacctgagcaacggccagatgagcacccccgagaccccccagcccagcccccccggcggcagcggcagcgagccctacaagctgctgcccggcgccgtggccaccatcgtgaagcccctgagcgccatcccccagcccaccatcaccaagcaggaggtgatctag

SEQ ID NO: 84361 - DNA, 1227 bp, Artificial Sequence
  Description of Artificial Sequence: Synthetic coding sequence
atgaacaccaccgacaacggcgtgaactgcctgtgcgccatctgcggcgacagagccaccggcaagcactacggcgccagcagctgcgacggctgcaagggcttcttcagaagaagcatcagaaagagccacgtgtacagctgcagattcagcagacagtgcgtggtggacaaggacaagagaaaccagtgcagatactgcagactgagaaagtgcttcagagccggcatgaagaaggaggccgtgcagaacgagagagacagaatcagcaccagaagaagcaccttcgacggcagcaacatccccagcatcaacaccctggcccaggccgaggtgagaagcagacagatcagcgtgagcagccccggcagcagcaccgacatcaacgtgaagaagatcgccagcatcggcgacgtgtgcgagagcatgaagcagcagctgctggtgctggtggagtgggccaagtacatccccgccttctgcgagctgcccctggacgaccaggtggccctgctgagagcccacgccggcgagcacctgctgctgggcgccaccaagagaagcatgatgtacaaggacatcctgctgctgggcaacaactacgtgatccacagaaacagctgcgaggtggagatcagcagagtggccaacagagtgctggacgagctggtgagacccttccaggagatccagatcgacgacaacgagtacgcctgcctgaaggccatcgtgttcttcgaccccgacgccaagggcctgagcgaccccgtgaagatcaagaacatgagattccaggtgcagatcggcctggaggactacatcaacgacagacagtacgacagcagaggcagattcggcgagctgctgctgctgctgcccaccctgcagagcatcacctggcagatgatcgagcagatccagttcgtgaagctgttcggcatggtgaagatcgacaacctgctgcaggagatgctgctgggcggcgccagcaacgacggcagccacctgcaccaccccatgcacccccacctgagccaggaccccctgaccggccagaccatcctgctgggccccatgagcaccctggtgcacgccgaccagatcagcacccccgagacccccctgcccagccccccccagggcagcggccaggagcagtacaagatcgccgccaaccaggccagcgtgatcagccaccagcacctgagcaagcagaagcagctgtag

SEQ ID NO: 84362 - DNA, 1338 bp, Artificial Sequence
  Description of Artificial Sequence: Synthetic coding sequence
atggacatggccaactacagcgaggtgctggaccccacctacaccaccctggagttcgagaccatgcagatcctgtacaacagcagcgacagcagcgcccccgagaccagcatgaacaccaccgacaacggcgtgaactgcctgtgcgccatctgcggcgacagagccaccggcaagcactacggcgccagcagctgcgacggctgcaagggcttcttcagaagaagcatcagaaagagccacgtgtacagctgcagattcagcagacagtgcgtggtggacaaggacaagagaaaccagtgcagatactgcagactgagaaagtgcttcagagccggcatgaagaaggaggccgtgcagaacgagagagacagaatcagcaccagaagaagcaccttcgacggcagcaacatccccagcatcaacaccctggcccaggccgaggtgagaagcagacagatcagcgtgagcagccccggcagcagcaccgacatcaacgtgaagaagatcgccagcatcggcgacgtgtgcgagagcatgaagcagcagctgctggtgctggtggagtgggccaagtacatccccgccttctgcgagctgcccctggacgaccaggtggccctgctgagagcccacgccggcgagcacctgctgctgggcgccaccaagagaagcatgatgtacaaggacatcctgctgctgggcaacaactacgtgatccacagaaacagctgcgaggtggagatcagcagagtggccaacagagtgctggacgagctggtgagacccttccaggagatccagatcgacgacaacgagtacgcctgcctgaaggccatcgtgttcttcgaccccgacgccaagggcctgagcgaccccgtgaagatcaagaacatgagattccaggtgcagatcggcctggaggactacatcaacgacagacagtacgacagcagaggcagattcggcgagctgctgctgctgctgcccaccctgcagagcatcacctggcagatgatcgagcagatccagttcgtgaagctgttcggcatggtgaagatcgacaacctgctgcaggagatgctgctgggcggcgccagcaacgacggcagccacctgcaccaccccatgcacccccacctgagccaggaccccctgaccggccagaccatcctgctgggccccatgagcaccctggtgcacgccgaccagatcagcacccccgagacccccctgcccagccccccccagggcagcggccaggagcagtacaagatcgccgccaaccaggccagcgtgatcagccaccagcacctgagcaagcagaagcagctgtag

SEQ ID NO: 84363 - DNA, 723 bp, Artificial Sequence
  Description of Artificial Sequence: Synthetic coding sequence
atgagcagaagcaacagacagaaggagtacaagtgcggcgacctggtgttcgccaagatgaagggctacccccactggcccgccagaatcgacgagatgcccgaggccgccgtgaagagcaccgccaacaagtaccaggtgttcttcttcggcacccacgagaccgccttcctgggccccaaggacctgttcccctacgaggagagcaaggagaagttcggcaagcccaacaagagaaagggcttcagcgagggcctgtgggagatcgagaacaaccccaccgtgaaggccagcggctaccagagcagccagaagaagagctgcgtggaggagcccgagcccgagcccgaggccgccgagggcgacggcgacaagaagggcaacgccgagggcagcagcgacgaggagggcaagctggtgatcgacgagcccgccaaggagaagaacgagaagggcgccctgaagagaagagccggcgacctgctggaggacagccccaagagacccaaggaggccgagaaccccgagggcgaggagaaggaggccgccaccctggaggtggagagacccctgcccatggaggtggagaagaacagcacccccagcgagcccggcagcggcagaggccccccccaggaggaggaggaggaggaggacgaggaggaggaggccaccaaggaggacgccgaggcccccggcatcagagaccacgagagcctgtag

SEQ ID NO: 84364 - DNA, 771 bp, Artificial Sequence
  Description of Artificial Sequence: Synthetic coding sequence
atgcaccccgagggcggccagttcgtgccccagctgctgggccacctgctggccaccaagctgaagagattcctgctgagcaagggcggcagaagagcccagatccccgacgtgagcagagccaccccccacaccatcgacgagatgcccgaggccgccgtgaagagcaccgccaacaagtaccaggtgttcttcttcggcacccacgagaccgccttcctgggccccaaggacctgttcccctacgaggagagcaaggagaagttcggcaagcccaacaagagaaagggcttcagcgagggcctgtgggagatcgagaacaaccccaccgtgaaggccagcggctaccagagcagccagaagaagagctgcgtggaggagcccgagcccgagcccgaggccgccgagggcgacggcgacaagaagggcaacgccgagggcagcagcgacgaggagggcaagctggtgatcgacgagcccgccaaggagaagaacgagaagggcgccctgaagagaagagccggcgacctgctggaggacagccccaagagacccaaggaggccgagaaccccgagggcgaggagaaggaggccgccaccctggaggtggagagacccctgcccatggaggtggagaagaacagcacccccagcgagcccggcagcggcagaggccccccccaggaggaggaggaggaggaggacgaggaggaggaggccaccaaggaggacgccgaggcccccggcatcagagaccacgagagcctgtag

SEQ ID NO: 84365 - DNA, 702 bp, Artificial Sequence
  Description of Artificial Sequence: Synthetic coding sequence
atggagcagagagccggcggcaacagagtgcagaccagcaccctgaactgcgccggcgccgccgtgatcgacgagatgcccgaggccgccgtgaagagcaccgccaacaagtaccaggtgttcttcttcggcacccacgagaccgccttcctgggccccaaggacctgttcccctacgaggagagcaaggagaagttcggcaagcccaacaagagaaagggcttcagcgagggcctgtgggagatcgagaacaaccccaccgtgaaggccagcggctaccagagcagccagaagaagagctgcgtggaggagcccgagcccgagcccgaggccgccgagggcgacggcgacaagaagggcaacgccgagggcagcagcgacgaggagggcaagctggtgatcgacgagcccgccaaggagaagaacgagaagggcgccctgaagagaagagccggcgacctgctggaggacagccccaagagacccaaggaggccgagaaccccgagggcgaggagaaggaggccgccaccctggaggtggagagacccctgcccatggaggtggagaagaacagcacccccagcgagcccggcagcggcagaggccccccccaggaggaggaggaggaggaggacgaggaggaggaggccaccaaggaggacgccgaggcccccggcatcagagaccacgagagcctgtag

SEQ ID NO: 84366 - DNA, 789 bp, Artificial Sequence
  Description of Artificial Sequence: Synthetic coding sequence
atgagcagaagcaacagacagaaggagtacaagtgcggcgacctggtgttcgccaagatgaagggctacccccactggcccgccagaatcgacgagatgcccgaggccgccgtgaagagcaccgccaacaagtaccaggtgttcttcagcggccccaccagaagacacagctgggcccccaagaccagcagcctgaccagaaaccccagaagaagcctggccagccccaccagaggcaagggcagcgccagaggctgcggcagaagcagaaccaccctgctgagcagactgcccgccatcagccccccccccagctgcaccgagccctgcctgcccggccagtgggtgtaccccggcgccaaccccaccgagagcagccagaagaagagctgcgtggaggagcccgagcccgagcccgaggccgccgagggcgacggcgacaagaagggcaacgccgagggcagcagcgacgaggagggcaagctggtgatcgacgagcccgccaaggagaagaacgagaagggcgccctgaagagaagagccggcgacctgctggaggacagccccaagagacccaaggaggccgagaaccccgagggcgaggagaaggaggccgccaccctggaggtggagagacccctgcccatggaggtggagaagaacagcacccccagcgagcccggcagcggcagaggccccccccaggaggaggaggaggaggaggacgaggaggaggaggccaccaaggaggacgccgaggcccccggcatcagagaccacgagagatag

SEQ ID NO: 84367 - DNA, 627 bp, Artificial Sequence
  Description of Artificial Sequence: Synthetic coding sequence
atgcccgaggccgccgtgaagagcaccgccaacaagtaccaggtgttcttcttcggcacccacgagaccgccttcctgggccccaaggacctgttcccctacgaggagagcaaggagaagttcggcaagcccaacaagagaaagggcttcagcgagggcctgtgggagatcgagaacaaccccaccgtgaaggccagcggctaccagagcagccagaagaagagctgcgtggaggagcccgagcccgagcccgaggccgccgagggcgacggcgacaagaagggcaacgccgagggcagcagcgacgaggagggcaagctggtgatcgacgagcccgccaaggagaagaacgagaagggcgccctgaagagaagagccggcgacctgctggaggacagccccaagagacccaaggaggccgagaaccccgagggcgaggagaaggaggccgccaccctggaggtggagagacccctgcccatggaggtggagaagaacagcacccccagcgagcccggcagcggcagaggccccccccaggaggaggaggaggaggaggacgaggaggaggaggccaccaaggaggacgccgaggcccccggcatcagagaccacgagagcctgtag

SEQ ID NO: 84368 - DNA, 723 bp, Artificial Sequence; identical to SEQ ID NO: 84363
  Description of Artificial Sequence: Synthetic coding sequence

SEQ ID NO: 84369 - DNA, 2676 bp, Artificial Sequence
  Description of Artificial Sequence: Synthetic coding sequence
atgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcagcagctaccccggcctggtggccaagcccttcgagaaggtgacctacagatggaccgtgcccccccacgccggccccaccgcccaggaccccgcctgcctgacctggatgtacttcagcgccgccgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggccgtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84370 - DNA, 3477 bp, Artificial Sequence
  Description of Artificial Sequence: Synthetic coding sequence
atggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcagcagctaccccggcctggtggccaagcccttcgagaaggtgacctacagatggaccgtgcccccccacgccggccccaccgcccaggaccccgcctgcctgacctggatgtacttcagcgccgccgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggccgtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84371 - DNA, 3486 bp, Artificial Sequence
  Description of Artificial Sequence: Synthetic coding sequence
atgtgggccatggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcagcagctaccccggcctggtggccaagcccttcgagaaggtgacctacagatggaccgtgcccccccacgccggccccaccgcccaggaccccgcctgcctgacctggatgtacttcagcgccgccgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggccgtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84372 - DNA, 2910 bp, Artificial Sequence
  Description of Artificial Sequence: Synthetic coding sequence
atgtgggccatggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggccgtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84373 - DNA, 2436 bp, Artificial Sequence
  Description of Artificial Sequence: Synthetic coding sequence
atggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagccctag

SEQ ID NO: 84374 - DNA, 3483 bp, Artificial Sequence
  Description of Artificial Sequence: Synthetic coding sequence
atgtgggccatggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcagcagctaccccggcctggtggccaagcccttcgagaaggtgacctacagatggaccgtgcccccccacgccggccccaccgcccaggaccccgcctgcctgacctggatgtacttcagcgccgccgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84375 - DNA, 627 bp, Artificial Sequence
  Description of Artificial Sequence: Synthetic coding sequence
atggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagatag

SEQ ID NO: 84376 - DNA, 3639 bp, Artificial Sequence
  Description of Artificial Sequence: Synthetic coding sequence
atgacccagaccctgccctaccacctgagcctgctgaacgtgctgttccccggcccctgcagcagacacttcaagttcagaagaggcaagtgcgcccagcccgcctggagaaaggtgagcgcccccagccaggacctgctgatcaccaaggtgatgtgggccatggagagcggccacctgctgtgggccctgctgttcatgcagagcctgtggccccagctgaccgacggcgccaccagagtgtactacctgggcatcagagacgtgcagtggaactacgcccccaagggcagaaacgtgatcaccaaccagcccctggacagcgacatcgtggccagcagcttcctgaagagcgacaagaacagaatcggcggcacctacaagaagaccatctacaaggagtacaaggacgacagctacaccgacgaggtggcccagcccgcctggctgggcttcctgggccccgtgctgcaggccgaggtgggcgacgtgatcctgatccacctgaagaacttcgccaccagaccctacaccatccacccccacggcgtgttctacgagaaggacagcgagggcagcctgtaccccgacggcagcagcggccccctgaaggccgacgacagcgtgccccccggcggcagccacatctacaactggaccatccccgagggccacgcccccaccgacgccgaccccgcctgcctgacctggatctaccacagccacgtggacgcccccagagacatcgccaccggcctgatcggccccctgatcacctgcaagagaggcgccctggacggcaacagccccccccagagacaggacgtggaccacgacttcttcctgctgttcagcgtggtggacgagaacctgagctggcacctgaacgagaacatcgccacctactgcagcgaccccgccagcgtggacaaggaggacgagaccttccaggagagcaacagaatgcacgccatcaacggcttcgtgttcggcaacctgcccgagctgaacatgtgcgcccagaagagagtggcctggcacctgttcggcatgggcaacgagatcgacgtgcacaccgccttcttccacggccagatgctgaccaccagaggccaccacaccgacgtggccaacatcttccccgccaccttcgtgaccgccgagatggtgccctgggagcccggcacctggctgatcagctgccaggtgaacagccacttcagagacggcatgcaggccctgtacaaggtgaagagctgcagcatggccccccccgtggacctgctgaccggcaaggtgagacagtacttcatcgaggcccacgagatccagtgggactacggccccatgggccacgacggcagcaccggcaagaacctgagagagcccggcagcatcagcgacaagttcttccagaagagcagcagcagaatcggcggcacctactggaaggtgagatacgaggccttccaggacgagaccttccaggagaagatgcacctggaggaggacagacacctgggcatcctgggccccgtgatcagagccgaggtgggcgacaccatccaggtggtgttctacaacagagccagccagcccttcagcatgcagccccacggcgtgttctacgagaaggactacgagggcaccgtgtacaacgacggcagcagctaccccggcctggtggccaagcccttcgagaaggtgacctacagatggaccgtgcccccccacgccggccccaccgcccaggaccccgcctgcctgacctggatgtacttcagcgccgccgaccccatcagagacaccaacagcggcctggtgggccccctgctggtgtgcagagccggcgccctgggcgccgacggcaagcagaagggcgtggacaaggagttcttcctgctgttcaccgtgctggacgagaacaagagctggtacagcaacgccaaccaggccgccgccatgctggacttcagactgctgagcgaggacatcgagggcttccaggacagcaacagaatgcacgccatcaacggcttcctgttcagcaacctgcccagactggacatgtgcaagggcgacaccgtggcctggcacctgctgggcctgggcaccgagaccgacgtgcacggcgtgatgttccagggcaacaccgtgcagctgcagggcatgagaaagggcgccgccatgctgttcccccacaccttcgtgatggccatcatgcagcccgacaacctgggcaccttcgagatctactgccaggccggcagccacagagaggccggcatgagagccatctacaacgtgagccagtgccccggccaccaggccacccccagacagagataccaggccgccagaatctactacatcatggccgaggaggtggagtgggactactgccccgacagaagctgggagagagagtggcacaaccagagcgagaaggacagctacggctacatcttcctgagcaacaaggacggcctgctgggcagcagatacaagaaggccgtgttcagagagtacaccgacggcaccttcagaatccccagacccagaaccggccccgaggagcacctgggcatcctgggccccctgatcaagggcgaggtgggcgacatcctgaccgtggtgttcaagaacaacgccagcagaccctacagcgtgcacgcccacggcgtgctggagagcaccaccgtgtggcccctggccgccgagcccggcgaggtggtgacctaccagtggaacatccccgagagaagcggccccggccccaacgacagcgcctgcgtgagctggatctactacagcgccgtggaccccatcaaggacatgtacagcggcctggtgggccccctggccatctgccagaagggcatcctggagccccacggcggcagaagcgacatggacagagagttcgccctgctgttcctgatcttcgacgagaacaagagctggtacctggaggagaacgtggccacccacggcagccaggaccccggcagcatcaacctgcaggacgagaccttcctggagagcaacaagatgcacgccatcaacggcaagctgtacgccaacctgagaggcctgaccatgtaccagggcgagagagtggcctggtacatgctggccatgggccaggacgtggacctgcacaccatccacttccacgccgagagcttcctgtacagaaacggcgagaactacagagccgacgtggtggacctgttccccggcaccttcgaggtggtggagatggtggccagcaaccccggcacctggctgatgcactgccacgtgaccgaccacgtgcacgccggcatggagaccctgttcaccgtgttcagcagaaccgagcacctgagccccctgaccgtgatcaccaaggagaccgagaaggccgtgccccccagagacatcgaggagggcaacgtgaagatgctgggcatgcagatccccatcaagaacgtggagatgctggccagcgtgctggtggccatcagcgtgaccctgctgctggtggtgctggccctgggcggcgtggtgtggtaccagcacagacagagaaagctgagaagaaacagaagaagcatcctggacgacagcttcaagctgctgagcttcaagcagtag

SEQ ID NO: 84377 - DNA, 1254 bp, Artificial Sequence
  Description of Artificial Sequence: Synthetic coding sequence
atggcccagaaggagggcggcagaaccgtgccctgctgcagcagacccaaggtggccgccctgaccgccggcaccctgctgctgctgaccgccatcggcgccgccagctgggccatcgtggccgtgctgctgagaagcgaccaggagcccctgtaccccgtgcaggtgagcagcgccgacgccagactgatggtgttcgacaagaccgagggcacctggagactgctgtgcagcagcagaagcaacgccagagtggccggcctgagctgcgaggagatgggcttcctgagagccctgacccacagcgagctggacgtgagaaccgccggcgccaacggcaccagcggcttcttctgcgtggacgagggcagactgccccacacccagagactgctggaggtgatcagcgtgtgcgactgccccagaggcagattcctggccgccatctgccaggactgcggcagaagaaagctgcccgtggacagaatcgtgggcggcagagacaccagcctgggcagatggccctggcaggtgagcctgagatacgacggcgcccacctgtgcggcggcagcctgctgagcggcgactgggtgctgaccgccgcccactgcttccccgagagaaacagagtgctgagcagatggagagtgttcgccggcgccgtggcccaggccagcccccacggcctgcagctgggcgtgcaggccgtggtgtaccacggcggctacctgcccttcagagaccccaacagcgaggagaacagcaacgacatcgccctggtgcacctgagcagccccctgcccctgaccgagtacatccagcccgtgtgcctgcccgccgccggccaggccctggtggacggcaagatctgcaccgtgaccggctggggcaacacccagtactacggccagcaggccggcgtgctgcaggaggccagagtgcccatcatcagcaacgacgtgtgcaacggcgccgacttctacggcaaccagatcaagcccaagatgttctgcgccggctaccccgagggcggcatcgacgcctgccagggcgacagcggcggccccttcgtgtgcgaggacagcatcagcagaacccccagatggagactgtgcggcatcgtgagctggggcaccggctgcgccctggcccagaagcccggcgtgtacaccaaggtgagcgacttcagagagtggatcttccaggccatcaagacccacagcgaggccagcggcatggtgacccagctgtag

SEQ ID NO: 84378 - DNA, 1254 bp, Artificial Sequence; identical to SEQ ID NO: 84377
  Description of Artificial Sequence: Synthetic coding sequence

SEQ ID NO: 84379 - DNA, 1182 bp, Artificial Sequence
  Description of Artificial Sequence: Synthetic coding sequence
atgtgcaagatgagaaccagagaggacatgcagctgggcaacgagggccccggcaccgccctgagactgatccacctgcaggtgagcagcgccgacgccagactgatggtgttcgacaagaccgagggcacctggagactgctgtgcagcagcagaagcaacgccagagtggccggcctgagctgcgaggagatgggcttcctgagagccctgacccacagcgagctggacgtgagaaccgccggcgccaacggcaccagcggcttcttctgcgtggacgagggcagactgccccacacccagagactgctggaggtgatcagcgtgtgcgactgccccagaggcagattcctggccgccatctgccaggactgcggcagaagaaagctgcccgtggacagaatcgtgggcggcagagacaccagcctgggcagatggccctggcaggtgagcctgagatacgacggcgcccacctgtgcggcggcagcctgctgagcggcgactgggtgctgaccgccgcccactgcttccccgagagaaacagagtgctgagcagatggagagtgttcgccggcgccgtggcccaggccagcccccacggcctgcagctgggcgtgcaggccgtggtgtaccacggcggctacctgcccttcagagaccccaacagcgaggagaacagcaacgacatcgccctggtgcacctgagcagccccctgcccctgaccgagtacatccagcccgtgtgcctgcccgccgccggccaggccctggtggacggcaagatctgcaccgtgaccggctggggcaacacccagtactacggccagcaggccggcgtgctgcaggaggccagagtgcccatcatcagcaacgacgtgtgcaacggcgccgacttctacggcaaccagatcaagcccaagatgttctgcgccggctaccccgagggcggcatcgacgcctgccagggcgacagcggcggccccttcgtgtgcgaggacagcatcagcagaacccccagatggagactgtgcggcatcgtgagctggggcaccggctgcgccctggcccagaagcccggcgtgtacaccaaggtgagcgacttcagagagtggatcttccaggccatcaaggtgaaggtgggcagcagatgggagcccggctggggcagactgggcgtgtag

SEQ ID NO: 84380 - DNA, 2103 bp, Artificial Sequence
  Description of Artificial Sequence: Synthetic coding sequence
atgaagtgcgtgctggtggccaccgagggcgccgaggtgctgttctactggaccgaccaggagttcgaggagagcctgagactgaagttcggccagagcgagaacgaggaggaggagctgcccgccctggaggaccagctgagcaccctgctggcccccgtgatcatcagcagcatgaccatgctggagaagctgagcgacacctacacctgcttcagcaccgagaacggcaacttcctgtacgtgctgcacctgttcggcgagtgcctgttcatcgccatcaacggcgaccacaccgagagcgagggcgacctgagaagaaagctgtacgtgctgaagtacctgttcgaggtgcacttcggcctggtgaccgtggacggccacctgatcagaaaggagctgagaccccccgacctggcccagagagtgcagctgtgggagcacttccagagcctgctgtggacctacagcagactgagagagcaggagcagtgcttcgccgtggaggccctggagagactgatccacccccagctgtgcgagctgtgcatcgaggccctggagagacacgtgatccaggccgtgaacaccagccccgagagaggcggcgaggaggccctgcacgccttcctgctggtgcacagcaagctgctggccttctacagcagccacagcgccagcagcctgagacccgccgacctgctggccctgatcctgctggtgcaggacctgtaccccagcgagagcaccgccgaggacgacatccagcccagccccagaagagccagaagcagccagaacatccccgtgcagcaggcctggagcccccacagcaccggccccaccggcggcagcagcgccgagaccgagaccgacagcttcagcctgcccgaggagtacttcacccccgcccccagccccggcgaccagagcagcggcagcaccatctggctggagggcggcaccccccccatggacgccctgcagatcgccgaggacaccctgcagaccctggtgccccactgccccgtgcccagcggccccagaagaatcttcctggacgccaacgtgaaggagagctactgccccctggtgccccacaccatgtactgcctgcccctgtggcagggcatcaacctggtgctgctgaccagaagccccagcgcccccctggccctggtgctgagccagctgatggacggcttcagcatgctggagaagaagctgaaggagggccccgagcccggcgccagcctgagaagccagcccctggtgggcgacctgagacagagaatggacaagttcgtgaagaacagaggcgcccaggagatccagagcacctggctggagttcaaggccaaggccttcagcaagagcgagcccggcagcagctgggagctgctgcaggcctgcggcaagctgaagagacagctgtgcgccatctacagactgaacttcctgaccaccgcccccagcagaggcggcccccacctgccccagcacctgcaggaccaggtgcagagactgatgagagagaagctgaccgactggaaggacttcctgctggtgaagagcagaagaaacatcaccatggtgagctacctggaggacttccccggcctggtgcacttcatctacgtggacagaaccaccggccagatggtggcccccagcctgaactgcagccagaagaccagcagcgagctgggcaagggccccctggccgccttcgtgaagaccaaggtgtggagcctgatccagctggccagaagatacctgcagaagggctacaccaccctgctgttccaggagggcgacttctactgcagctacttcctgtggttcgagaacgacatgggctacaagctgcagatgatcgaggtgcccgtgctgagcgacgacagcgtgcccatcggcatgctgggcggcgactactacagaaagctgctgagatactacagcaagaacagacccaccgaggccgtgagatgctacgagctgctggccctgcacctgagcgtgatccccaccgacctgctggtgcagcaggccggccagctggccagaagactgtgggaggccagcagaatccccctgctgtag

SEQ ID NO: 84381 - DNA, 975 bp, Artificial Sequence
  Description of Artificial Sequence: Synthetic coding sequence
atgaagtgcgtgctggtggccaccgagggcgccgaggtgctgttctactggaccgaccaggagttcgaggagagcctgagactgaagttcggccagagcgagaacgaggaggaggagctgcccgccctggaggaccagctgagcaccctgctggcccccgtgatcatcagcagcatgaccatgctggagaagctgagcgacacctacacctgcttcagcaccgagaacggcaacttcctgtacgtgctgcacctgttcggcgagtgcctgttcatcgccatcaacggcgaccacaccgagagcgagggcgacctgagaagaaagctgtacgtgctgaagtacctgttcgaggtgcacttcggcctggtgaccgtggacggccacctgatcagaaaggagctgagaccccccgacctggcccagagagtgcagctgtgggagcacttccagagcctgctgtggacctacagcagactgagagagcaggagcagtgcttcgccgtggaggccctggagagactgatccacccccagctgtgcgagctgtgcatcgaggccctggagagacacgtgatccaggccgtgaacaccagccccgagagaggcggcgaggaggccctgcacgccttcctgctggtgcacagcaagctgctggccttctacagcagccacagcgccagcagcctgagacccgccgacctgctggccctgatcctgctggtgcaggacctgtaccccagcgagagcaccgccgaggacgacatccagcccagccccagaagagccagaagcagccagaacatccccgtgcagcaggcctggagcccccacagcaccggccccaccggcggcagcagcgccgagaccgagaccgacagcttcagcctgcccgaggagtacttcacccccgcccccagccccggcgaccagagcagcggcgaggacagaagaaaggccggcggcaacaacagctag

SEQ ID NO: 84382 - DNA, 981 bp, Artificial Sequence
  Description of Artificial Sequence: Synthetic coding sequence
agactgatccacccccagctgtgcgagctgtgcatcgaggccctggagagacacgtgatccaggccgtgaacaccagccccgagagaggcggcgaggaggccctgcacgccttcctgctggtgcacagcaagctgctggccttctacagcagccacagcgccagcagcctgagacccgccgacctgctggccctgatcctgctggtgcaggacctgtaccccagcgagagcaccgccgaggacgacatccaggagaccgacagcttcagcctgcccgaggagtacttcacccccgcccccagccccggcgaccagagcagcggcagcaccatctggctggagggcggcaccccccccatggacgccctgcagatcgccgaggacaccctgcagaccctggtgccccactgccccgtgcccagcggccccagaagaatcttcctggacgccaacgtgaaggagagctactgccccctggtgccccacaccatgtactgcctgcccctgtggcagggcatcaacctggtgctgctgaccagaagccccagcgcccccctggccctggtgctgagccagctgatggacggcttcagcatgctggagaagaagctgaaggagggccccgagcccggcgccagcctgagaagccagcccctggtgggcgacctgagacagagaatggacaagttcgtgaagaacagaggcgcccaggagatccagagcacctggctggagttcaaggccaaggccttcagcaagagcgagcccggcagcagctgggagctgctgcaggcctgcggcaagctgaagagacagctgtgcgccatctacagactgaacttcctgaccaccgcccccagcagaggcggcccccacctgccccagcacctgcaggaccaggtgcagagactgatgagagagaagctgaccgactggaaggacttcctgctggtgaagagcagaagaaacatcaccatgtag

SEQ ID NO: 84383 - DNA, 2103 bp, Artificial Sequence; identical to SEQ ID NO: 84380
  Description of Artificial Sequence: Synthetic coding sequence

SEQ ID NO: 84384 - DNA, 2004 bp, Artificial Sequence
  Description of Artificial Sequence: Synthetic coding sequence
atgaagtgcgtgctggtggccaccgagggcgccgaggtgctgttctactggaccgaccaggagttcgaggagagcctgagactgaagttcggccagagcgagaacgaggaggaggagctgcccgccctggaggaccagctgagcaccctgctggcccccgtgatcatcagcagcatgaccatgctggagaagctgagcgacacctacacctgcttcagcaccgagaacggcaacttcctgtacgtgctgcacctgttcggcgagtgcctgttcatcgccatcaacggcgaccacaccgagagcgagggcgacctgagaagaaagctgtacgtgctgaagtacctgttcgaggtgcacttcggcctggtgaccgtggacggccacctgatcagaaaggagctgagaccccccgacctggcccagagagtgcagctgtgggagcacttccagagcctgctgtggacctacagcagactgagagagcaggagcagtgcttcgccgtggaggccctggagagactgatccacccccagctgtgcgagctgtgcatcgaggccctggagagacacgtgatccaggccgtgaacaccagccccgagagaggcggcgaggaggccctgcacgccttcctgctggtgcacagcaagctgctggccttctacagcagccacagcgccagcagcctgagacccgccgacctgctggccctgatcctgctggtgcaggacctgtaccccagcgagagcaccgccgaggacgacatccaggagaccgacagcttcagcctgcccgaggagtacttcacccccgcccccagccccggcgaccagagcagcggcagcaccatctggctggagggcggcaccccccccatggacgccctgcagatcgccgaggacaccctgcagaccctggtgccccactgccccgtgcccagcggccccagaagaatcttcctggacgccaacgtgaaggagagctactgccccctggtgccccacaccatgtactgcctgcccctgtggcagggcatcaacctggtgctgctgaccagaagccccagcgcccccctggccctggtgctgagccagctgatggacggcttcagcatgctggagaagaagctgaaggagggccccgagcccggcgccagcctgagaagccagcccctggtgggcgacctgagacagagaatggacaagttcgtgaagaacagaggcgcccaggagatccagagcacctggctggagttcaaggccaaggccttcagcaagagcgagcccggcagcagctgggagctgctgcaggcctgcggcaagctgaagagacagctgtgcgccatctacagactgaacttcctgaccaccgcccccagcagaggcggcccccacctgccccagcacctgcaggaccaggtgcagagactgatgagagagaagctgaccgactggaaggacttcctgctggtgaagagcagaagaaacatcaccatggtgagctacctggaggacttccccggcctggtgcacttcatctacgtggacagaaccaccggccagatggtggcccccagcctgaactgcagccagaagaccagcagcgagctgggcaagggccccctggccgccttcgtgaagaccaaggtgtggagcctgatccagctggccagaagatacctgcagaagggctacaccaccctgctgttccaggagggcgacttctactgcagctacttcctgtggttcgagaacgacatgggctacaagctgcagatgatcgaggtgcccgtgctgagcgacgacagcgtgcccatcggcatgctgggcggcgactactacagaaagctgctgagatactacagcaagaacagacccaccgaggccgtgagatgctacgagctgctggccctgcacctgagcgtgatccccaccgacctgctggtgcagcaggccggccagctggccagaagactgtgggaggccagcagaatccccctgctgtag

SEQ ID NO: 84385 - DNA, 480 bp, Artificial Sequence
  Description of Artificial Sequence: Synthetic coding sequence
tgactgagaccccccgacctggcccagagagtgcagctgtgggagcacttccagagcctgctgtggacctacagcagactgagagagcaggagcagtgcttcgccgtggaggccctggagagactgatccacccccagctgtgcgagctgtgcatcgaggccctggagagacacgtgatccaggccgtgaacaccagccccgagagaggcggcgaggaggccctgcacgccttcctgctggtgcacagcaagctgctggccttctacagcagccacagcgccagcagcctgagacccgccgacctgctggccctgatcctgctggtgcaggacctgtaccccagcgagagcaccgccgaggacgacatccaggagaccgacagcttcagcctgcccgaggagtacttcacccccgcccccagccccggcgaccagagcagcggcgaggacagaagaaaggccggcggcaacaacagctag

SEQ ID NO: 84386 - DNA, 3015 bp, Artificial Sequence
  Description of Artificial Sequence: Synthetic coding sequence
atggtgcagctgtacaacctgcaccccttcggcagccagcaggtggtgccctgcaagctggagcccgacagattctgcggcggcggcagagacgccctgttcgtggccgccggctgcaaggtggaggccttcgccgtggccggccaggagctgtgccagcccagatgcgccttcagcaccctgggcagagtgctgagactggcctacagcgaggccggcgactacctggtggccatcgaggagaagaacaaggccaccttcctgagagcctacgtgaactggagaaacaagagaaccgagaacagcagagtgtgcatcagaatgatcggccacaacgtggagggccccttcagcaaggccttcagagaccagatgtacatcatcgagatgcccctgagcgaggcccccctgtgcatcagctgctgccccgtgaagggcgacctgctggtgggctgcaccaacaagctggtgctgttcagcctgaagtaccagatcatcaacgaggagttcagcctgctggacttcgagagaagcctgatcatccacatcgacaacatcacccccgtggaggtgagcttctgcgtgggctacgtggccgtgatgagcgacctggaggtgctgatcgtgaagctggagagcggccccaagaacggcgagagagtgcaccaccacccccacaagaccaacaacagaatcagaagaaccgaggagggcatcagcaacgagatcagccagctggagagcgacgacttcgtgatctgccagaagcccctggagctgctgggcgagaagagcgagcagagcggcctgagcgtgaccctggagagcaccggcctggccgacgagaagagaaagtacagccacttccagcacctgctgtacagaagattcgcccccgacatcagcagctacgtgctgagcgacgacatcaagctgcacagcctgcagctgctgcccatctaccagaccggcagcctgaccagcgacggcaagaacctgagccaggagaaggagctgctgagcctgttctgcttcttcagcctgccccacgtgggctacctgtacatggtggtgaagagcgtggagctgatgagcgtgtaccagtaccccgagaagagccagcaggccgtgctgaccccccagttcctgcacgtgatcaccagcaacaacctgcagtgcttcaccgtgagatgcagcgccgccgccgccagagaggaggacccctacatggacaccaccctgaaggcctgcccccccgtgagcatggacgtgtgcgccctgagaatccagctgttcatcggcctgaaggccatctgccacttcaagaaccacatcatcctgctgaccaaggccgagcccgaggccatccccgagagaagacagagccccaagagactgctgagcagaaaggacaccagcgtgaagatcaagatcccccccgtggccgaggccggctggaacctgtacatcgtgaacaccatcagccccgtgcagctgtacaaggagatggtggactacagcaacacctacaagaccgtgaagacccagagctgcatccacctgctgagcgaggcccacctgctggtgagagccgccctgatggacgccagccagctggagcccggcgagaaggccgagctgctggaggccttcaaggagagctgcggccacctgggcgactgctacagcagactggacagccagcacagccacctgaccctgccctactacaagatgagcggcctgagcatggccgaggtgctggccagaaccgactggaccgtggaggacggcctgcagaagtacgagagaggcctgatcttctacatcaaccacagcctgtacgagaacctggacgaggagctgaacgaggagctggccgccaaggtggtgcagatgttctacgtggccgagcccaagcaggtgccccacatcctgtgcagccccagcatgaagaacatcaaccccctgaccgccatgagctacctgagaaagctggacaccagcggcttcagcagcatcctggtgaccctgaccaaggccgccgtggccctgaagatgggcgacctggacatgcacagaaacgagatgaagagccacagcgagatgaagctggtgtgcggcttcatcctggagcccagactgctgatccagcagagaaagggccagatcgtgcccaccgagctggccctgcacctgaaggagacccagcccggcctgctggtggccagcgtgctgggcctgcagaagaacaacaagatcggcatcgaggaggccgacagcttcttcaaggtgctgtgcgccaaggacgaggacaccatcccccagctgctggtggacttctgggaggcccagctggtggcctgcctgcccgacgtggtgctgcaggagctgttcttcaagctgaccagccagtacatctggagactgagcaagagacagccccccgacaccacccccctgagaaccagcgaggacctgatcaacgcctgcagccactacggcctgatctacccctgggtgcacgtggtgatcagcagcgacagcctggccgacaagaactacaccgaggacctgagcaagctgcagagcctgatctgcggccccagcttcgacatcgccagcatcatccccttcctggagcccctgagcgaggacaccatcgccggcctgagcgtgcacgtgctgtgcagaaccagactgaaggagtacgagcagtgcatcgacatcctgctggagagatgccccgaggccgtgatcccctacgccaaccacgagctgaaggaggagaacagaaccctgtggtggaagaagctgctgcccgagctgtgccagagaatcaagtgcggcggcgagaagtaccagctgtacctgagcagcctgaaggagaccctgagcatcgtggccgtggagctggagctgaaggacttcatgaacgtgctgcccgaggacggcaccgccaccttcttcctgccctacctgctgtactgcagcagaaagaagcccctgacctag

SEQ ID NO: 84387 - DNA, 1587 bp, Artificial Sequence
  Description of Artificial Sequence: Synthetic coding sequence
atggccaccagcaccagcaccgaggccaagagcgccagctggtggaactacttcttcctgtacgacggcagcaaggtgaaggaggagggcgaccccaccagagccggcatctgctacttctaccccagccagaccctgctggaccagcaggagctgctgtgcggccagatcgccggcgtggtgagatgcgtgagcgacatcagcgacagcccccccaccctggtgagactgagaaagctgaagttcgccatcaaggtggacggcgactacctgtgggtgctgggctgcgccgtggagctgcccgacgtgagctgcaagagattcctggaccagctggtgggcttcttcaacttctacaacggccccgtgagcctggcctacgagaactgcagccaggaggagctgagcaccgagtgggacaccttcatcgagcagatcctgaagaacaccagcgacctgcacaagatcttcaacagcctgtggaacctggaccagaccaaggtggagcccctgctgctgctgaaggccgccagaatcctgcagacctgccagagaagcccccacatcctggccggctgcatcctgtacaagggcctgatcgtgagcacccagctgccccccagcctgaccgccaaggtgctgctgcacagaaccgccccccaggagcagagactgcccaccggcgaggacgccccccaggagcacggcaagtggatgctgtggagcttcaagaacagagtgacccaccagaaccccaacggcgccgccctgccccccaacgtgcagatcatccccgtgttcgtgaccaaggaggaggccatcagcctgcacgagttccccgtggagcagatgaccagaagcctggccagccccgccggcctgcaggacggcagcgcccagcaccaccccaagggcggcagcaccagcgccctgaaggagaacgccaccggccacgtggagagcatggcctggaccacccccgaccccaccagccccgacgaggcctgccccgacggcagaaaggagaacggctgcctgagcggccacgacctggagagcatcagacccgccggcctgcacaacagcgccagaggcgaggtgctgggcctgagcagcagcctgggcaaggagctggtgttcctgcaggaggagctggacctgagcgagatccacatccccgaggcccaggaggtggagatggccagcggccacttcgccttcctgcacgtgcccgtgcccgacggcagagccccctactgcaaggccagcctgagcgccagcagcagcctggagcccaccccccccgaggacaccgccatcagcagcctgagaccccccagcgcccccgagatgctgacccagcacggcgcccaggagcagctggaggaccaccccggccacagcagccaggcccccatccccagagccgaccccctgcccaagagcaccgtgctgttcagcggcggctgcgtgaagggcagcgacacccagctgtgcgtgcccggcctggtgtggtacctggagccccagttctactacgtgatcgtgagacacttcttcgacagcatgagacagaccgccggctag

SEQ ID NO: 84388 - DNA, 2127 bp, Artificial Sequence
  Description of Artificial Sequence: Synthetic coding sequence
atggccaccagcaccagcaccgaggccaagagcgccagctggtggaactacttcttcctgtacgacggcagcaaggtgaaggaggagggcgaccccaccagagccggcatctgctacttctaccccagccagaccctgctggaccagcaggagctgctgtgcggccagatcgccggcgtggtgagatgcgtgagcgacatcagcgacagcccccccaccctggtgagactgagaaagctgaagttcgccatcaaggtggacggcgactacctgtgggtgctgggctgcgccgtggagctgcccgacgtgagctgcaagagattcctggaccagctggtgggcttcttcaacttctacaacggccccgtgagcctggcctacgagaactgcagccaggaggagctgagcaccgagtgggacaccttcatcgagcagatcctgaagaacaccagcgacctgcacaagatcttcaacagcctgtggaacctggaccagaccaaggtggagcccctgctgctgctgaaggccgccagaatcctgcagacctgccagagaagcccccacatcctggccggctgcatcctgtacaagggcctgatcgtgagcacccagctgccccccagcctgaccgccaaggtgctgctgcacagaaccgccccccaggagcagagactgcccaccggcgaggacgccccccaggagcacggcgccgccctgccccccaacgtgcagatcatccccgtgttcgtgaccaaggaggaggccatcagcctgcacgagttccccgtggagcagatgaccagaagcctggccagccccgccggcctgcaggacggcagcgcccagcaccaccccaagggcggcagcaccagcgccctgaaggagaacgccaccggccacgtggagagcatggcctggaccacccccgaccccaccagccccgacgaggcctgccccgacggcagaaaggagaacggctgcctgagcggccacgacctggagagcatcagacccgccggcctgcacaacagcgccagaggcgaggtgctgggcctgagcagcagcctgggcaaggagctggtgttcctgcaggaggagctggacctgagcgagatccacatccccgaggcccaggaggtggagatggccagcggccacttcgccttcctgcacgtgcccgtgcccgacggcagagccccctactgcaaggccagcctgagcgccagcagcagcctggagcccaccccccccgaggacaccgccatcagcagcctgagaccccccagcgcccccgagatgctgacccagcacggcgcccaggagcagctggaggaccaccccggccacagcagccaggcccccatccccagagccgaccccctgcccagaagaaccagaagacccctgctgctgcccagactggaccccggccagagaggcaacaagctgcccaccggcgagcagggcctggacgaggacgtggacggcgtgtgcgagagccacgccgcccccggcctggagtgcagcagcggcagcgccaactgccagggcgccggccccagcgccgacggcatcagcagcagactgacccccgccgagagctgcatgggcctggtgagaatgaacctgtacacccactgcgtgaagggcctggtgctgagcctgctggccgaggagcccctgctgggcgacagcgccgccatcgaggaggtgtaccacagcagcctggccagcctgaacggcctggaggtgcacctgaaggagaccctgcccagagacgaggccgccagcaccagcagcacctacaacttcacccactacgacagaatccagagcctgctgatggccaacctgccccaggtggccaccccccaggacagaagattcctgcaggccgtgagcctgatgcacagcgagttcgcccagctgcccgccctgtacgagatgaccgtgagaaacgccagcaccgccgtgtacgcctgctgcaaccccatccaggagacctacttccagcagctggcccccgccgccagaagcagcggcttccccaacccccaggacggcgccttcagcctgagcggcaaggccaagcagaagctgctgaagcacggcgtgaacctgctgtag

SEQ ID NO: 84389 - DNA, 2166 bp, Artificial Sequence
  Description of Artificial Sequence: Synthetic coding sequence
atggcccccctgtgcagcctggccagatggaactacttcttcctgtacgacggcagcaaggtgaaggaggagggcgaccccaccagagccggcatctgctacttctaccccagccagaccctgctggaccagcaggagctgctgtgcggccagatcgccggcgtggtgagatgcgtgagcgacatcagcgacagcccccccaccctggtgagactgagaaagctgaagttcgccatcaaggtggacggcgactacctgtgggtgctgggctgcgccgtggagctgcccgacgtgagctgcaagagattcctggaccagctggtgggcttcttcaacttctacaacggccccgtgagcctggcctacgagaactgcagccaggaggagctgagcaccgagtgggacaccttcatcgagcagatcctgaagaacaccagcgacctgcacaagatcttcaacagcctgtggaacctggaccagaccaaggtggagcccctgctgctgctgaaggccgccagaatcctgcagacctgccagagaagcccccacatcctggccggctgcatcctgtacaagggcctgatcgtgagcacccagctgccccccagcctgaccgccaaggtgctgctgcacagaaccgccccccaggagcagagactgcccaccggcgaggacgccccccaggagcacggcaagtggatgctgtggagcttcaagaacagagtgacccaccagaaccccaacggcgccgccctgccccccaacgtgcagatcatccccgtgttcgtgaccaaggaggaggccatcagcctgcacgagttccccgtggagcagatgaccagaagcctggccagccccgccggcctgcaggacggcagcgcccagcaccaccccaagggcggcagcaccagcgccctgaaggagaacgccaccggccacgtggagagcatggcctggaccacccccgaccccaccagccccgacgaggcctgccccgacggcagaaaggagaacggctgcctgagcggccacgacctggagagcatcagacccgccggcctgcacaacagcgccagaggcgaggtgctgggcctgagcagcagcctgggcaaggagctggtgttcctgcaggaggagctggacctgagcgagatccacatccccgaggcccaggaggtggagatggccagcggccacttcgccttcctgcacgtgcccgtgcccgacggcagagccccctactgcaaggccagcctgagcgccagcagcagcctggagcccaccccccccgaggacaccgccatcagcagcctgagaccccccagcgcccccgagatgctgacccagcacggcgcccaggagcagctggaggaccaccccggccacagcagccaggcccccatccccagagccgaccccctgcccagaagaaccagaagacccctgctgctgcccagactggaccccggccagagaggcaacaagctgcccaccggcgagcagggcctggacgaggacgtggacggcgtgtgcgagagccacgccgcccccggcctggagtgcagcagcggcagcgccaactgccagggcgccggccccagcgccgacggcatcagcagcagactgacccccgccgagagctgcatgggcctggtgagaatgaacctgtacacccactgcgtgaagggcctggtgctgagcctgctggccgaggagcccctgctgggcgacagcgccgccatcgaggaggtgtaccacagcagcctggccagcctgaacggcctggaggtgcacctgaaggagaccctgcccagagacgaggccgccagcaccagcagcacctacaacttcacccactacgacagaatccagagcctgctgatggccaacctgccccaggtggccaccccccaggacagaagattcctgcaggccgtgagcctgatgcacagcgagttcgcccagctgcccgccctgtacgagatgaccgtgagaaacgccagcaccgccgtgtacgcctgctgcaaccccatccaggagacctacttccagcagctggcccccgccgccagaagcagcggcttccccaacccccaggacggcgccttcagcctgagcggcaaggccaagcagaagctgctgaagcacggcgtgaacctgctgtag

SEQ ID NO: 84390 - DNA, 2127 bp, Artificial Sequence; identical to SEQ ID NO: 84388
  Description of Artificial Sequence: Synthetic coding sequence

SEQ ID NO: 84391 - DNA, 2112 bp, Artificial Sequence
  Description of Artificial Sequence: Synthetic coding sequence
atggcccccctgtgcagcctggccagatggaactacttcttcctgtacgacggcagcaaggtgaaggaggagggcgaccccaccagagccggcatctgctacttctaccccagccagaccctgctggaccagcaggagctgctgtgcggccagatcgccggcgtggtgagatgcgtgagcgacatcagcgacagcccccccaccctggtgagactgagaaagctgaagttcgccatcaaggtggacggcgactacctgtgggtgctgggctgcgccgtggagctgcccgacgtgagctgcaagagattcctggaccagctggtgggcttcttcaacttctacaacggccccgtgagcctggcctacgagaactgcagccaggaggagctgagcaccgagtgggacaccttcatcgagcagatcctgaagaacaccagcgacctgcacaagatcttcaacagcctgtggaacctggaccagaccaaggtggagcccctgctgctgctgaaggccgccagaatcctgcagacctgccagagaagcccccacatcctggccggctgcatcctgtacaagggcctgatcgtgagcacccagctgccccccagcctgaccgccaaggtgctgctgcacagaaccgccccccaggagcagagactgcccaccggcgaggacgccccccaggagcacggcgccgccctgccccccaacgtgcagatcatccccgtgttcgtgaccaaggaggaggccatcagcctgcacgagttccccgtggagcagatgaccagaagcctggccagccccgccggcctgcaggacggcagcgcccagcaccaccccaagggcggcagcaccagcgccctgaaggagaacgccaccggccacgtggagagcatggcctggaccacccccgaccccaccagccccgacgaggcctgccccgacggcagaaaggagaacggctgcctgagcggccacgacctggagagcatcagacccgccggcctgcacaacagcgccagaggcgaggtgctgggcctgagcagcagcctgggcaaggagctggtgttcctgcaggaggagctggacctgagcgagatccacatccccgaggcccaggaggtggagatggccagcggccacttcgccttcctgcacgtgcccgtgcccgacggcagagccccctactgcaaggccagcctgagcgccagcagcagcctggagcccaccccccccgaggacaccgccatcagcagcctgagaccccccagcgcccccgagatgctgacccagcacggcgcccaggagcagctggaggaccaccccggccacagcagccaggcccccatccccagagccgaccccctgcccagaagaaccagaagacccctgctgctgcccagactggaccccggccagagaggcaacaagctgcccaccggcgagcagggcctggacgaggacgtggacggcgtgtgcgagagccacgccgcccccggcctggagtgcagcagcggcagcgccaactgccagggcgccggccccagcgccgacggcatcagcagcagactgacccccgccgagagctgcatgggcctggtgagaatgaacctgtacacccactgcgtgaagggcctggtgctgagcctgctggccgaggagcccctgctgggcgacagcgccgccatcgaggaggtgtaccacagcagcctggccagcctgaacggcctggaggtgcacctgaaggagaccctgcccagagacgaggccgccagcaccagcagcacctacaacttcacccactacgacagaatccagagcctgctgatggccaacctgccccaggtggccaccccccaggacagaagattcctgcaggccgtgagcctgatgcacagcgagttcgcccagctgcccgccctgtacgagatgaccgtgagaaacgccagcaccgccgtgtacgcctgctgcaaccccatccaggagacctacttccagcagctggcccccgccgccagaagcagcggcttccccaacccccaggacggcgccttcagcctgagcggcaaggccaagcagaagctgctgaagcacggcgtgaacctgctgtag

SEQ ID NO: 84392 - DNA, 3390 bp, Artificial Sequence
  Description of Artificial Sequence: Synthetic coding sequence
atggccttcgtgcccgtgatccccgagagctacagccacgtgctggccgagttcgagagcctggaccccctgctgagcgccctgagactggacagcagcagactgaagtgcaccagcatcgccgtgagcagaaagtggctggccctgggcagcagcggcggcggcctgcacctgatccagaaggagggctggaagcacagactgttcctgagccacagagagggcgccatcagccaggtggcctgctgcctgcacgacgacgactacgtggccgtggccaccagccagggcctggtggtggtgtgggagctgaaccaggagagaagaggcaagcccgagcagatgtacgtgagcagcgagcacaagggcagaagagtgaccgccctgtgctgggacaccgccatcctgagagtgttcgtgggcgaccacgccggcaaggtgagcgccatcaagctgaacaccagcaagcaggccaaggccgccgccgccttcgtgatgttccccgtgcagaccatcaccaccgtggacagctgcgtggtgcagctggactacctggacggcagactgctgatcagcagcctgaccagaagcttcctgtgcgacaccgagagagagaagttctggaagatcggcaacaaggagagagacggcgagtacggcgcctgcttcttccccggcagatgcagcggcggccagcagcccctgatctactgcgccagacccggcagcagaatgtgggaggtgaacttcgacggcgaggtgatcagcacccaccagttcaagaagctgctgagcctgccccccctgcccgtgatcaccctgagaagcgagccccagtacgaccacaccgccggcagcagccagagcctgagcttccccaagctgctgcacctgagcgagcactgcgtgctgacctggaccgagagaggcatctacatcttcatcccccagaacgtgcaggtgctgctgtggagcgaggtgaaggacatccaggacgtggccgtgtgcagaaacgagctgttctgcctgcacctgaacggcaaggtgagccacctgagcctgatcagcgtggagagatgcgtggagagactgctgagaagaggcctgtggaacctggccgccagaacctgctgcctgttccagaacagcgtgatcgccagcagagccagaaagaccctgaccgccgacaagctggagcacctgaagagccagctggaccacggcacctacaacgacctgatcagccagctggaggagctgatcctgaagttcgagcccctggacagcgcctgcagcagcagaagaagcagcatcagcagccacgagagcttcagcatcctggacagcggcatctacagaatcatcagcagcagaagaggcagccagagcgacgaggacagctgcagcctgcacagccagaccctgagcgaggacgagagattcaaggagttcaccagccagcaggaggaggacctgcccgaccagtgctgcggcagccacggcaacgaggacaacgtgagccacgcccccgtgatgttcgagaccgacaagaacgagaccttcctgcccttcggcatccccctgcccttcagaagccccagccccctggtgagcctgcaggccgtgaaggagagcgtgagcagcttcgtgagaaagaccaccgagaagatcggcaccctgcacaccagccccgacctgaaggtgagacccgagctgagaggcgacgagcagagctgcgaggaggacgtgagcagcgacacctgccccaaggaggaggacaccgaggaggagaaggaggtgaccagccccccccccgaggaggacagattccaggagctgaaggtggccaccgccgaggccatgaccaagctgcaggaccccctggtgctgttcgagagcgagagcctgagaatggtgctgcaggagtggctgagccacctggagaagaccttcgccatgaaggacttcagcggcgtgagcgacaccgacaacagcagcatgaagctgaaccaggacgtgctgctggtgaacgagagcaagaagggcatcctggacgaggacaacgagaaggagaagagagacagcctgggcaacgaggagagcgtggacaagaccgcctgcgagtgcgtgagaagccccagagagagcctggacgacctgttccagatctgcagcccctgcgccatcgccagcggcctgagaaacgacctggccgagctgaccaccctgtgcctggagctgaacgtgctgaacagcaagatcaagagcaccagcggccacgtggaccacaccctgcagcagtacagccccgagatcctggcctgccagttcctgaagaagtacttcttcctgctgaacctgaagagagccaaggagagcatcaagctgagctacagcaacagccccagcgtgtgggacaccttcatcgagggcctgaaggagatggccagcagcaaccccgtgtacatggagatggagaagggcgacctgcccaccagactgaagctgctggacgacgaggtgcccttcgacagccccctgctggtggtgtacgccaccagactgtacgagaagttcggcgagagcgccctgagaagcctgatcaagttcttccccagcatcctgcccagcgacatcatccagctgtgccaccaccaccccgccgagttcctggcctacctggacagcctggtgaagagcagacccgaggaccagagaagcagcttcctggagagcctgctgcagcccgagagcctgagactggactggctgctgctggccgtgagcctggacgccccccccagcaccagcaccatggacgacgagggctaccccagaccccacagccacctgctgagctggggctacagccagctgatcctgcacctgatcaagctgcccgccgacttcatcaccaaggagaagatgaccgacatctgcagaagctgcggcttctggcccggctacctgatcctgtgcctggagctggagagaagaagagaggccttcaccaacatcgtgtacctgaacgacatgagcctgatggagggcgacaacggctggatccccgagaccgtggaggagtggaagctgctgctgcacctgatccagagcaagagcaccagacccgccccccaggagagcctgaacggcagcctgagcgacggccccagccccatcaacgtggagaacgtggccctgctgctggccaaggccatgggccccgacagagcctggagcctgctgcaggagtgcggcctggccctggagctgagcgagaagttcaccagaacctgcgacatcctgagaatcgccgagaagagacagagagccctgatccagagcatgctggagaagtgcgacagattcctgtggagccagcaggcctag

SEQ ID NO: 84393 - DNA, 3048 bp, Artificial Sequence
  Description of Artificial Sequence: Synthetic coding sequence
atgtacgtgagcagcgagcacaagggcagaagagtgaccgccctgtgctgggacaccgccatcctgagagtgttcgtgggcgaccacgccggcaaggtgagcgccatcaagctgaacaccagcaagcaggccaaggccgccgccgccttcgtgatgttccccgtgcagaccatcaccaccgtggacagctgcgtggtgcagctggactacctggacggcagactgctgatcagcagcctgaccagaagcttcctgtgcgacaccgagagagagaagttctggaagatcggcaacaaggagagagacggcgagtacggcgcctgcttcttccccggcagatgcagcggcggccagcagcccctgatctactgcgccagacccggcagcagaatgtgggaggtgaacttcgacggcgaggtgatcagcacccaccagttcaagaagctgctgagcctgccccccctgcccgtgatcaccctgagaagcgagccccagtacgaccacaccgccggcagcagccagagcctgagcttccccaagctgctgcacctgagcgagcactgcgtgctgacctggaccgagagaggcatctacatcttcatcccccagaacgtgcaggtgctgctgtggagcgaggtgaaggacatccaggacgtggccgtgtgcagaaacgagctgttctgcctgcacctgaacggcaaggtgagccacctgagcctgatcagcgtggagagatgcgtggagagactgctgagaagaggcctgtggaacctggccgccagaacctgctgcctgttccagaacagcgtgatcgccagcagagccagaaagaccctgaccgccgacaagctggagcacctgaagagccagctggaccacggcacctacaacgacctgatcagccagctggaggagctgatcctgaagttcgagcccctggacagcgcctgcagcagcagaagaagcagcatcagcagccacgagagcttcagcatcctggacagcggcatctacagaatcatcagcagcagaagaggcagccagagcgacgaggacagctgcagcctgcacagccagaccctgagcgaggacgagagattcaaggagttcaccagccagcaggaggaggacctgcccgaccagtgctgcggcagccacggcaacgaggacaacgtgagccacgcccccgtgatgttcgagaccgacaagaacgagaccttcctgcccttcggcatccccctgcccttcagaagccccagccccctggtgagcctgcaggccgtgaaggagagcgtgagcagcttcgtgagaaagaccaccgagaagatcggcaccctgcacaccagccccgacctgaaggtgagacccgagctgagaggcgacgagcagagctgcgaggaggacgtgagcagcgacacctgccccaaggaggaggacaccgaggaggagaaggaggtgaccagccccccccccgaggaggacagattccaggagctgaaggtggccaccgccgaggccatgaccaagctgcaggaccccctggtgctgttcgagagcgagagcctgagaatggtgctgcaggagtggctgagccacctggagaagaccttcgccatgaaggacttcagcggcgtgagcgacaccgacaacagcagcatgaagctgaaccaggacgtgctgctggtgaacgagagcaagaagggcatcctggacgaggacaacgagaaggagaagagagacagcctgggcaacgaggagagcgtggacaagaccgcctgcgagtgcgtgagaagccccagagagagcctggacgacctgttccagatctgcagcccctgcgccatcgccagcggcctgagaaacgacctggccgagctgaccaccctgtgcctggagctgaacgtgctgaacagcaagatcaagagcaccagcggccacgtggaccacaccctgcagcagtacagccccgagatcctggcctgccagttcctgaagaagtacttcttcctgctgaacctgaagagagccaaggagagcatcaagctgagctacagcaacagccccagcgtgtgggacaccttcatcgagggcctgaaggagatggccagcagcaaccccgtgtacatggagatggagaagggcgacctgcccaccagactgaagctgctggacgacgaggtgcccttcgacagccccctgctggtggtgtacgccaccagactgtacgagaagttcggcgagagcgccctgagaagcctgatcaagttcttccccagcatcctgcccagcgacatcatccagctgtgccaccaccaccccgccgagttcctggcctacctggacagcctggtgaagagcagacccgaggaccagagaagcagcttcctggagagcctgctgcagcccgagagcctgagactggactggctgctgctggccgtgagcctggacgccccccccagcaccagcaccatggacgacgagggctaccccagaccccacagccacctgctgagctggggctacagccagctgatcctgcacctgatcaagctgcccgccgacttcatcaccaaggagaagatgaccgacatctgcagaagctgcggcttctggcccggctacctgatcctgtgcctggagctggagagaagaagagaggccttcaccaacatcgtgtacctgaacgacatgagcctgatggagggcgacaacggctggatccccgagaccgtggaggagtggaagctgctgctgcacctgatccagagcaagagcaccagacccgccccccaggagagcctgaacggcagcctgagcgacggccccagccccatcaacgtggagaacgtggccctgctgctggccaaggccatgggccccgacagagcctggagcctgctgcaggagtgcggcctggccctggagctgagcgagaagttcaccagaacctgcgacatcctgagaatcgccgagaagagacagagagccctgatccagagcatgctggagaagtgcgacagattcctgtggagccagcaggcctag

SEQ ID NO: 84394 - DNA, 3048 bp, Artificial Sequence; identical to SEQ ID NO: 84393
  Description of Artificial Sequence: Synthetic coding sequence

SEQ ID NO: 84395 - DNA, 2328 bp, Artificial Sequence
  Description of Artificial Sequence: Synthetic coding sequence
atgaagagaagcggcaccctgagactgctgagcgacctgagcgccttcggcggcgccgccagactgagagagctggtggccggcgacagcgccgtgagagtgagaggcagccccgacggcagacacctgctgctgctgagaccccccggcgccgtggccccccagctgctggtggccagcagaggccccggcgccgagctggagagagcctggcccgccggccagcccagccccctggacgccttcttcctgccctggcccgccagacccgccctggtgctggtgtgggagagcggcctggccgaggtgtggggcgccggcgtgggccccggctggagacccctgcagagcaccgagctgtgccccggcggcggcgccagagtggtggccgtggccgccctgagaggcagactggtgtggtgcgaggagagacaggccagagccgagggccccagcggcagccccgccgccgccttcagccactgcgtgtgcgtgagaaccctggagcccagcggcgaggccagcaccagcctgggcagaacccacgtgctgctgcaccactgccccgccttcggcctgctggccagctgcagacagctgttcctggtgcccaccgccaccacctggcccggcgtggcccacgtgctgctgatctggagccccggcaagggcaaggtgatggtggccgcccccagactgggcctgagctacagcaagagcctgaaccccggcagaggcgacacctgggacttcagaaccctgctgagaggcctgcccggcctgctgagccccagagagcccctggccgtgcacacctgggcccccaccccccagggcctgctgctgctggacttcggcggcaccgtgagcctgctgcagagccacggcggcaccagagccgtgggcaccctgcaggaggcccccgtgggcccctggggcagcgccgccctgggcaccttccagggcaccctggcctgcgtgctgggcagcaccctggagctgctggacatgggcagcggccagctgctggagagaaaggtgctgagcaccgacagagtgcacctgctggagccccccgcccccggcatggaggacgaggaggagctggagaccagaggcaacctgagactgctgagcgccctgggcctgttctgcgtgggctgggaggccccccagggcgtggagctgcccagcgccaaggacctggtgttcgaggaggcctgcggctactaccagagaagaagcctgagaggcgcccagctgacccccgaggagctgagacacagcagcaccttcagagccccccaggccctggccagcatcctgcagggccacctgccccccagcgccctgctgaccatgctgagaaccgagctgagagactacagaggcctggagcagctgaaggcccagctggtggccggcgacgacgaggaggccggctggaccgagctggccgagcaggaggtggccagactgctgagaaccgagctgatcggcgaccagctggcccagctgaacaccgtgttccaggccctgcccaccgccgcctggggcgccaccctgagagccctgcagctgcagctggacggcaacggcaagctgagaagccaggccccccccgacgtgtggaagaaggtgctgggcggcatcaccgccggcaaggagccccccaacggcatcctgccccccttcgagctgctgtgccagtgcctgtgccagctggagcccagatggctgccccccttcgtggagctggcccagcagcagggcggccccggctggggcgccggcggccccggcctgcccctgtacagaagagccctggccgtgctgggcgaggagggcaccagacccgaggccctggagctggagctgctgctgagcagcggcagacccaaggccgtgctgcaggccgtgggccagctggtgcagaaggagcagtgggacagagccctggacgccggcctggccctgggccccagcagccccctgctgagaagcgagatcttcaagctgctgctggccgagttcgcccagcacagaagactggacgcccacctgcccctgctgtgcagactgtgcccccccgagctggcccccgccgagctgctgctgctgctgagaacctacctgcccgacgaggtgggcccccccacccccttccccgagcccggcgccgagccccccctgaccgtgggcctgctgaaggccctgctggagcagaccggcgcccagggctggctgagcggccccgtgctgagcccctacgaggacatcctgtgggaccccagcacccccccccccaccccccccagagacctgtag

SEQ ID NO: 84396 - DNA, 1596 bp, Artificial Sequence
  Description of Artificial Sequence: Synthetic coding sequence
atgctgggcttcctgagcagaggccccagcatgaagctgtgcatgggcctggcctgcgtgctgagcctgtggaacaccgtgagcggcatcaagggcgaggccaagaaggagaagggcatgaccttcctgcccaccaccgtgagcggcctgagagaggaggagagaaaggagaagggcgtggccttcctggccaccaccgagctgcccgccagaagcatcgacctgagcgccctgaacctgaccgagctggtgaacggcatgctgagcagagccctgaaggacagcaagaagttcttcagcctgctgagcgtgaccagctacagcagcttcgccttccacaagttcagcgtggccgtgtacaacatcagcaacctgaagaccgtggaccccgccaagttccccaccagatactgctactgcctgaacaacagaaccaacgacctgagcgacttcaccgccctgctggtggacatcatcggcaacagcaccagctacctgaccgagatcttcaagagcaccagcatcctgagcgtgaaccagagcaacgagagcgactgcatcttcatctgcgtgatgaccggcaagagcggcagaaacctgagcgacttctgggagatcgaggagaagtaccccatcatcaactacaccttcaccagcggcctgagcggcgtgctgggcgccgccaccagaggcaccgccagaaccagcaagcccaccaccaagagccagaagaccctgcccagcaccagccccggccactggacccagagcaccccctgggccagcgccctgagaagcagcccctggaccgagaccgccgcccccagcgagaccgaggagaccctgaacaccggcagaccccccgagctgcccgccagagccaccgccacctggttcagcgccagccacaccctgcccgccctggccaccagaagagtggccagaacccagtggctgaccgccgacagacagacctgggccagcatcagcagcgtgccctgggcccagaccatcagcgagaagaagcccggcggcagcctgtgggagaccagaagcagcccccccaccaccgccggcaccgaggaggccatgaacaccaccagcctgctggcccccgccgccgagatcatggccacccccggcagccccagccaggccagccccaccctgggcgccttcacccacggcacccagacccccagccccaccaaggccaccgcccccagatacccccagaccggcgacctgagcgccgagtggcccttcaccgccggcgaggagcccgtgctggtgcccagaccccaccaggtgagcagatgcccccagcccctgttcaaggtgggcgccatggccgccgcccccctgaccctggccatccagagactgaacccctgcctgatggagctgtgccagttcttccagcagtgcctgtgcatgagccagagaagccccagaaccgaggacatgagatactgcctggagtactacagctggttcctgaagaacgccacctacatctgccagagagtgaagagagtgagccacagccacaccctgaagcagaagtgcctggagaacatctgcaagagcgtgtag

SEQ ID NO: 84397 - DNA, 558 bp, Artificial Sequence
  Description of Artificial Sequence: Synthetic coding sequence
atgagccccagcctgcaggagggcgcccagctgggcgagaacaagcccagcacctgcagcttcagcatcgagagaatcctgggcctggaccagaagaaggactgcgtgcccctgatgaagccccacagaccctgggccgacacctgcagcagcagcggcaaggacggcaacctgtgcctgcacgtgcccaacccccccagcggcatcagcttccccagcgtggtggaccaccccatgcccgaggagagagccagcaagtacgagaactacttcagcgccagcgagagactgagcctgaagagagagctgagctggtacagaggcagaagacccagaaccgccttcacccagaaccagatcgaggtgctggagaacgtgttcagagtgaactgctaccccggcatcgacatcagagaggacctggcccagaagctgaacctggaggaggacagaatccagatctggttccagaacagaagagccaagctgaagagaagccacagagagagccagttcctgatggccaagaagaacttcaacaccaacctgctggagtag

SEQ ID NO: 84398 - DNA, 324 bp, Artificial Sequence
  Description of Artificial Sequence: Synthetic coding sequence
atgagccccagcctgcaggagggcgcccagctgggcgagaacaagcccagcacctgcagcttcagcatcgagagaatcctgggcctggaccagaagaaggactgcgtgcccctgatgaagccccacagaccctgggccgacacctgcagcagcagcggcaaggacggcaacctgtgcctgcacgtgcccaacccccccagcggcatcagcttccccagcgtggtggaccaccccatgcccgaggagagagccagcaagtacgagaactacttcagcgccagcgagagactgagcctgaagagagagctgagctggtacagatag

SEQ ID NO: 84399 - DNA, 1263 bp, Artificial Sequence
  Description of Artificial Sequence: Synthetic coding sequence
atggaggtgccccccagactgagccacgtgcccccccccctgttccccagcgcccccgccaccctggccagcagaagcctgagccactggagacccagaccccccagacagctggcccccctgctgcccagcctggcccccagcagcgccagacagggcgccagaagagcccagagacacgtgaccgcccagcagcccagcagactggccggcggcgccgccatcaagggcggcagaagaagaagacccgacctgttcagaagacacttcaagagcagcagcatccagagaagcgccgccgccgccgccgccaccagaaccgccagacagcacccccccgccgacagcagcgtgaccatggaggacatgaacgagtacagcaacatcgaggagttcgccgagggcagcaagatcaacgccagcaagaaccagcaggacgacggcaagatgttcatcggcggcctgagctgggacaccagcaagaaggacctgaccgagtacctgagcagattcggcgaggtggtggactgcaccatcaagaccgaccccgtgaccggcagaagcagaggcttcggcttcgtgctgttcaaggacgccgccagcgtggacaaggtgctggagctgaaggagcacaagctggacggcaagctgatcgaccccaagagagccaaggccctgaagggcaaggagccccccaagaaggtgttcgtgggcggcctgagccccgacaccagcgaggagcagatcaaggagtacttcggcgccttcggcgagatcgagaacatcgagctgcccatggacaccaagaccaacgagagaagaggcttctgcttcatcacctacaccgacgaggagcccgtgaagaagctgctggagagcagataccaccagatcggcagcggcaagtgcgagatcaaggtggcccagcccaaggaggtgtacagacagcagcagcagcagcagaagggcggcagaggcgccgccgccggcggcagaggcggcaccagaggcagaggcagaggccagggccagaactggaaccagggcttcaacaactactacgaccagggctacggcaactacaacagcgcctacggcggcgaccagaactacagcggctacggcggctacgactacaccggctacaactacggcaactacggctacggccagggctacgccgactacagcggccagcagagcacctacggcaaggccagcagaggcggcggcaaccaccagaacaactaccagccctactag

SEQ ID NO: 84400 - DNA, 735 bp, Artificial Sequence
  Description of Artificial Sequence: Synthetic coding sequence
atggaggacatgaacgagtacagcaacatcgaggagttcgccgagggcagcaagatcaacgccagcaagaaccagcaggacgacggcaagatgttcatcggcggcctgagctgggacaccagcaagaaggacctgaccgagtacctgagcagattcggcgaggtggtggactgcaccatcaagaccgaccccgtgaccggcagaagcagaggcttcggcttcgtgctgttcaaggacgccgccagcgtggacaaggtgctggagctgaaggagcacaagctggacggcaagctgatcgaccccaagagagccaaggccctgaagggcaaggagccccccaagaaggtgttcgtgggcggcctgagccccgacaccagcgaggagcagatcaaggagtacttcggcgccttcggcgagatcgagaacatcgagctgcccatggacaccaagaccaacgagagaagaggcttctgcttcatcacctacaccgacgaggagcccgtgaagaagctgctggagagcagataccaccagatcggcagcggcaagtgcgagatcaaggtggcccagcccaaggaggtgtacagacagcagcagcagcagcagaagggcggcagaggcgccgccgccggcggcagaggcggcaccagaggcagaggcagaggccagcagagcacctacggcaaggccagcagaggcggcggcaaccaccagaacaactaccagccctactag

SEQ ID NO: 84401 - DNA, 1263 bp, Artificial Sequence; identical to SEQ ID NO: 84399
  Description of Artificial Sequence: Synthetic coding sequence

SEQ ID NO: 84402 - DNA, 1902 bp, Artificial Sequence
  Description of Artificial Sequence: Synthetic coding sequence
atggccaaccaggtgaacggcaacgccgtgcagctgaaggaggaggaggagcccatggacaccagcagcgtgacccacaccgagcactacaagaccctgatcgaggccggcctgccccagaaggtggccgagagactggacgagatcttccagaccggcctggtggcctacgtggacctggacgagagagccatcgacgccctgagagagttcaacgaggagggcgccctgagcgtgctgcagcagttcaaggagagcgacctgagccacgtgcagaacaagagcgccttcctgtgcggcgtgatgaagacctacagacagagagagaagcagggcagcaaggtgcaggagagcaccaagggccccgacgaggccaagatcaaggccctgctggagagaaccggctacaccctggacgtgaccaccggccagagaaagtacggcggccccccccccgacagcgtgtacagcggcgtgcagcccggcatcggcaccgaggtgttcgtgggcaagatccccagagacctgtacgaggacgagctggtgcccctgttcgagaaggccggccccatctgggacctgagactgatgatggaccccctgagcggccagaacagaggctacgccttcatcaccttctgcggcaaggaggccgcccaggaggccgtgaagctgtgcgacagctacgagatcagacccggcaagcacctgggcgtgtgcatcagcgtggccaacaacagactgttcgtgggcagcatccccaagaacaagaccaaggagaacatcctggaggagttcagcaaggtgaccgagggcctggtggacgtgatcctgtaccaccagcccgacgacaagaagaagaacagaggcttctgcttcctggagtacgaggaccacaagagcgccgcccaggccagaagaagactgatgagcggcaaggtgaaggtgtggggcaacgtggtgaccgtggagtgggccgaccccgtggaggagcccgaccccgaggtgatggccaaggtgaaggtgctgttcgtgagaaacctggccaccaccgtgaccgaggagatcctggagaagagcttcagcgagttcggcaagctggagagagtgaagaagctgaaggactacgccttcgtgcacttcgaggacagaggcgccgccgtgaaggccatggacgagatgaacggcaaggagatcgagggcgaggagatcgagatcgtgctggccaagccccccgacaagaagagaaaggagagacaggccgccagacaggccagcagaagcaccgcctacgaggactactactaccaccccccccccagaatgcccccccccatcagaggcagaggcagaggcggcggcagaggcggctacggctacccccccgactactacggctacgaggactactacgacgactactacggctacgactaccacgactacagaggcggctacgaggacccctactacggctacgacgacggctacgccgtgagaggcagaggcggcggcagaggcggcagaggcgccccccccccccccagaggcagaggcgcccccccccccagaggcagagccggctacagccagagaggcgcccccctgggcccccccagaggcagcagaggcggcagaggcggccccgcccagcagcagagaggcagaggcagcagaggcagcagaggcaacagaggcggcaacgtgggcggcaagagaaaggccgacggctacaaccagcccgacagcaagagaagacagaccaacaaccagcagaactggggcagccagcccatcgcccagcagcccctgcagcagggcggcgactacagcggcaactacggctacaacaacgacaaccaggagttctaccaggacacctacggccagcagtggaagtag

SEQ ID NO: 84403 - DNA, 1902 bp, Artificial Sequence; identical to SEQ ID NO: 84402
  Description of Artificial Sequence: Synthetic coding sequence

SEQ ID NO: 84404 - DNA, 1911 bp, Artificial Sequence
  Description of Artificial Sequence: Synthetic coding sequence
atggccaaccaggtgaacggcaacgccgtgcagctgaaggaggaggaggagcccatggacaccagcagcgtgacccacaccgagcactacaagaccctgatcgaggccggcctgccccagaaggtggccgagagactggacgagatcttccagaccggcctggtggcctacgtggacctggacgagagagccatcgacgccctgagagagttcaacgaggagggcgccctgagcgtgctgcagcagttcaaggagagcgacctgagccacgtgcagaacaagagcgccttcctgtgcggcgtgatgaagacctacagacagagagagaagcagggcagcaaggtgcaggagagcaccaagggccccgacgaggccaagatcaaggccctgctggagagaaccggctacaccctggacgtgaccaccggccagagaaagtacggcggccccccccccgacagcgtgtacagcggcgtgcagcccggcatcggcaccgaggtgttcgtgggcaagatccccagagacctgtacgaggacgagctggtgcccctgttcgagaaggccggccccatctgggacctgagactgatgatggaccccctgagcggccagaacagaggctacgccttcatcaccttctgcggcaaggaggccgcccaggaggccgtgaagctgtgcgacagctacgagatcagacccggcaagcacctgggcgtgtgcatcagcgtggccaacaacagactgttcgtgggcagcatccccaagaacaagaccaaggagaacatcctggaggagttcagcaaggtgaccggcctgaccgagggcctggtggacgtgatcctgtaccaccagcccgacgacaagaagaagaacagaggcttctgcttcctggagtacgaggaccacaagagcgccgcccaggccagaagaagactgatgagcggcaaggtgaaggtgtggggcaacgtggtgaccgtggagtgggccgaccccgtggaggagcccgaccccgaggtgatggccaaggtgaaggtgctgttcgtgagaaacctggccaccaccgtgaccgaggagatcctggagaagagcttcagcgagttcggcaagctggagagagtgaagaagctgaaggactacgccttcgtgcacttcgaggacagaggcgccgccgtgaaggccatggacgagatgaacggcaaggagatcgagggcgaggagatcgagatcgtgctggccaagccccccgacaagaagagaaaggagagacaggccgccagacaggccagcagaagcaccgcctacgaggactactactaccaccccccccccagaatgcccccccccatcagaggcagaggcagaggcggcggcagaggcggctacggctacccccccgactactacggctacgaggactactacgacgactactacggctacgactaccacgactacagaggcggctacgaggacccctactacggctacgacgacggctacgccgtgagaggcagaggcggcggcagaggcggcagaggcgccccccccccccccagaggcagaggcgcccccccccccagaggcagagccggctacagccagagaggcgcccccctgggcccccccagaggcagcagaggcggcagaggcggccccgcccagcagcagagaggcagaggcagcagaggcagcagaggcaacagaggcggcaacgtgggcggcaagagaaaggccgacggctacaaccagcccgacagcaagagaagacagaccaacaaccagcagaactggggcagccagcccatcgcccagcagcccctgcagcagggcggcgactacagcggcaactacggctacaacaacgacaaccaggagttctaccaggacacctacggccagcagtggaagtag

SEQ ID NO: 84405 - DNA, 1422 bp, Artificial Sequence
  Description of Artificial Sequence: Synthetic coding sequence
atgaagacctacagacagagagagaagcagggcagcaaggtgcaggagagcaccaagggccccgacgaggccaagatcaaggccctgctggagagaaccggctacaccctggacgtgaccaccggccagagaaagtacggcggccccccccccgacagcgtgtacagcggcgtgcagcccggcatcggcaccgagtgcgacagctacgagatcagacccggcaagcacctgggcgtgtgcatcagcgtggccaacaacagactgttcgtgggcagcatccccaagaacaagaccaaggagaacatcctggaggagttcagcaaggtgaccgagggcctggtggacgtgatcctgtaccaccagcccgacgacaagaagaagaacagaggcttctgcttcctggagtacgaggaccacaagagcgccgcccaggccagaagaagactgatgagcggcaaggtgaaggtgtggggcaacgtggtgaccgtggagtgggccgaccccgtggaggagcccgaccccgaggtgatggccaaggtgaaggtgctgttcgtgagaaacctggccaccaccgtgaccgaggagatcctggagaagagcttcagcgagttcggcaagctggagagagtgaagaagctgaaggactacgccttcgtgcacttcgaggacagaggcgccgccgtgaaggccatggacgagatgaacggcaaggagatcgagggcgaggagatcgagatcgtgctggccaagccccccgacaagaagagaaaggagagacaggccgccagacaggccagcagaagcaccgcctacgaggactactactaccaccccccccccagaatgcccccccccatcagaggcagaggcagaggcggcggcagaggcggctacggctacccccccgactactacggctacgaggactactacgacgactactacggctacgactaccacgactacagaggcggctacgaggacccctactacggctacgacgacggctacgccgtgagaggcagaggcggcggcagaggcggcagaggcgccccccccccccccagaggcagaggcgcccccccccccagaggcagagccggctacagccagagaggcgcccccctgggcccccccagaggcagcagaggcggcagaggcggccccgcccagcagcagagaggcagaggcagcagaggcagcagaggcaacagaggcggcaacgtgggcggcaagagaaaggccgacggctacaaccagcccgacagcaagagaagacagaccaacaaccagcagaactggggcagccagcccatcgcccagcagcccctgcagcagggcggcgactacagcggcaactacggctacaacaacgacaaccaggagttctaccaggacacctacggccagcagtggaagtag

SEQ ID NO: 84406 - DNA, 1788 bp, Artificial Sequence
  Description of Artificial Sequence: Synthetic coding sequence
atggccaaccaggtgaacggcaacgccgtgcagctgaaggaggaggaggagcccatggacaccagcagcgtgacccacaccgagcactacaagaccctgatcgaggccggcctgccccagaaggtggccgagagactggacgagatcttccagaccggcctggtggcctacgtggacctggacgagagagccatcgacgccctgagagagttcaacgaggagggcgccctgagcgtgctgcagcagttcaaggagagcgacctgagccacgtgcagaacaagagcgccttcctgtgcggcgtgatgaagacctacagacagagagagaagcagggcagcaaggtgcaggagagcaccaagggccccgacgaggccaagatcaaggtgttcgtgggcaagatccccagagacctgtacgaggacgagctggtgcccctgttcgagaaggccggccccatctgggacctgagactgatgatggaccccctgagcggccagaacagaggctacgccttcatcaccttctgcggcaaggaggccgcccaggaggccgtgaagctgtgcgacagctacgagatcagacccggcaagcacctgggcgtgtgcatcagcgtggccaacaacagactgttcgtgggcagcatccccaagaacaagaccaaggagaacatcctggaggagttcagcaaggtgaccgagggcctggtggacgtgatcctgtaccaccagcccgacgacaagaagaagaacagaggcttctgcttcctggagtacgaggaccacaagagcgccgcccaggccagaagaagactgatgagcggcaaggtgaaggtgtggggcaacgtggtgaccgtggagtgggccgaccccgtggaggagcccgaccccgaggtgatggccaaggtgaaggtgctgttcgtgagaaacctggccaccaccgtgaccgaggagatcctggagaagagcttcagcgagttcggcaagctggagagagtgaagaagctgaaggactacgccttcgtgcacttcgaggacagaggcgccgccgtgaaggccatggacgagatgaacggcaaggagatcgagggcgaggagatcgagatcgtgctggccaagccccccgacaagaagagaaaggagagacaggccgccagacaggccagcagaagcaccgcctacgaggactactactaccaccccccccccagaatgcccccccccatcagaggcagaggcagaggcggcggcagaggcggctacggctacccccccgactactacggctacgaggactactacgacgactactacggctacgactaccacgactacagaggcggctacgaggacccctactacggctacgacgacggctacgccgtgagaggcagaggcggcggcagaggcggcagaggcgccccccccccccccagaggcagaggcgcccccccccccagaggcagagccggctacagccagagaggcgcccccctgggcccccccagaggcagcagaggcggcagaggcggccccgcccagcagcagagaggcagaggcagcagaggcagcagaggcaacagaggcggcaacgtgggcggcaagagaaaggccgacggctacaaccagcccgacagcaagagaagacagaccaacaaccagcagaactggggcagccagcccatcgcccagcagcccctgcagcagggcggcgactacagcggcaactacggctacaacaacgacaaccaggagttctaccaggacacctacggccagcagtggaagtag

SEQ ID NO: 84407 - DNA, 2304 bp, Artificial Sequence
  Description of Artificial Sequence: Synthetic coding sequence
atgagaagctgggccttcagctacctggacgccatggacaacatcaccagacagaaccagttctacgacacccaggtgatcaagcaggagaacgagagcggctacgagagaagacccctggagatggagcagcagcaggcctacagacccgagatgaagaccgagatgaagcagggcgcccccaccagcttcctgccccccgaggccagccagctgaagcccgacagacagcagttccagagcagaaagagaccctacgaggagaacagaggcagaggctacttcgagcacagagaggacagaagaggcagaagcccccagccccccgccgaggaggacgaggacgacttcgacgacaccctggtggccatcgacacctacaactgcgacctgcacttcaaggtggccagagacagaagcagcggctaccccctgaccatcgagggcttcgcctacctgtggagcggcgccagagccagctacggcgtgagaagaggcagagtgtgcttcgagatgaagatcaacgaggagatcagcgtgaagcacctgcccagcaccgagcccgacccccacgtggtgagaatcggctggagcctggacagctgcagcacccagctgggcgaggagcccttcagctacggctacggcggcaccggcaagaagagcaccaacagcagattcgagaactacggcgacaagttcgccgagaacgacgtgatcggctgcttcgccgacttcgagtgcggcaacgacgtggagctgagcttcaccaagaacggcaagtggatgggcatcgccttcagaatccagaaggaggccctgggcggccaggccctgtacccccacgtgctggtgaagaactgcgccgtggagttcaacttcggccagagagccgagccctactgcagcgtgctgcccggcttcaccttcatccagcacctgcccctgagcgagagaatcagaggcaccgtgggccccaagagcaaggccgagtgcgagatcctgatgatggtgggcctgcccgccgccggcaagaccacctgggccatcaagcacgccgccagcaaccccagcaagaagtacaacatcctgggcaccaacgccatcatggacaagatgagagtgatgggcctgagaagacagagaaactacgccggcagatgggacgtgctgatccagcaggccacccagtgcctgaacagactgatccagatcgccgccagaaagaagagaaactacatcctggaccagaccaacgtgtacggcagcgcccagagaagaaagatgagacccttcgagggcttccagagaaaggccatcgtgatctgccccaccgacgaggacctgaaggacagaaccatcaagagaaccgacgaggagggcaaggacgtgcccgaccacgccgtgctggagatgaaggccaacttcaccctgcccgacgtgggcgacttcctggacgaggtgctgttcatcgagctgcagagagaggaggccgacaagctggtgagacagtacaacgaggagggcagaaaggccggccccccccccgagaagagattcgacaacagaggcggcggcggcttcagaggcagaggcggcggcggcggcttccagagatacgagaacagaggcccccccggcggcaacagaggcggcttccagaacagaggcggcggcagcggcggcggcggcaactacagaggcggcttcaacagaagcggcggcggcggctacagccagaacagatggggcaacaacaacagagacaacaacaacagcaacaacagaggcagctacaacagagccccccagcagcagccccccccccagcagcccccccccccccagccccccccccagcagcccccccccccccccagctacagccccgccagaaacccccccggcgccagcacctacaacaagaacagcaacatccccggcagcagcgccaacaccagcacccccaccgtgagcagctacagccccccccagcccagctacagccagcccccctacaaccagggcggctacagccagggctacaccgcccccccccccccccccccccccccccccgcctacaactacggcagctacggcggctacaaccccgccccctacacccccccccccccccccaccgcccagacctacccccagcccagctacaaccagtaccagcagtacgcccagcagtggaaccagtactaccagaaccagggccagtggcccccctactacggcaactacgactacggcagctacagcggcaacacccagggcggcaccagcacccagtag

SEQ ID NO: 84408 - DNA, 369 bp, Artificial Sequence
  Description of Artificial Sequence: Synthetic coding sequence
atggacgtgagaagactgaaggtgaacgagctgagagaggagctgcagagaagaggcctggacaccagaggcctgaaggccgagctggccgagagactgcaggccgccctggaggccgaggagcccgacgacgagagagagctggacgccgacgacgagcccggcagacccggccacatcaacgaggaggccgagctgcagcccgccaccctgcagcccggcagactgcagcccggcctgcacagccccaccgccagcaccagcaccaccacctgcctgcagctgtgggagctgagaagactgcagcccggccccctgtaccccaccgccaccccccactgcaccgacctgcccagcgcccagctgtag

SEQ ID NO: 84409 - DNA, 2271 bp, Artificial Sequence
  Description of Artificial Sequence: Synthetic coding sequence
atggacaacatcaccagacagaaccagttctacgacacccaggtgatcaagcaggagaacgagagcggctacgagagaagacccctggagatggagcagcagcaggcctacagacccgagatgaagaccgagatgaagcagggcgcccccaccagcttcctgccccccgaggccagccagctgaagcccgacagacagcagttccagagcagaaagagaccctacgaggagaacagaggcagaggctacttcgagcacagagaggacagaagaggcagaagcccccagccccccgccgaggaggacgaggacgacttcgacgacaccctggtggccatcgacacctacaactgcgacctgcacttcaaggtggccagagacagaagcagcggctaccccctgaccatcgagggcttcgcctacctgtggagcggcgccagagccagctacggcgtgagaagaggcagagtgtgcttcgagatgaagatcaacgaggagatcagcgtgaagcacctgcccagcaccgagcccgacccccacgtggtgagaatcggctggagcctggacagctgcagcacccagctgggcgaggagcccttcagctacggctacggcggcaccggcaagaagagcaccaacagcagattcgagaactacggcgacaagttcgccgagaacgacgtgatcggctgcttcgccgacttcgagtgcggcaacgacgtggagctgagcttcaccaagaacggcaagtggatgggcatcgccttcagaatccagaaggaggccctgggcggccaggccctgtacccccacgtgctggtgaagaactgcgccgtggagttcaacttcggccagagagccgagccctactgcagcgtgctgcccggcttcaccttcatccagcacctgcccctgagcgagagaatcagaggcaccgtgggccccaagagcaaggccgagtgcgagatcctgatgatggtgggcctgcccgccgccggcaagaccacctgggccatcaagcacgccgccagcaaccccagcaagaagtacaacatcctgggcaccaacgccatcatggacaagatgagagtgatgggcctgagaagacagagaaactacgccggcagatgggacgtgctgatccagcaggccacccagtgcctgaacagactgatccagatcgccgccagaaagaagagaaactacatcctggaccagaccaacgtgtacggcagcgcccagagaagaaagatgagacccttcgagggcttccagagaaaggccatcgtgatctgccccaccgacgaggacctgaaggacagaaccatcaagagaaccgacgaggagggcaaggacgtgcccgaccacgccgtgctggagatgaaggccaacttcaccctgcccgacgtgggcgacttcctggacgaggtgctgttcatcgagctgcagagagaggaggccgacaagctggtgagacagtacaacgaggagggcagaaaggccggccccccccccgagaagagattcgacaacagaggcggcggcggcttcagaggcagaggcggcggcggcggcttccagagatacgagaacagaggcccccccggcggcaacagaggcggcttccagaacagaggcggcggcagcggcggcggcggcaactacagaggcggcttcaacagaagcggcggcggcggctacagccagaacagatggggcaacaacaacagagacaacaacaacagcaacaacagaggcagctacaacagagccccccagcagcagccccccccccagcagcccccccccccccagccccccccccagcagcccccccccccccccagctacagccccgccagaaacccccccggcgccagcacctacaacaagaacagcaacatccccggcagcagcgccaacaccagcacccccaccgtgagcagctacagccccccccagcccagctacagccagcccccctacaaccagggcggctacagccagggctacaccgcccccccccccccccccccccccccccccgcctacaactacggcagctacggcggctacaaccccgccccctacacccccccccccccccccaccgcccagacctacccccagcccagctacaaccagtaccagcagtacgcccagcagtggaaccagtactaccagaaccagggccagtggcccccctactacggcaactacgactacggcagctacagcggcaacacccagggcggcaccagcacccagtag

SEQ ID NO: 84410 - DNA, 2259 bp, Artificial Sequence
  Description of Artificial Sequence: Synthetic coding sequence
atggacgtgagaagactgaaggtgaacgagctgagagaggagctgcagagaagaggcctggacaccagaggcctgaaggccgagctggccgagagactgcagccccccccccccggcctgcagccccacgccgagcccggcggctacagcggccccgacggccactacgccatggacaacatcaccagacagaaccagttctacgacacccaggtgatcaagcaggagaacgagagcggctacgagagaagacccctggagatggagcagcagcaggcctacagacccgagatgaagaccgagatgaagcagggcgcccccaccagcttcctgccccccgaggccagccagctgaagcccgacagacagcagttccagagcagaaagagaccctacgaggagaacagaggcagaggctacttcgagcacagagaggacagaagaggcagaagcccccagccccccgccgaggaggacgaggacgacttcgacgacaccctggtggccatcgacacctacaactgcgacctgcacttcaaggtggccagagacagaagcagcggctaccccctgaccatcgagggcttcgcctacctgtggagcggcgccagagccagctacggcgtgagaagaggcagagtgtgcttcgagatgaaggacttcgagtgcggcaacgacgtggagctgagcttcaccaagaacggcaagtggatgggcatcgccttcagaatccagaaggaggccctgggcggccaggccctgtacccccacgtgctggtgaagaactgcgccgtggagttcaacttcggccagagagccgagccctactgcagcgtgctgcccggcttcaccttcatccagcacctgcccctgagcgagagaatcagaggcaccgtgggccccaagagcaaggccgagtgcgagatcctgatgatggtgggcctgcccgccgccggcaagaccacctgggccatcaagcacgccgccagcaaccccagcaagaagtacaacatcctgggcaccaacgccatcatggacaagatgagagtgatgggcctgagaagacagagaaactacgccggcagatgggacgtgctgatccagcaggccacccagtgcctgaacagactgatccagatcgccgccagaaagaagagaaactacatcctggaccagaccaacgtgtacggcagcgcccagagaagaaagatgagacccttcgagggcttccagagaaaggccatcgtgatctgccccaccgacgaggacctgaaggacagaaccatcaagagaaccgacgaggagggcaaggacgtgcccgaccacgccgtgctggagatgaaggccaacttcaccctgcccgacgtgggcgacttcctggacgaggtgctgttcatcgagctgcagagagaggaggccgacaagctggtgagacagtacaacgaggagggcagaaaggccggccccccccccgagaagagattcgacaacagaggcggcggcggcttcagaggcagaggcggcggcggcggcttccagagatacgagaacagaggcccccccggcggcaacagaggcggcttccagaacagaggcggcggcagcggcggcggcggcaactacagaggcggcttcaacagaagcggcggcggcggctacagccagaacagatggggcaacaacaacagagacaacaacaacagcaacaacagaggcagctacaacagagccccccagcagcagccccccccccagcagcccccccccccccagccccccccccagcagcccccccccccccccagctacagccccgccagaaacccccccggcgccagcacctacaacaagaacagcaacatccccggcagcagcgccaacaccagcacccccaccgtgagcagctacagccccccccagagcttcggcttcttccccagcaccttccagcccagctacagccagcccccctacaaccagggcggctacagccagggctacaccgcccccccccccccccccccccccccccccgcctacaactacggcagctacggcggctacaaccccgccccctacacccccccccccccccccaccgcccagacctacccccagcccagctacaaccagtaccagcagtacgcccagcagtggaaccagtactaccagaaccagggccagtggcccccctactacggcaactacgactacggcagctacagcggcaacacccagggcggcaccagcacccagtag

SEQ ID NO: 84411 - DNA, 2571 bp, Artificial Sequence
  Description of Artificial Sequence: Synthetic coding sequence
atggacgtgagaagactgaaggtgaacgagctgagagaggagctgcagagaagaggcctggacaccagaggcctgaaggccgagctggccgagagactgcaggccgccctggaggccgaggagcccgacgacgagagagagctggacgccgacgacgagcccggcagacccggccacatcaacgaggaggtggagaccgagggcggcagcgagctggagggcaccgcccagccccccccccccggcctgcagccccacgccgagcccggcggctacagcggccccgacggccactacgccatggacaacatcaccagacagaaccagttctacgacacccaggtgatcaagcaggagaacgagagcggctacgagagaagacccctggagatggagcagcagcaggcctacagacccgagatgaagaccgagatgaagcagggcgcccccaccagcttcctgccccccgaggccagccagctgaagcccgacagacagcagttccagagcagaaagagaccctacgaggagaacagaggcagaggctacttcgagcacagagaggacagaagaggcagaagcccccagccccccgccgaggaggacgaggacgacttcgacgacaccctggtggccatcgacacctacaactgcgacctgcacttcaaggtggccagagacagaagcagcggctaccccctgaccatcgagggcttcgcctacctgtggagcggcgccagagccagctacggcgtgagaagaggcagagtgtgcttcgagatgaagatcaacgaggagatcagcgtgaagcacctgcccagcaccgagcccgacccccacgtggtgagaatcggctggagcctggacagctgcagcacccagctgggcgaggagcccttcagctacggctacggcggcaccggcaagaagagcaccaacagcagattcgagaactacggcgacaagttcgccgagaacgacgtgatcggctgcttcgccgacttcgagtgcggcaacgacgtggagctgagcttcaccaagaacggcaagtggatgggcatcgccttcagaatccagaaggaggccctgggcggccaggccctgtacccccacgtgctggtgaagaactgcgccgtggagttcaacttcggccagagagccgagccctactgcagcgtgctgcccggcttcaccttcatccagcacctgcccctgagcgagagaatcagaggcaccgtgggccccaagagcaaggccgagtgcgagatcctgatgatggtgggcctgcccgccgccggcaagaccacctgggccatcaagcacgccgccagcaaccccagcaagaagtacaacatcctgggcaccaacgccatcatggacaagatgagagtgatgggcctgagaagacagagaaactacgccggcagatgggacgtgctgatccagcaggccacccagtgcctgaacagactgatccagatcgccgccagaaagaagagaaactacatcctggaccagaccaacgtgtacggcagcgcccagagaagaaagatgagacccttcgagggcttccagagaaaggccatcgtgatctgccccaccgacgaggacctgaaggacagaaccatcaagagaaccgacgaggagggcaaggacgtgcccgaccacgccgtgctggagatgaaggccaacttcaccctgcccgacgtgggcgacttcctggacgaggtgctgttcatcgagctgcagagagaggaggccgacaagctggtgagacagtacaacgaggagggcagaaaggccggccccccccccgagaagagattcgacaacagaggcggcggcggcttcagaggcagaggcggcggcggcggcttccagagatacgagaacagaggcccccccggcggcaacagaggcggcttccagaacagaggcggcggcagcggcggcggcggcaactacagaggcggcttcaacagaagcggcggcggcggctacagccagaacagatggggcaacaacaacagagacaacaacaacagcaacaacagaggcagctacaacagagccccccagcagcagccccccccccagcagcccccccccccccagccccccccccagcagcccccccccccccccagctacagccccgccagaaacccccccggcgccagcacctacaacaagaacagcaacatccccggcagcagcgccaacaccagcacccccaccgtgagcagctacagccccccccagcccagctacagccagcccccctacaaccagggcggctacagccagggctacaccgcccccccccccccccccccccccccccccgcctacaactacggcagctacggcggctacaaccccgccccctacacccccccccccccccccaccgcccagacctacccccagcccagctacaaccagtaccagcagtacgcccagcagtggaaccagtactaccagaaccagggccagtggcccccctactacggcaactacgactacggcagctacagcggcaacacccagggcggcaccagcacccagtag

SEQ ID NO: 84412 - DNA, 2751 bp, Artificial Sequence
  Description of Artificial Sequence: Synthetic coding sequence
atggactgcgagcacagcctgagcctgccctgcagaggcgccgaggcctgggagatcggcatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggccagcagctag

SEQ ID NO: 84413 - DNA, 2754 bp, Artificial Sequence
  Description of Artificial Sequence: Synthetic coding sequence
atgatcgccgcccagctgctggcctactacttcaccgagctgaaggacgaccaggtgaagaagatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggccagcagctag

SEQ ID NO: 84414 - DNA, 2718 bp, Artificial Sequence
  Description of Artificial Sequence: Synthetic coding sequence
atggccaagagagccctgcacgacttcatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggccagcagctag

SEQ ID NO: 84415 - DNA, 2766 bp, Artificial Sequence
  Description of Artificial Sequence: Synthetic coding sequence
atgggccagatctgccagagagagagcgccaccgccgccgagaagcccaagctgcacctgctggccgagagcgagatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggccagcagctag

SEQ ID NO: 84416 - DNA, 2748 bp, Artificial Sequence
  Description of Artificial Sequence: Synthetic coding sequence
atgatcgccgcccagctgctggcctactacttcaccgagctgaaggacgaccaggtgaagaagatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggcctag

SEQ ID NO: 84417 - DNA, 345 bp, Artificial Sequence
  Description of Artificial Sequence: Synthetic coding sequence
atggccaagagagccctgcacgacttcatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgtag

SEQ ID NO: 84418 - DNA, 876 bp, Artificial Sequence
  Description of Artificial Sequence: Synthetic coding sequence
atggactgcgagcacagcctgagcctgccctgcagaggcgccgaggcctgggagatcggcatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgtag

SEQ ID NO: 84419 - DNA, 2859 bp, Artificial Sequence
  Description of Artificial Sequence: Synthetic coding sequence
atgggccagatctgccagagagagagcagacagggcctggccatgctgcccagactgttcctgaacccctggagacaggtgatcctgctgccccagccccccaaggtgctgggcctgcaggccaccgccgccgagaagcccaagctgcacctgctggccgagagcgagatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggcgacttcatggagaagagaaagatcaaggacaagaagctgcccgtgggcttcaccttcagcttcccctgccagcagagcaagatcgacgaggccatcctgatcacctggaccaagagattcaaggccagcggcgtggagggcgccgacgtggtgaagctgctgaacaaggccatcaagaagagaggcgactacgacgccaacatcgtggccgtggtgaacgacaccgtgggcaccatgatgacctgcggctacgacgaccagcactgcgaggtgggcctgatcatcggcaccggcaccaacgcctgctacatggaggagctgagacacatcgacctggtggagggcgacgagggcagaatgtgcatcaacaccgagtggggcgccttcggcgacgacggcagcctggaggacatcagaaccgagttcgacagagagatcgacagaggcagcctgaaccccggcaagcagctgttcgagaagatggtgagcggcatgtacctgggcgagctggtgagactgatcctggtgaagatggccaaggagggcctgctgttcgagggcagaatcacccccgagctgctgaccagaggcaagttcaacaccagcgacgtgagcgccatcgagaagaacaaggagggcctgcacaacgccaaggagatcctgaccagactgggcgtggagcccagcgacgacgactgcgtgagcgtgcagcacgtgtgcaccatcgtgagcttcagaagcgccaacctggtggccgccaccctgggcgccatcctgaacagactgagagacaacaagggcacccccagactgagaaccaccgtgggcgtggacggcagcctgtacaagacccacccccagtacagcagaagattccacaagaccctgagaagactggtgcccgacagcgacgtgagattcctgctgagcgagagcggcagcggcaagggcgccgccatggtgaccgccgtggcctacagactggccgagcagcacagacagatcgaggagaccctggcccacttccacctgaccaaggacatgctgctggaggtgaagaagagaatgagagccgagatggagctgggcctgagaaagcagacccacaacaacgccgtggtgaagatgctgcccagcttcgtgagaagaacccccgacggcaccgagaacggcgacttcctggccctggacctgggcggcaccaacttcagagtgctgctggtgaagatcagaagcggcaagaagagaaccgtggagatgcacaacaagatctacgccatccccatcgagatcatgcagggcaccggcgaggagctgttcgaccacatcgtgagctgcatcagcgacttcctggactacatgggcatcaagggccccagaatgcccctgggcttcaccttcagcttcccctgccagcagaccagcctggacgccggcatcctgatcacctggaccaagggcttcaaggccaccgactgcgtgggccacgacgtggtgaccctgctgagagacgccatcaagagaagagaggagttcgacctggacgtggtggccgtggtgaacgacaccgtgggcaccatgatgacctgcgcctacgaggagcccacctgcgaggtgggcctgatcgtgggcaccggcagcaacgcctgctacatggaggagatgaagaacgtggagatggtggagggcgaccagggccagatgtgcatcaacatggagtggggcgccttcggcgacaacggctgcctggacgacatcagaacccactacgacagactggtggacgagtacagcctgaacgccggcaagcagagatacgagaagatgatcagcggcatgtacctgggcgagatcgtgagaaacatcctgatcgacttcaccaagaagggcttcctgttcagaggccagatcagcgagaccctgaagaccagaggcatcttcgagaccaagttcctgagccagatcgagagcgacagactggccctgctgcaggtgagagccatcctgcagcagctgggcctgaacagcacctgcgacgacagcatcctggtgaagaccgtgtgcggcgtggtgagcagaagagccgcccagctgtgcggcgccggcatggccgccgtggtggacaagatcagagagaacagaggcctggacagactgaacgtgaccgtgggcgtggacggcaccctgtacaagctgcacccccacttcagcagaatcatgcaccagaccgtgaaggagctgagccccaagtgcaacgtgagcttcctgctgagcgaggacggcagcggcaagggcgccgccctgatcaccgccgtgggcgtgagactgagaaccgaggccagcagctag

SEQ ID NO: 84420 - DNA, 420 bp, Artificial Sequence
  Description of Artificial Sequence: Synthetic coding sequence
atgggccagatctgccagagagagagcgccaccgccgccgagaagcccaagctgcacctgctggccgagagcgagatcgacaagtacctgtacgccatgagactgagcgacgagaccctgatcgacatcatgaccagattcagaaaggagatgaagaacggcctgagcagagacttcaaccccaccgccaccgtgaagatgctgcccaccttcgtgagaagcatccccgacggcagcgagaagggcgacttcatcgccctggacctgggcggcagcagcttcagaatcctgagagtgcaggtgaaccacgagaagaaccagaacgtgcacatggagagcgaggtgtacgacacccccgagaacatcgtgcacggcagcggcagccagctgttcgaccacgtggccgagtgcctgggctag

SEQ ID NO: 84421 - DNA, 2754 bp, Artificial Sequence
  Description of Artificial Sequence: Synthetic coding sequence
atgatcgccagccacctgctggcctacttcttcaccgagctgaaccacgaccaggtgcagaaggtggaccagtacctgtaccacatgagactgagcgacgagaccctgctggagatcagcaagagattcagaaaggagatggagaagggcctgggcgccaccacccaccccaccgccgccgtgaagatgctgcccaccttcgtgagaagcacccccgacggcaccgagcacggcgagttcctggccctggacctgggcggcaccaacttcagagtgctgtgggtgaaggtgaccgacaacggcctgcagaaggtggagatggagaaccagatctacgccatccccgaggacatcatgagaggcagcggcacccagctgttcgaccacatcgccgagtgcctggccaacttcatggacaagctgcagatcaaggacaagaagctgcccctgggcttcaccttcagcttcccctgccaccagaccaagctggacgagagcttcctggtgagctggaccaagggcttcaagagcagcggcgtggagggcagagacgtggtggccctgatcagaaaggccatccagagaagaggcgacttcgacatcgacatcgtggccgtggtgaacgacaccgtgggcaccatgatgacctgcggctacgacgaccacaactgcgagatcggcctgatcgtgggcaccggcagcaacgcctgctacatggaggagatgagacacatcgacatggtggagggcgacgagggcagaatgtgcatcaacatggagtggggcgccttcggcgacgacggcagcctgaacgacatcagaaccgagttcgaccaggagatcgacatgggcagcctgaaccccggcaagcagctgttcgagaagatgatcagcggcatgtacatgggcgagctggtgagactgatcctggtgaagatggccaaggaggagctgctgttcggcggcaagctgagccccgagctgctgaacaccggcagattcgagaccaaggacatcagcgacatcgagggcgagaaggacggcatcagaaaggccagagaggtgctgatgagactgggcctggaccccacccaggaggactgcgtggccacccacagaatctgccagatcgtgagcaccagaagcgccagcctgtgcgccgccaccctggccgccgtgctgcagagaatcaaggagaacaagggcgaggagagactgagaagcaccatcggcgtggacggcagcgtgtacaagaagcacccccacttcgccaagagactgcacaagaccgtgagaagactggtgcccggctgcgacgtgagattcctgagaagcgaggacggcagcggcaagggcgccgccatggtgaccgccgtggcctacagactggccgaccagcacagagccagacagaagaccctggagcacctgcagctgagccacgaccagctgctggaggtgaagagaagaatgaaggtggagatggagagaggcctgagcaaggagacccacgccagcgcccccgtgaagatgctgcccacctacgtgtgcgccacccccgacggcaccgagaagggcgacttcctggccctggacctgggcggcaccaacttcagagtgctgctggtgagagtgagaaacggcaagtggggcggcgtggagatgcacaacaagatctacgccatcccccaggaggtgatgcacggcaccggcgacgagctgttcgaccacatcgtgcagtgcatcgccgacttcctggagtacatgggcatgaagggcgtgagcctgcccctgggcttcaccttcagcttcccctgccagcagaacagcctggacgagagcatcctgctgaagtggaccaagggcttcaaggccagcggctgcgagggcgaggacgtggtgaccctgctgaaggaggccatccacagaagagaggagttcgacctggacgtggtggccgtggtgaacgacaccgtgggcaccatgatgacctgcggcttcgaggacccccactgcgaggtgggcctgatcgtgggcaccggcagcaacgcctgctacatggaggagatgagaaacgtggagctggtggagggcgaggagggcagaatgtgcgtgaacatggagtggggcgccttcggcgacaacggctgcctggacgacttcagaaccgagttcgacgtggccgtggacgagctgagcctgaaccccggcaagcagagattcgagaagatgatcagcggcatgtacctgggcgagatcgtgagaaacatcctgatcgacttcaccaagagaggcctgctgttcagaggcagaatcagcgagagactgaagaccagaggcatcttcgagaccaagttcctgagccagatcgagagcgactgcctggccctgctgcaggtgagagccatcctgcagcacctgggcctggagagcacctgcgacgacagcatcatcgtgaaggaggtgtgcaccgtggtggccagaagagccgcccagctgtgcggcgccggcatggccgccgtggtggacagaatcagagagaacagaggcctggacgccctgaaggtgaccgtgggcgtggacggcaccctgtacaagctgcacccccacttcgccaaggtgatgcacgagaccgtgaaggacctggcccccaagtgcgacgtgagcttcctgcagagcgaggacggcagcggcaagggcgccgccctgatcaccgccgtggcctgcagaatcagagaggccggccagagatag

SEQ ID NO: 84422 - DNA, 2670 bp, Artificial Sequence
  Description of Artificial Sequence: Synthetic coding sequence
atgagactgagcgacgagaccctgctggagatcagcaagagattcagaaaggagatggagaagggcctgggcgccaccacccaccccaccgccgccgtgaagatgctgcccaccttcgtgagaagcacccccgacggcaccgagcacggcgagttcctggccctggacctgggcggcaccaacttcagagtgctgtgggtgaaggtgaccgacaacggcctgcagaaggtggagatggagaaccagatctacgccatccccgaggacatcatgagaggcagcggcacccagctgttcgaccacatcgccgagtgcctggccaacttcatggacaagctgcagatcaaggacaagaagctgcccctgggcttcaccttcagcttcccctgccaccagaccaagctggacgagagcttcctggtgagctggaccaagggcttcaagagcagcggcgtggagggcagagacgtggtggccctgatcagaaaggccatccagagaagaggcgacttcgacatcgacatcgtggccgtggtgaacgacaccgtgggcaccatgatgacctgcggctacgacgaccacaactgcgagatcggcctgatcgtgggcaccggcagcaacgcctgctacatggaggagatgagacacatcgacatggtggagggcgacgagggcagaatgtgcatcaacatggagtggggcgccttcggcgacgacggcagcctgaacgacatcagaaccgagttcgaccaggagatcgacatgggcagcctgaaccccggcaagcagctgttcgagaagatgatcagcggcatgtacatgggcgagctggtgagactgatcctggtgaagatggccaaggaggagctgctgttcggcggcaagctgagccccgagctgctgaacaccggcagattcgagaccaaggacatcagcgacatcgagggcgagaaggacggcatcagaaaggccagagaggtgctgatgagactgggcctggaccccacccaggaggactgcgtggccacccacagaatctgccagatcgtgagcaccagaagcgccagcctgtgcgccgccaccctggccgccgtgctgcagagaatcaaggagaacaagggcgaggagagactgagaagcaccatcggcgtggacggcagcgtgtacaagaagcacccccacttcgccaagagactgcacaagaccgtgagaagactggtgcccggctgcgacgtgagattcctgagaagcgaggacggcagcggcaagggcgccgccatggtgaccgccgtggcctacagactggccgaccagcacagagccagacagaagaccctggagcacctgcagctgagccacgaccagctgctggaggtgaagagaagaatgaaggtggagatggagagaggcctgagcaaggagacccacgccagcgcccccgtgaagatgctgcccacctacgtgtgcgccacccccgacggcaccgagaagggcgacttcctggccctggacctgggcggcaccaacttcagagtgctgctggtgagagtgagaaacggcaagtggggcggcgtggagatgcacaacaagatctacgccatcccccaggaggtgatgcacggcaccggcgacgagctgttcgaccacatcgtgcagtgcatcgccgacttcctggagtacatgggcatgaagggcgtgagcctgcccctgggcttcaccttcagcttcccctgccagcagaacagcctggacgagagcatcctgctgaagtggaccaagggcttcaaggccagcggctgcgagggcgaggacgtggtgaccctgctgaaggaggccatccacagaagagaggagttcgacctggacgtggtggccgtggtgaacgacaccgtgggcaccatgatgacctgcggcttcgaggacccccactgcgaggtgggcctgatcgtgggcaccggcagcaacgcctgctacatggaggagatgagaaacgtggagctggtggagggcgaggagggcagaatgtgcgtgaacatggagtggggcgccttcggcgacaacggctgcctggacgacttcagaaccgagttcgacgtggccgtggacgagctgagcctgaaccccggcaagcagagattcgagaagatgatcagcggcatgtacctgggcgagatcgtgagaaacatcctgatcgacttcaccaagagaggcctgctgttcagaggcagaatcagcgagagactgaagaccagaggcatcttcgagaccaagttcctgagccagatcgagagcgactgcctggccctgctgcaggtgagagccatcctgcagcacctgggcctggagagcacctgcgacgacagcatcatcgtgaaggaggtgtgcaccgtggtggccagaagagccgcccagctgtgcggcgccggcatggccgccgtggtggacagaatcagagagaacagaggcctggacgccctgaaggtgaccgtgggcgtggacggcaccctgtacaagctgcacccccacttcgccaaggtgatgcacgagaccgtgaaggacctggcccccaagtgcgacgtgagcttcctgcagagcgaggacggcagcggcaagggcgccgccctgatcaccgccgtggcctgcagaatcagagaggccggccagagatag

SEQ ID NO: 84423 - DNA, 2754 bp, Artificial Sequence; identical to SEQ ID NO: 84421
  Description of Artificial Sequence: Synthetic coding sequence

SEQ ID NO: 84424 - DNA, 2772 bp, Artificial Sequence
  Description of Artificial Sequence: Synthetic coding sequence
atggacagcatcggcagcagcggcctgagacagggcgaggagaccctgagctgcagcgaggagggcctgcccggccccagcgacagcagcgagctggtgcaggagtgcctgcagcagttcaaggtgaccagagcccagctgcagcagatccaggccagcctgctgggcagcatggagcaggccctgagaggccaggccagccccgcccccgccgtgagaatgctgcccacctacgtgggcagcaccccccacggcaccgagcagggcgacttcgtggtgctggagctgggcgccaccggcgccagcctgagagtgctgtgggtgaccctgaccggcatcgagggccacagagtggagcccagaagccaggagttcgtgatcccccaggaggtgatgctgggcgccggccagcagctgttcgacttcgccgcccactgcctgagcgagttcctggacgcccagcccgtgaacaagcagggcctgcagctgggcttcagcttcagcttcccctgccaccagaccggcctggacagaagcaccctgatcagctggaccaagggcttcagatgcagcggcgtggagggccaggacgtggtgcagctgctgagagacgccatcagaagacagggcgcctacaacatcgacgtggtggccgtggtgaacgacaccgtgggcaccatgatgggctgcgagcccggcgtgagaccctgcgaggtgggcctggtggtggacaccggcaccaacgcctgctacatggaggaggccagacacgtggccgtgctggacgaggacagaggcagagtgtgcgtgagcgtggagtggggcagcttcagcgacgacggcgccctgggccccgtgctgaccaccttcgaccacaccctggaccacgagagcctgaaccccggcgcccagagattcgagaagatgatcggcggcctgtacctgggcgagctggtgagactggtgctggcccacctggccagatgcggcgtgctgttcggcggctgcaccagccccgccctgctgagccagggcagcatcctgctggagcacgtggccgagatggaggaccccagcaccggcgccgccagagtgcacgccatcctgcaggacctgggcctgagccccggcgccagcgacgtggagctggtgcagcacgtgtgcgccgccgtgtgcaccagagccgcccagctgtgcgccgccgccctggccgccgtgctgagctgcctgcagcacagcagagagcagcagaccctgcaggtggccgtggccaccggcggcagagtgtgcgagagacaccccagattctgcagcgtgctgcagggcaccgtgatgctgctggcccccgagtgcgacgtgagcctgatccccagcgtggacggcggcggcagaggcgtggccatggtgaccgccgtggccgccagactggccgcccacagaagactgctggaggagaccctggcccccttcagactgaaccacgaccagctggccgccgtgcaggcccagatgagaaaggccatggccaagggcctgagaggcgaggccagcagcctgagaatgctgcccaccttcgtgagagccacccccgacggcagcgagagaggcgacttcctggccctggacctgggcggcaccaacttcagagtgctgctggtgagagtgaccaccggcgtgcagatcaccagcgagatctacagcatccccgagaccgtggcccagggcagcggccagcagctgttcgaccacatcgtggactgcatcgtggacttccagcagaagcagggcctgagcggccagagcctgcccctgggcttcaccttcagcttcccctgcagacagctgggcctggaccagggcatcctgctgaactggaccaagggcttcaaggccagcgactgcgagggccaggacgtggtgagcctgctgagagaggccatcaccagaagacaggccgtggagctgaacgtggtggccatcgtgaacgacaccgtgggcaccatgatgagctgcggctacgaggaccccagatgcgagatcggcctgatcgtgggcaccggcaccaacgcctgctacatggaggagctgagaaacgtggccggcgtgcccggcgacagcggcagaatgtgcatcaacatggagtggggcgccttcggcgacgacggcagcctggccatgctgagcaccagattcgacgccagcgtggaccaggccagcatcaaccccggcaagcagagattcgagaagatgatcagcggcatgtacctgggcgagatcgtgagacacatcctgctgcacctgaccagcctgggcgtgctgttcagaggccagcagatccagagactgcagaccagagacatcttcaagaccaagttcctgagcgagatcgagagcgacagcctggccctgagacaggtgagagccatcctggaggacctgggcctgcccctgaccagcgacgacgccctgatggtgctggaggtgtgccaggccgtgagccagagagccgcccagctgtgcggcgccggcgtggccgccgtggtggagaagatcagagagaacagaggcctggaggagctggccgtgagcgtgggcgtggacggcaccctgtacaagctgcaccccagattcagcagcctggtggccgccaccgtgagagagctggcccccagatgcgtggtgaccttcctgcagagcgaggacggcagcggcaagggcgccgccctggtgaccgccgtggcctgcagactggcccagctgaccagagtgtag

SEQ ID NO: 84425 - DNA, 1590 bp, Artificial Sequence
  Description of Artificial Sequence: Synthetic coding sequence
atgaccagcagcagactgtggttcagcctgctgctggccgccgccttcgccggcagagccaccgccctgtggccctggccccagaacttccagaccagcgaccagagatacgtgctgtaccccaacaacttccagttccagtacgacgtgagcagcgccgcccagcccggctgcagcgtgctggacgaggccttccagagatacagagacctgctgttcggcagcggcagctggcccagaccctacctgaccggcaagagacacaccctggagaagaacgtgctggtggtgagcgtggtgacccccggctgcaaccagctgcccaccctggagagcgtggagaactacaccctgaccatcaacgacgaccagtgcctgctgctgagcgagaccgtgtggggcgccctgagaggcctggagaccttcagccagctggtgtggaagagcgccgagggcaccttcttcatcaacaagaccgagatcgaggacttccccagattcccccacagaggcctgctgctggacaccagcagacactacctgcccctgagcagcatcctggacaccctggacgtgatggcctacaacaagctgaacgtgttccactggcacctggtggacgaccccagcttcccctacgagagcttcaccttccccgagctgatgagaaagggcagctacaaccccgtgacccacatctacaccgcccaggacgtgaaggaggtgatcgagtacgccagactgagaggcatcagagtgctggccgagttcgacacccccggccacaccctgagctggggccccggcatccccggcctgctgaccccctgctacagcggcagcgagcccagcggcaccttcggccccgtgaaccccagcctgaacaacacctacgagttcatgagcaccttcttcctggaggtgagcagcgtgttccccgacttctacctgcacctgggcggcgacgaggtggacttcacctgctggaagagcaaccccgagatccaggacttcatgagaaagaagggcttcggcgaggacttcaagcagctggagagcttctacatccagaccctgctggacatcgtgagcagctacggcaagggctacgtggtgtggcaggaggtgttcgacaacaaggtgaagatccagcccgacaccatcatccaggtgtggagagaggacatccccgtgaactacatgaaggagctggagctggtgaccaaggccggcttcagagccctgctgagcgccccctggtacctgaacagaatcagctacggccccgactggaaggacttctacatcgtggagcccctggccttcgagggcacccccgagcagaaggccctggtgatcggcggcgaggcctgcatgtggggcgagtacgtggacaacaccaacctggtgcccagactgtggcccagagccggcgccgtggccgagagactgtggagcaacaagctgaccagcgacctgaccttcgcctacgagagactgagccacttcagatgcgagctgctgagaagaggcgtgcaggcccagcccctgaacgtgggcttctgcgagcaggagttcgagcagacctag

SEQ ID NO: 84426 - DNA, 906 bp, Artificial Sequence
  Description of Artificial Sequence: Synthetic coding sequence
atgatgaccagcgtgtacagcagcctgagactgagcggcgagctgagcgaggacgtgatggcctacaacaagctgaacgtgttccactggcacctggtggacgaccccagcttcccctacgagagcttcaccttccccgagctgatgagaaagggcagctacaaccccgtgacccacatctacaccgcccaggacgtgaaggaggtgatcgagtacgccagactgagaggcatcagagtgctggccgagttcgacacccccggccacaccctgagctggggccccggcatccccggcctgctgaccccctgctacagcggcagcgagcccagcggcaccttcggccccgtgaaccccagcctgaacaacacctacgagttcatgagcaccttcttcctggaggtgagcagcgtgttccccgacttctacctgcacctgggcggcgacgaggtggacttcacctgctggaagagcaaccccgagatccaggacttcatgagaaagaagggcttcggcgaggacttcaagcagctggagagcttctacatccagaccctgctggacatcgtgagcagctacggcaagggctacgtggtgtggcaggaggtgttcgacaacaaggtgaagatccagcccgacaccatcatccaggtgtggagagaggacatccccgtgaactacatgaaggagctggagctggtgaccaaggccggcttcagagccctgctgagcgccccctggtacctgaacagaatcagctacggccccgactggaaggacttctacatcgtggagcccctggccttcgagggcacccccgagcagaaggccctggtgatcggcggcgaggcctgcatgtggggcgagtacgtggacaacaccaacctggtgcccagactgtggtag

SEQ ID NO: 84427 - DNA, 507 bp, Artificial Sequence
  Description of Artificial Sequence: Synthetic coding sequence
atggcctacaacaagctgaacgtgttccactggcacctggtggacgaccccagcttcccctacgagagcttcaccttccccgagctgatgagaaagggcagctacaaccccgtgacccacatctacaccgcccaggacgtgaaggaggtgatcgagtacgccagactgagaggcatcagagtgctggccgagttcgacacccccggccacaccctgagctggggccccggcatccccggcctgctgaccccctgctacagcggcagcgagcccagcggcaccttcggccccgtgaaccccagcctgaacaacacctacgagttcatgagcaccttcttcctggaggtgagcagcgtgttccccgacttctacctgcacctgggcggcgacgaggtggacttcacctgctggaagagcaaccccgagatccaggacttcatgagaaagaagggcttcggcgaggacttcaagcagctggagagcttctacatccagacctacccctag

SEQ ID NO: 84428 - DNA, 1671 bp, Artificial Sequence
  Description of Artificial Sequence: Synthetic coding sequence
atggagctgtgcggcctgggcctgcccagaccccccatgctgctggccctgctgctggccaccctgctggccgccatgctggccctgctgacccaggtggccctggtggtgcaggtggccgaggccgccagagcccccagcgtgagcgccaagcccggccccgccctgtggcccctgcccctgctggtgaagatgacccccaacctgctgcacctggcccccgagaacttctacatcagccacagccccaacagcaccgccggccccagctgcaccctgctggaggaggccttcagaagataccacggctacatcttcggcttctacaagtggcaccacgagcccgccgagttccaggccaagacccaggtgcagcagctgctggtgagcatcaccctgcagagcgagtgcgacgccttccccaacatcagcagcgacgagagctacaccctgctggtgaaggagcccgtggccgtgctgaaggccaacagagtgtggggcgccctgagaggcctggagaccttcagccagctggtgtaccaggacagctacggcaccttcaccatcaacgagagcaccatcatcgacagccccagattcagccacagaggcatcctgatcgacaccagcagacactacctgcccgtgaagatcatcctgaagaccctggacgccatggccttcaacaagttcaacgtgctgcactggcacatcgtggacgaccagagcttcccctaccagagcatcaccttccccgagctgagcaacaagggcagctacagcctgagccacgtgtacacccccaacgacgtgagaatggtgatcgagtacgccagactgagaggcatcagagtgctgcccgagttcgacacccccggccacaccctgagctggggcaagggccagaaggacctgctgaccccctgctacagcagacagaacaagctggacagcttcggccccatcaaccccaccctgaacaccacctacagcttcctgaccaccttcttcaaggagatcagcgaggtgttccccgaccagttcatccacctgggcggcgacgaggtggagttcaagtgctgggagagcaaccccaagatccaggacttcatgagacagaagggcttcggcaccgacttcaagaagctggagagcttctacatccagaaggtgctggacatcatcgccaccatcaacaagggcagcatcgtgtggcaggaggtgttcgacgacaaggccaagctggcccccggcaccatcgtggaggtgtggaaggacagcgcctaccccgaggagctgagcagagtgaccgccagcggcttccccgtgatcctgagcgccccctggtacctggacctgatcagctacggccaggactggagaaagtactacaaggtggagcccctggacttcggcggcacccagaagcagaagcagctgttcatcggcggcgaggcctgcctgtggggcgagtacgtggacgccaccaacctgacccccagactgtggcccagagccagcgccgtgggcgagagactgtggagcagcaaggacgtgagagacatggacgacgcctacgacagactgaccagacacagatgcagaatggtggagagaggcatcgccgcccagcccctgtacgccggctactgcaaccacgagaacatgtag

SEQ ID NO: 84429 - DNA, 996 bp, Artificial Sequence
  Description of Artificial Sequence: Synthetic coding sequence
atggccttcaacaagttcaacgtgctgcactggcacatcgtggacgaccagagcttcccctaccagagcatcaccttccccgagctgagcaacaagggcagctacagcctgagccacgtgtacacccccaacgacgtgagaatggtgatcgagtacgccagactgagaggcatcagagtgctgcccgagttcgacacccccggccacaccctgagctggggcaagggccagaaggacctgctgaccccctgctacagcagacagaacaagctggacagcttcggccccatcaaccccaccctgaacaccacctacagcttcctgaccaccttcttcaaggagatcagcgaggtgttccccgaccagttcatccacctgggcggcgacgaggtggagttcaagtgctgggagagcaaccccaagatccaggacttcatgagacagaagggcttcggcaccgacttcaagaagctggagagcttctacatccagaaggtgctggacatcatcgccaccatcaacaagggcagcatcgtgtggcaggaggtgttcgacgacaaggccaagctggcccccggcaccatcgtggaggtgtggaaggacagcgcctaccccgaggagctgagcagagtgaccgccagcggcttccccgtgatcctgagcgccccctggtacctggacctgatcagctacggccaggactggagaaagtactacaaggtggagcccctggacttcggcggcacccagaagcagaagcagctgttcatcggcggcgaggcctgcctgtggggcgagtacgtggacgccaccaacctgacccccagactgtggcccagagccagcgccgtgggcgagagactgtggagcagcaaggacgtgagagacatggacgacgcctacgacagactgaccagacacagatgcagaatggtggagagaggcatcgccgcccagcccctgtacgccggctactgcaaccacgagaacatgtag

SEQ ID NO: 84430 - DNA, 2376 bp, Artificial Sequence
  Description of Artificial Sequence: Synthetic coding sequence
atgtggaacatgctgatcgtggccatgtgcctggccctgctgggctgcctgcaggcccaggagctgcagggccacgtgagcatcatcctgctgggcgccaccggcgacctggccaagaagtacctgtggcagggcctgttccagctgtacctggacgaggccggcagaggccacagcttcagcttccacggcgccgccctgaccgcccccaagcagggccaggagctgatggccaaggccctggagagcctgagctgccccaaggacatggcccccagccactgcgccgagcacaaggaccagttcctgcagctgagccagtacagacagctgaagaccgccgaggactaccaggccctgaacaaggacatcgaggcccagctgcagcacgccggcctgagagaggccggcagaatcttctacttcagcgtgccccccttcgcctacgaggacatcgccagaaacatcaacagcagctgcagacccggccccggcgcctggctgagagtggtgctggagaagcccttcggccacgaccacttcagcgcccagcagctggccaccgagctgggcaccttcttccaggaggaggagatgtacagagtggaccactacctgggcaagcaggccgtggcccagatcctgcccttcagagaccagaacagaaaggccctggacggcctgtggaacagacaccacgtggagagagtggagatcatcatgaaggagaccgtggacgccgagggcagaaccagcttctacgaggagtacggcgtgatcagagacgtgctgcagaaccacctgaccgaggtgctgaccctggtggccatggagctgccccacaacgtgagcagcgccgaggccgtgctgagacacaagctgcaggtgttccaggccctgagaggcctgcagagaggcagcgccgtggtgggccagtaccagagctacagcgagcaggtgagaagagagctgcagaagcccgacagcttccacagcctgacccccaccttcgccgccgtgctggtgcacatcgacaacctgagatgggagggcgtgcccttcatcctgatgagcggcaaggccctggacgagagagtgggctacgccagaatcctgttcaagaaccaggcctgctgcgtgcagagcgagaagcactgggccgccgcccagagccagtgcctgcccagacagctggtgttccacatcggccacggcgacctgggcagccccgccgtgctggtgagcagaaacctgttcagacccagcctgcccagcagctggaaggagatggagggcccccccggcctgagactgttcggcagccccctgagcgactactacgcctacagccccgtgagagagagagacgcccacagcgtgctgctgagccacatcttccacggcagaaagaacttcttcatcaccaccgagaacctgctggccagctggaacttctggacccccctgctggagagcctggcccacaaggcccccagactgtaccccggcggcgccgagaacggcagactgctggacttcgagttcagcagcggcagactgttcttcagccagcagcagcccgagcagctggtgcccggccccggccccgcccccatgcccagcgacttccaggtgctgagagccaagtacagagagagccccctggtgagcgcctggagcgaggagctgatcagcaagctggccaacgacatcgaggccaccgccgtgagagccgtgagaagattcggccagttccacctggccctgagcggcggcagcagccccgtggccctgttccagcagctggccaccgcccactacggcttcccctgggcccacacccacctgtggctggtggacgagagatgcgtgcccctgagcgaccccgagagcaacttccagggcctgcaggcccacctgctgcagcacgtgagaatcccctactacaacatccaccccatgcccgtgcacctgcagcagagactgtgcgccgaggaggaccagggcgcccagatctacgccagagagatcagcgccctggtggccaacagcagcttcgacctggtgctgctgggcatgggcgccgacggccacaccgccagcctgttcccccagagccccaccggcctggacggcgagcagctggtggtgctgaccaccagccccagccagccccacagaagaatgagcctgagcctgcccctgatcaacagagccaagaaggtggccgtgctggtgatgggcagaatgaagagagagatcaccaccctggtgagcagagtgggccacgagcccaagaagtggcccatcagcggcgtgctgccccacagcggccagctggtgtggtacatggactacgacgccttcctgggctag

SEQ ID NO: 84431 - DNA, 1968 bp, Artificial Sequence
  Description of Artificial Sequence: Synthetic coding sequence
atgggcagatgggcctgggtgcccagcccctggcccccccccggcctgggccccttcctgctgctgctgctgctgctgctgctgctgcccagaggcttccagccccagcccggcggcaacagaaccgagagccccgagcccaacgccaccgccacccccgccatccccaccatcctggtgaccagcgtgaccagcgagacccccgccaccagcgcccccgaggccgagggcccccagagcggcggcctgccccccccccccagagccgtgcccagcagcagcagcccccaggcccaggccctgaccgaggacggcagaccctgcagattccccttcagatacggcggcagaatgctgcacgcctgcaccagcgagggcagcgcccacagaaagtggtgcgccaccacccacaactacgacagagacagagcctggggctactgcgtggaggccacccccccccccggcggccccgccgccctggacccctgcgccagcggcccctgcctgaacggcggcagctgcagcaacacccaggacccccagagctaccactgcagctgccccagagccttcaccggcaaggactgcggcaccgagaagtgcttcgacgagaccagatacgagtacctggagggcggcgacagatgggccagagtgagacagggccacgtggagcagtgcgagtgcttcggcggcagaacctggtgcgagggcaccagacacaccgcctgcctgagcagcccctgcctgaacggcggcacctgccacctgatcgtggccaccggcaccaccgtgtgcgcctgcccccccggcttcgccggcagactgtgcaacatcgagcccgacgagagatgcttcctgggcaacggcaccggctacagaggcgtggccagcaccagcgccagcggcctgagctgcctggcctggaacagcgacctgctgtaccaggagctgcacgtggacagcgtgggcgccgccgccctgctgggcctgggcccccacgcctactgcagaaaccccgacaacgacgagagaccctggtgctacgtggtgaaggacagcgccctgagctgggagtactgcagactggaggcctgcgagagcctgaccagagtgcagctgagccccgacctgctggccaccctgcccgagcccgccagccccggcagacaggcctgcggcagaagacacaagaagagaaccttcctgagacccagaatcatcggcggcagcagcagcctgcccggcagccacccctggctggccgccatctacatcggcgacagcttctgcgccggcagcctggtgcacacctgctgggtggtgagcgccgcccactgcttcagccacagcccccccagagacagcgtgagcgtggtgctgggccagcacttcttcaacagaaccaccgacgtgacccagaccttcggcatcgagaagtacatcccctacaccctgtacagcgtgttcaaccccagcgaccacgacctggtgctgatcagactgaagaagaagggcgacagatgcgccaccagaagccagttcgtgcagcccatctgcctgcccgagcccggcagcaccttccccgccggccacaagtgccagatcgccggctggggccacctggacgagaacgtgagcggctacagcagcagcctgagagaggccctggtgcccctggtggccgaccacaagtgcagcagccccgaggtgtacggcgccgacatcagccccaacatgctgtgcgccggctacttcgactgcaagagcgacgcctgccagggcgacagcggcggccccctggcctgcgagaagaacggcgtggcctacctgtacggcatcatcagctggggcgacggctgcggcagactgcacaagcccggcgtgtacaccagagtggccaactacgtggactggatcaacgacagaatcagaccccccagaagactggtggcccccagctag

SEQ ID NO: 84432 - DNA, 3807 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgcagacccaggccagcgccaccgtggccatccccaaggagcaccacagattcgtgatcggcaagaacggcgagaagctgcaggacctggagctgaagaccgccaccaagatccagatccccagacccgacgaccccagcaaccagatcaagatcaccggcaccaaggagggcatcgagaaggccagacacgaggtgctgctgatcagcgccgagcaggacaagagagccgtggagagactggaggtggagaaggccttccaccccttcatcgccggcccctacaacagactggtgggcgagatcatgcaggagaccggcaccagaatcaacatccccccccccagcgtgaacagaaccgagatcgtgttcaccggcgagaaggagcagctggcccaggccgtggccagaatcaagaagatctacgaggagaagaagaagaagaccaccaccatcgccgtggaggtgaagaagagccagcacaagtacgtgatcggccccaagggcaacagcctgcaggagatcctggagagaaccggcgtgagcgtggagatcccccccagcgacagcatcagcgagaccgtgatcctgagaggcgagcccgagaagctgggccaggccctgaccgaggtgtacgccaaggccaacagcttcaccgtgagcagcgtggccgcccccagctggctgcacagattcatcatcggcaagaagggccagaacctggccaagatcacccagcagatgcccaaggtgcacatcgagttcaccgagggcgaggacaagatcaccctggagggccccaccgaggacgtgaacgtggcccaggagcagatcgagggcatggtgaaggacctgatcaacagaatggactacgtggagatcaacatcgaccacaagttccacagacacctgatcggcaagagcggcgccaacatcaacagaatcaaggaccagtacaaggtgagcgtgagaatcccccccgacagcgagaagagcaacctgatcagaatcgagggcgacccccagggcgtgcagcaggccaagagagagctgctggagctggccagcagaatggagaacgagagaaccaaggacctgatcatcgagcagagattccacagaaccatcatcggccagaagggcgagagaatcagagagatcagagacaagttccccgaggtgatcatcaacttccccgaccccgcccagaagagcgacatcgtgcagctgagaggccccaagaacgaggtggagaagtgcaccaagtacatgcagaagatggtggccgacctggtggagaacagctacagcatcagcgtgcccatcttcaagcagttccacaagaacatcatcggcaagggcggcgccaacatcaagaagatcagagaggagagcaacaccaagatcgacctgcccgccgagaacagcaacagcgagaccatcatcatcaccggcaagagagccaactgcgaggccgccagaagcagaatcctgagcatccagaaggacctggccaacatcgccgaggtggaggtgagcatccccgccaagctgcacaacagcctgatcggcaccaagggcagactgatcagaagcatcatggaggagtgcggcggcgtgcacatccacttccccgtggagggcagcggcagcgacaccgtggtgatcagaggccccagcagcgacgtggagaaggccaagaagcagctgctgcacctggccgaggagaagcagaccaagagcttcaccgtggacatcagagccaagcccgagtaccacaagttcctgatcggcaagggcggcggcaagatcagaaaggtgagagacagcaccggcgccagagtgatcttccccgccgccgaggacaaggaccaggacctgatcaccatcatcggcaaggaggacgccgtgagagaggcccagaaggagctggaggccctgatccagaacctggacaacgtggtggaggacagcatgctggtggaccccaagcaccacagacacttcgtgatcagaagaggccaggtgctgagagagatcgccgaggagtacggcggcgtgatggtgagcttccccagaagcggcacccagagcgacaaggtgaccctgaagggcgccaaggactgcgtggaggccgccaagaagagaatccaggagatcatcgaggacctggaggcccaggtgaccctggagtgcgccatcccccagaagttccacagaagcgtgatgggccccaagggcagcagaatccagcagatcaccagagacttcagcgtgcagatcaagttccccgacagagaggagaacgccgtgcacagcaccgagcccgtggtgcaggagaacggcgacgaggccggcgagggcagagaggccaaggactgcgaccccggcagccccagaagatgcgacatcatcatcatcagcggcagaaaggagaagtgcgaggccgccaaggaggccctggaggccctggtgcccgtgaccatcgaggtggaggtgcccttcgacctgcacagatacgtgatcggccagaagggcagcggcatcagaaagatgatggacgagttcgaggtgaacatccacgtgcccgcccccgagctgcagagcgacatcatcgccatcaccggcctggccgccaacctggacagagccaaggccggcctgctggagagagtgaaggagctgcaggccgagcaggaggacagagccctgagaagcttcaagctgagcgtgaccgtggaccccaagtaccaccccaagatcatcggcagaaagggcgccgtgatcacccagatcagactggagcacgacgtgaacatccagttccccgacaaggacgacggcaaccagccccaggaccagatcaccatcaccggctacgagaagaacaccgaggccgccagagacgccatcctgagaatcgtgggcgagctggagcagatggtgagcgaggacgtgcccctggaccacagagtgcacgccagaatcatcggcgccagaggcaaggccatcagaaagatcatggacgagttcaaggtggacatcagattcccccagagcggcgcccccgaccccaactgcgtgaccgtgaccggcctgcccgagaacgtggaggaggccatcgaccacatcctgaacctggaggaggagtacctggccgacgtggtggacagcgaggccctgcaggtgtacatgaagccccccgcccacgaggaggccaaggcccccagcagaggcttcgtggtgagagacgccccctggaccgccagcagcagcgagaaggcccccgacatgagcagcagcgaggagttccccagcttcggcgcccaggtggcccccaagaccctgccctggggccccaagagatag

SEQ ID NO: 84433 - DNA, 3807 bp, Artificial Sequence; identical to SEQ ID NO: 84432
  Description of Artificial Sequence: Synthetic coding sequence

SEQ ID NO: 84434 - DNA, 3807 bp, Artificial Sequence; identical to SEQ ID NO: 84432
  Description of Artificial Sequence: Synthetic coding sequence

SEQ ID NO: 84435 - DNA, 249 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgtag

SEQ ID NO: 84436 - DNA, 45 bp, Artificial Sequence
  Description of Artificial Sequence: Synthetic coding sequence
atgagcagcgtggccgtgctgacccaggagagcttcgccgagtag

SEQ ID NO: 84437 - DNA, 210 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagatag

SEQ ID NO: 84438 - DNA, 165 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctgtag

SEQ ID NO: 84439 - DNA, 675 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgcagacccaggccagcgccaccgtggccatccccaaggagcaccacagattcgtgatcggcaagaacggcgagaagctgcaggacctggagctgaagaccgccaccaagatccagatccccagacccgacgaccccagcaaccagatcaagatcaccggcaccaaggagggcatcgagaaggccagacacgaggtgctgctgatcagcgccgagcaggacaagagagccgtgtag

SEQ ID NO: 84440 - DNA, 246 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccactag

SEQ ID NO: 84441 - DNA, 240 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgtag

SEQ ID NO: 84442 - DNA, 291 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggctag

SEQ ID NO: 84443 - DNA, 60 bp, Artificial Sequence
  Description of Artificial Sequence: Synthetic coding sequence
atgagcagcgtggccgtgctgacccaggagagcttcgccgagcacagaagcggcctgtag

SEQ ID NO: 84444 - DNA, 3708 bp, Artificial Sequence
  Description of Artificial Sequence: Synthetic coding sequence
atgcacctggccgagagagacagatggctgttcgtggccaccgtgatgatgcacttcgtgagcatcaagagcggcttccccggcctgtgcgtgggcgtgagaagcaccatgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgcagacccaggccagcgccaccgtggccatccccaaggagcaccacagattcgtgatcggcaagaacggcgagaagctgcaggacctggagctgaagaccgccaccaagatccagatccccagacccgacgaccccagcaaccagatcaagatcaccggcaccaaggagggcatcgagaaggccagacacgaggtgctgctgatcagcgccgagcaggacaagagagccgtggagagactggaggtggagaaggccttccaccccttcatcgccggcccctacaacagactggtgggcgagatcatgcaggagaccggcaccagaatcaacatccccccccccagcgtgaacagaaccgagatcgtgttcaccggcgagaaggagcagctggcccaggccgtggccagaatcaagaagatctacgaggagaaggccaacagcttcaccgtgagcagcgtggccgcccccagctggctgcacagattcatcatcggcaagaagggccagaacctggccaagatcacccagcagatgcccaaggtgcacatcgagttcaccgagggcgaggacaagatcaccctggagggccccaccgaggacgtgaacgtggcccaggagcagatcgagggcatggtgaaggacctgatcaacagaatggactacgtggagatcaacatcgaccacaagttccacagacacctgatcggcaagagcggcgccaacatcaacagaatcaaggaccagtacaaggtgagcgtgagaatcccccccgacagcgagaagagcaacctgatcagaatcgagggcgacccccagggcgtgcagcaggccaagagagagctgctggagctggccagcagaatggagaacgagagaaccaaggacctgatcatcgagcagagattccacagaaccatcatcggccagaagggcgagagaatcagagagatcagagacaagttccccgaggtgatcatcaacttccccgaccccgcccagaagagcgacatcgtgcagctgagaggccccaagaacgaggtggagaagtgcaccaagtacatgcagaagatggtggccgacctggtggagaacagctacagcatcagcgtgcccatcttcaagcagttccacaagaacatcatcggcaagggcggcgccaacatcaagaagatcagagaggagagcaacaccaagatcgacctgcccgccgagaacagcaacagcgagaccatcatcatcaccggcaagagagccaactgcgaggccgccagaagcagaatcctgagcatccagaaggacctggccaacatcgccgaggtggaggtgagcatccccgccaagctgcacaacagcctgatcggcaccaagggcagactgatcagaagcatcatggaggagtgcggcggcgtgcacatccacttccccgtggagggcagcggcagcgacaccgtggtgatcagaggccccagcagcgacgtggagaaggccaagaagcagctgctgcacctggccgaggagaagcagaccaagagcttcaccgtggacatcagagccaagcccgagtaccacaagttcctgatcggcaagggcggcggcaagatcagaaaggtgagagacagcaccggcgccagagtgatcttccccgccgccgaggacaaggaccaggacctgatcaccatcatcggcaaggaggacgccgtgagagaggcccagaaggagctggaggccctgatccagaacctggacaacgtggtggaggacagcatgctggtggaccccaagcaccacagacacttcgtgatcagaagaggccaggtgctgagagagatcgccgaggagtacggcggcgtgatggtgagcttccccagaagcggcacccagagcgacaaggtgaccctgaagggcgccaaggactgcgtggaggccgccaagaagagaatccaggagatcatcgaggacctggaggcccaggtgaccctggagtgcgccatcccccagaagttccacagaagcgtgatgggccccaagggcagcagaatccagcagatcaccagagacttcagcgtgcagatcaagttccccgacagagaggagaacgccgtgcacagcaccgagcccgtggtgcaggagaacggcgacgaggccggcgagggcagagaggccaaggactgcgaccccggcagccccagaagatgcgacatcatcatcatcagcggcagaaaggagaagtgcgaggccgccaaggaggccctggaggccctggtgcccgtgaccatcgaggtggaggtgcccttcgacctgcacagatacgtgatcggccagaagggcagcggcatcagaaagatgatggacgagttcgaggtgaacatccacgtgcccgcccccgagctgcagagcgacatcatcgccatcaccggcctggccgccaacctggacagagccaaggccggcctgctggagagagtgaaggagctgcaggccgagcaggaggacagagccctgagaagcttcaagctgagcgtgaccgtggaccccaagtaccaccccaagatcatcggcagaaagggcgccgtgatcacccagatcagactggagcacgacgtgaacatccagttccccgacaaggacgacggcaaccagccccaggaccagatcaccatcaccggctacgagaagaacaccgaggccgccagagacgccatcctgagaatcgtgggcgagctggagcagatggtgagcgaggacgtgcccctggaccacagagtgcacgccagaatcatcggcgccagaggcaaggccatcagaaagatcatggacgagttcaaggtggacatcagattcccccagagcggcgcccccgaccccaactgcgtgaccgtgaccggcctgcccgagaacgtggaggaggccatcgaccacatcctgaacctggaggaggagtacctggccgacgtggtggacagcgaggccctgcaggtgtacatgaagccccccgcccacgaggaggccaaggcccccagcagaggcttcgtggtgagagacgccccctggaccgccagcagcagcgagaaggcccccgacatgagcagcagcgaggagttccccagcttcggcgcccaggtggcccccaagaccctgccctggggccccaagagatag

SEQ ID NO: 84445 - DNA, 666 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgcagacccaggccagcgccaccgtggccatccccaaggagcaccacagattcgtgatcggcaagaacggcgagaagctgcaggacctggagctgaagaccgccaccaagatccagatccccagacccgacgaccccagcaaccagatcaagatcaccggcaccaaggagggcatcgagaaggccagacacgaggtgctgctgatcagcgccgagcaggacaagtag

SEQ ID NO: 84446 - DNA, 426 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaagtag

SEQ ID NO: 84447 - DNA, 381 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagctag

SEQ ID NO: 84448 - DNA, 444 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgtag

SEQ ID NO: 84449 - DNA, 54 bp, Artificial Sequence
  Description of Artificial Sequence: Synthetic coding sequence
atgagcagcgtggccgtgctgacccaggagagcttcgccgagcacagaagctag

SEQ ID NO: 84450 - DNA, 495 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgcccgagaaggccgcctgcctggagagcgcccaggagcccagcggcgcctggggcaacaagatcagacccatcaaggccagcgtgatcacccaggtgttccacgtgcccctggaggagagaaagtacaaggacatgaaccagttcggcgagggcgagcaggccaagatctgcctggagatcatgcagagaaccggcgcccacctggagctgagcctggccaaggaccagggcctgagcatcatggtgagcggcaagctggacgccgtgatgaaggccagaaaggacatcgtggccagactgcagacccaggccagcgccaccgtggccatccccaaggagcaccacagattctag

SEQ ID NO: 84451 - DNA, 144 bp, Artificial Sequence
  Description of Artificial Sequence: Synthetic coding sequence
atgagcagcgtggccgtgctgacccaggagagcttcgccgagcacagaagcggcctggtgccccagcagatcaaggtggccaccctgaacagcgaggaggagagcgacccccccacctacaaggacgccttcccccccctgtag

SEQ ID NO: 84452 - DNA, 1044 bp, Artificial Sequence
  Description of Artificial Sequence: Synthetic coding sequence
atggagaacctgatgaccagcagcaccctgccccccctgttcgccgacgaggacggcagcaaggagagcaacgacctggccaccaccggcctgaaccaccccgaggtgccctacagcagcggcgccaccagcagcaccaacaaccccgagttcgtggaggacctgagccagggccagctgctgcagagcgagagcagcaacgccgccgagggcaacgagcagagacacgaggacgagcagagaagcaagagaggcggctggagcaagggcagaaagagaaagaagcccctgagagacagcaacgcccccaagagccccctgaccggctacgtgagattcatgaacgagagaagagagcagctgagagccaagagacccgaggtgcccttccccgagatcaccagaatgctgggcaacgagtggagcaagctgccccccgaggagaagcagagatacctggacgaggccgacagagacaaggagagatacatgaaggagctggagcagtaccagaagaccgaggcctacaaggtgttcagcagaaagacccaggacagacagaagggcaagagccacagacaggacgccgccagacaggccacccacgaccacgagaaggagaccgaggtgaaggagagaagcgtgttcgacatccccatcttcaccgaggagttcctgaaccacagcaaggccagagaggccgagctgagacagctgagaaagagcaacatggagttcgaggagagaaacgccgccctgcagaagcacgtggagagcatgagaaccgccgtggagaagctggaggtggacgtgatccaggagagaagcagaaacaccgtgctgcagcagcacctggagaccctgagacaggtgctgaccagcagcttcgccagcatgcccctgcccggcagcggcgagacccccaccgtggacaccatcgacagctacatgaacagactgcacagcatcatcctggccaacccccaggacaacgagaacttcatcgccaccgtgagagaggtggtgaacagactggacagatag

SEQ ID NO: 84453 - DNA, 1044 bp, Artificial Sequence; identical to SEQ ID NO: 84452
  Description of Artificial Sequence: Synthetic coding sequence

SEQ ID NO: 84454 - DNA, 471 bp, Artificial Sequence
  Description of Artificial Sequence: Synthetic coding sequence
atggagaacctgatgaccagcagcaccctgccccccctgttcgccgacgaggacggcagcaaggagagcaacgacctggccaccaccggcctgaaccaccccgaggtgccctacagcagcggcgccaccagcagcaccaacaaccccgagttcgtggaggacctgagccagggccagctgctgcagagcgagagcagcaacgccgccgagggcaacgagcagagacacgaggacgagcagagaagcaagagaggcggctggagcaagggcagaaagagaaagaagcccctgagagacagcaacgcccccaagagccccctgaccggctacgtgagattcatgaacgagagaagagagcagctgagagccaagagacccgaggtgcccttccccgagatcaccagaatgctgggcaacgagtggagcaagctgccccccgaggagaagcagagatacctggacgaggcctag

SEQ ID NO: 84455 - DNA, 303 bp, Artificial Sequence
  Description of Artificial Sequence: Synthetic coding sequence
atggagaacctgatgaccagcagcaccctgccccccctgttcgccgacgaggacggcagcaaggagagcaacgacctggccaccaccggcctgaaccaccccgaggtgccctacagcagcggcgccaccagcagcaccaacaaccccgagttcgtggaggacctgagccagggccagctgctgcagagcgagagcagcaacgccgccgagggcaacgagcagagacacgaggacgagcagagaagcaagagaggcggctggagcaagggcagaaagagaaagaagcccctgagagacagctag

SEQ ID NO: 84456 - DNA, 489 bp, Artificial Sequence
  Description of Artificial Sequence: Synthetic coding sequence
atggagaacctgatgaccagcagcaccctgccccccctgttcgccgacgaggacggcagcaaggagagcaacgacctggccaccaccggcctgaaccaccccgaggtgccctacagcagcggcgccaccagcagcaccaacaaccccgagttcgtggaggacctgagccagggccagctgctgcagagcgagagcagcaacgccgccgagggcaacgagcagagacacgaggacgagcagagaagcaagagaggcggctggagcaagggcagaaagagaaagaagcccctgagagacagcaacgcccccaagagccccctgaccggctacgtgagattcatgaacgagagaagagagcagctgagagccaagagacccgaggtgcccttccccgagatcaccagaatgctgggcaacgagtggagcaagctgccccccgaggagaagcagagatacctggacgaggccgacagagacaaggagagatag

SEQ ID NO: 84457 - DNA, 954 bp, Artificial Sequence
  Description of Artificial Sequence: Synthetic coding sequence
atgagccacggccccaagcagcccggcgccgccgccgcccccgccggcggcaaggcccccggccagcacggcggcttcgtggtgaccgtgaagcaggagagaggcgagggccccagagccggcgagaagggcagccacgaggaggagcccgtgaagaagagaggctggcccaagggcaagaagagaaagaagatcctgcccaacggccccaaggcccccgtgaccggctacgtgagattcctgaacgagagaagagagcagatcagaaccagacaccccgacctgcccttccccgagatcaccaagatgctgggcgccgagtggagcaagctgcagcccaccgagaagcagagatacctggacgaggccgagagagagaagcagcagtacatgaaggagctgagagcctaccagcagagcgaggcctacaagatgtgcaccgagaagatccaggagaagaagatcaagaaggaggacagcagcagcggcctgatgaacaccctgctgaacggccacaagggcggcgactgcgacggcttcagcaccttcgacgtgcccatcttcaccgaggagttcctggaccagaacaaggccagagaggccgagctgagaagactgagaaagatgaacgtggccttcgaggagcagaacgccgtgctgcagagacacacccagagcatgagcagcgccagagagagactggagcaggagctggccctggaggagagaagaaccctggccctgcagcagcagctgcaggccgtgagacaggccctgaccgccagcttcgccagcctgcccgtgcccggcaccggcgagacccccaccctgggcaccctggacttctacatggccagactgcacggcgccatcgagagagaccccgcccagcacgagaagctgatcgtgagaatcaaggagatcctggcccaggtggccagcgagcacctgtag

SEQ ID NO: 84458 - DNA, 807 bp, Artificial Sequence
  Description of Artificial Sequence: Synthetic coding sequence
atggacaccagagtgggcaccgccatggccagcccccccagcatgttccccagcagcctgaagagcagctggaccaagaccaagagagtgagaagaagcttcggcgccgaggacgagtgcggcctgagaggcgccgagagaggcaccgccgaggcccacgccgagcacgagcagagagccagagccagcggcgccggcgccggcgccggcggcgccgaggacgccggcgccgccgccgccgcccccggcagagcccccggcgcccacagacagctgagactgaccgccggcgccggccacggcagaaacgcccacgccggccacagcggcctgctgcacggccccgccagcagaagccacagagccagacccagacccgccagagaggcccacagaccccaccagggcaaccccggccccggcagacagagagcccccgtgagaagcggcagagcccacgacgccgaggagaagctgtgggccagaccctgccacaccccccccagaggcagagaggccggcggcccccccggccccggccccatcctgcacctgggcggcagcagcccccccaagatcaagttcctgcagcaccccttcagcttccagagcccccagccccccgagcccggcaagagcaccagagacacccccagaagaaccagccagcccagagtgcccctgctgggcggccagaccagatacaccggcagccccggccacccccaggacaccggccagaccaagcccacccccagcaccagacaggacccccccaactacagcctgagaggcgccgtgccctag

SEQ ID NO: 84459 - DNA, 648 bp, Artificial Sequence
  Description of Artificial Sequence: Synthetic coding sequence
atgagccacggccccaagcagcccggcgccgccgccgcccccgccggcggcaaggcccccggccagcacggcggcttcgtggtgaccgtgaagcaggagagaggcgagggccccagagccggcgagaagggcagccacgaggaggagcccgtgaagaagagaggctggcccaagggcaagaagagaaagaagatcctgcccaacggccccaaggcccccgtgaccggctacgtgagattcctgaacgagagaagagagcagatcagaaccagacaccccgacctgcccttccccgagatcaccaagatgctgggcgccgagtggagcaagctgcagcccaccgagaagcagagatacctggacgaggccgagagagagaagcagcagtacatgaaggagctgagagcctaccagcagagcgaggcctacaagatgtgcaccgagaagatccaggagaagaagatcaagaaggaggacagcagcagcggcctgatgaacaccctgctgaacggccacaagggcggcgactgcgacggcttcagcaccttcgacgtgcccatcttcaccgaggagttcctggaccagaacaaggccagagaggccgagctgagaagactgagaaagatgaacgtggccttcgaggagtag

SEQ ID NO: 84460 - DNA, 429 bp, Artificial Sequence
  Description of Artificial Sequence: Synthetic coding sequence
atgagccacggccccaagcagcccggcgccgccgccgcccccgccggcggcaaggcccccggccagcacggcggcttcgtggtgaccgtgaagcaggagagaggcgagggccccagagccggcgagaagggcagccacgaggaggagcccgtgaagaagagaggctggcccaagggcaagaagagaaagaagatcctgcccaacggccccaaggcccccgtgaccggctacgtgagattcctgaacgagagaagagagcagatcagaaccagacaccccgacctgcccttccccgagatcaccaagatgctgggcgccgagtggagcaagctgcagcccaccgagaagcagagatacctggacgaggccgagagagagaagcagcagtacatgaaggagctgagagcctaccagcagagcgaggcctag

SEQ ID NO: 84461 - DNA, 324 bp, Artificial Sequence
  Description of Artificial Sequence: Synthetic coding sequence
atgagcgagagcagcagcaagagcagccagcccctggccagcaagcaggagaaggacggcaccgagaagagaggcagaggcagacccagaaagcagccccccgtgagccccggcaccgccctggtgggcagccagaaggagcccagcgaggtgcccacccccaagagacccagaggcagacccaagggcagcaagaacaagggcgccgccaagaccagaaagaccaccaccacccccggcagaaagcccagaggcagacccaagaagctggagaaggaggaggaggagggcatcagccaggagagcagcgaggaggagcagtag

SEQ ID NO: 84462 - DNA, 291 bp, Artificial Sequence
  Description of Artificial Sequence: Synthetic coding sequence
atgagcgagagcagcagcaagagcagccagcccctggccagcaagcaggagaaggacggcaccgagaagagaggcagaggcagacccagaaagcagccccccaaggagcccagcgaggtgcccacccccaagagacccagaggcagacccaagggcagcaagaacaagggcgccgccaagaccagaaagaccaccaccacccccggcagaaagcccagaggcagacccaagaagctggagaaggaggaggaggagggcatcagccaggagagcagcgaggaggagcagtag

SEQ ID NO: 84463 - DNA, 291 bp, Artificial Sequence; identical to SEQ ID NO: 84462
  Description of Artificial Sequence: Synthetic coding sequence

SEQ ID NO: 84464 - DNA, 324 bp, Artificial Sequence; identical to SEQ ID NO: 84461
  Description of Artificial Sequence: Synthetic coding sequence

SEQ ID NO: 84465 - DNA, 291 bp, Artificial Sequence; identical to SEQ ID NO: 84462
  Description of Artificial Sequence: Synthetic coding sequence

SEQ ID NO: 84466 - DNA, 987 bp, Artificial Sequence
  Description of Artificial Sequence: Synthetic coding sequence
atgagcgagagcagcagcaagagcagccagcccctggccagcaagcaggagaaggacggcaccgagaagagaggcagaggcagacccagaaagcagccccccgtgagccccggcaccgccctggtgggcagccagaaggagcccagcgaggtgcccacccccaagagacccagaggcagacccaagggcagcaagaacaagggcgagggcggcagaggcggccacctggccggcgtgctgggcggcggcgccgtgacccacgcctgcagactgctgctgaccggcggcgccgccagcttctgggactggaccgccctgctgagaagccacagaccccaccccttccccagacccaccatcaccaccgccagcggcagacacccccacctgccccccgtgcccagccccccccactacaccgcccaccagcccctgcagggcagccacggcctgagcggcgagcagttcagccccggcctgagcagccagctgcccccccccacccacgcctacacccacgccctgctggacaaggccaacatccccctgagcagaaccctgcacctgctgagaccccacagcctgggcggcggcgacatcgccctgtgggccttcggcctgggcgcccccagcctgctgctgcactgcagcctgtggctgcccatcgtgggccccggcagagtgcccctggccctgaagggcgcccaggcccccagccaccccggcaccccctacagcaccgccctggccgccgccggcgtggccaacggcggcggctgctggccccccggcttcccccagcccaactgcctgtgccaccacgtgggcctgaccttccaccccagccccaccagcctggtgcccgtgctgggctggaccgcccccttcggctacagaaaggccggcggcgtgagccccctgctgcccctgcactgcggccacagccccctggccctgagactgggcagcgagtacatcctgtggtag

SEQ ID NO: 84467 - DNA, 291 bp, Artificial Sequence; identical to SEQ ID NO: 84462
  Description of Artificial Sequence: Synthetic coding sequence

SEQ ID NO: 84468 - DNA, 324 bp, Artificial Sequence; identical to SEQ ID NO: 84461
  Description of Artificial Sequence: Synthetic coding sequence

SEQ ID NO: 84469 - DNA, 321 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtgggacaacctgctgcccagaaccagcagcaagaagaagaccagcctgggcaacagcaccaagagaagccactag

SEQ ID NO: 84470 - DNA, 357 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggccccagcaggtggtgcagaagaagcccgcccaggtgaacgtggccctgcccggcaaggaccaccccggcaacctgatctacctgctgttcagcaagaacgccacctag

SEQ ID NO: 84471 - DNA, 273 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtgggaggagttctacatcgccgcctag

SEQ ID NO: 84472 - DNA, 330 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggccccagcaggtggtgcagaagaagcccgcccaggaggagaccgaggagaccagcagccaggagagcgccgaggaggactag

SEQ ID NO: 84473 - DNA, 279 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggtggctgctgatgaagagcccctgctggtag

SEQ ID NO: 84474 - DNA, 312 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggctgagagcccaggccctggacagcgacggcctgggcagcaacagcggccccagcctgagctag

SEQ ID NO: 84475 - DNA, 261 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggctgcagaactag

SEQ ID NO: 84476 - DNA, 300 bp, Artificial Sequence
  Description of Artificial Sequence: Synthetic coding sequence
atgagcgccagaggcgagggcgccggccagcccagcaccagcgcccagggccagcccgccgcccccgccccccagaagagaggcagaggcagacccagaaagcagcagcaggagcccaccggcgagcccagccccaagagacccagaggcagacccaagggcagcaagaacaagagccccagcaaggccgcccagaagaaggccgaggccaccggcgagaagagacccagaggcagacccagaaagtggccccagcaggtggtgcagaagaagcccgcccaggtgagacacagccactag

SEQ ID NO: 84477 - DNA, 477 bp, Artificial Sequence
  Description of Artificial Sequence: Synthetic coding sequence
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagaaggccgccaagctgaaggagaagtacgagaagttctag

SEQ ID NO: 84478 - DNA, 648 bp, Artificial Sequence
  Description of Artificial Sequence: Synthetic coding sequence
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagaaggccgccaagctgaaggagaagtacgagaaggacatcgccgcctacagagccaagggcaagcccgacgccgccaagaagggcgtggtgaaggccgagaagagcaagaagaagaaggaggaggaggaggacgaggaggacgaggaggacgaggaggaggaggaggacgaggaggacgaggacgaggaggaggacgacgacgacgagtag

SEQ ID NO: 84479 - DNA, 648 bp, Artificial Sequence; identical to SEQ ID NO: 84478
  Description of Artificial Sequence: Synthetic coding sequence

SEQ ID NO: 84480 - DNA, 294 bp, Artificial Sequence
  Description of Artificial Sequence: Synthetic coding sequence
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagatag

SEQ ID NO: 84481 - DNA, 477 bp, Artificial Sequence; identical to SEQ ID NO: 84477
  Description of Artificial Sequence: Synthetic coding sequence

SEQ ID NO: 84482 - DNA, 648 bp, Artificial Sequence; identical to SEQ ID NO: 84478
  Description of Artificial Sequence: Synthetic coding sequence

SEQ ID NO: 84483 - DNA, 648 bp, Artificial Sequence; identical to SEQ ID NO: 84478
  Description of Artificial Sequence: Synthetic coding sequence

SEQ ID NO: 84484 - DNA, 489 bp, Artificial Sequence
  Description of Artificial Sequence: Synthetic coding sequence
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagatcctgctgcacatcgagctgaaggagagcctgatgcagcagaagagatag

SEQ ID NO: 84485 - DNA, 630 bp, Artificial Sequence
  Description of Artificial Sequence: Synthetic coding sequence
atgggcaagggcgaccccaacaagcccagaggcaagatgagcagctacgccttcttcgtgcagacctgcagagaggagcacaagaagaagcaccccgacagcagcgtgaacttcgccgagttcagcaagaagtgcagcgagagatggaagaccatgagcgccaaggagaagagcaagttcgaggacatggccaagagcgacaaggccagatacgacagagagatgaagaactacgtgccccccaagggcgacaagaagggcaagaagaaggaccccaacgcccccaagagaccccccagcgccttcttcctgttctgcagcgagcacagacccaagatcaagagcgagcaccccggcctgagcatcggcgacaccgccaagaagctgggcgagatgtggagcgagcagagcgccaaggacaagcagccctacgagcagaaggccgccaagctgaaggagaagtacgagaaggacatcgccgcctacagagccaagggcaagagcgaggccggcaagaagggccccggcagacccaccggcagcaagaagaagaacgagcccgaggacgaggaggaggaggaggaggaggaggacgaggacgaggaggaggaggacgaggacgaggagtag

SEQ ID NO: 84486 - DNA, 630 bp, Artificial Sequence; identical to SEQ ID NO: 84485
  Description of Artificial Sequence: Synthetic coding sequence

SEQ ID NO: 84487 - DNA, 630 bp, Artificial Sequence; identical to SEQ ID NO: 84485
  Description of Artificial Sequence: Synthetic coding sequence

SEQ ID NO: 84488 - DNA, 405 bp, Artificial Sequence
  Description of Artificial Sequence: Synthetic coding sequence
atgggcaagggcgaccccaacaagcccagaggcaagatgagcagctacgccttcttcgtgcagacctgcagagaggagcacaagaagaagcaccccgacagcagcgtgaacttcgccgagttcagcaagaagtgcagcgagagatggaagaccatgagcgccaaggagaagagcaagttcgaggacatggccaagagcgacaaggccagatacgacagagagatgaagaactacgtgccccccaagggcgacaagaagggcaagaagaaggaccccaacgcccccaagagaccccccagcgccttcttcctgttctgcagcgagcacagacccaagatcaagagcgagcaccccggcctgagcatcggcgacaccgccaagaagctgggcgagatgtggagctag

SEQ ID NO: 84489 - DNA, 603 bp, Artificial Sequence
  Description of Artificial Sequence: Synthetic coding sequence
atggccaagggcgaccccaagaagcccaagggcaagatgagcgcctacgccttcttcgtgcagacctgcagagaggagcacaagaagaagaaccccgaggtgcccgtgaacttcgccgagttcagcaagaagtgcagcgagagatggaagaccatgagcggcaaggagaagagcaagttcgacgagatggccaaggccgacaaggtgagatacgacagagagatgaaggactacggccccgccaagggcggcaagaagaagaaggaccccaacgcccccaagagaccccccagcggcttcttcctgttctgcagcgagttcagacccaagatcaagagcaccaaccccggcatcagcatcggcgacgtggccaagaagctgggcgagatgtggaacaacctgaacgacagcgagaagcagccctacatcaccaaggccgccaagctgaaggagaagtacgagaaggacgtggccgactacaagagcaagggcaagttcgacggcgccaagggccccgccaaggtggccagaaagaaggtggaggaggaggacgaggaggaggaggaggaggaggaggaggaggaggaggaggaggacgagtag

SEQ ID NO: 84490 - DNA, 567 bp, Artificial Sequence
  Description of Artificial Sequence: Synthetic coding sequence
atggccaagggcgaccccaagaagcccaagggcaagatgagcgcctacgccttcttcgtgcagacctgcagagaggagcacaagaagaagaaccccgaggtgcccgtgaacttcgccgagttcagcaagaagtgcagcgagagatggaagaccatgagcggcaaggagaagagcaagttcgacgagatggccaaggccgacaaggtgagatacgacagagagatgaaggactacggccccgccaagggcggcaagaagaagaaggaccccaacgcccccaagagaccccccagcggcttcttcctgttctgcagcgagttcagacccaagatcaagagcaccaaccccggcatcagcatcggcgacgtggccaagaagctgggcgagatgtggaacaacctgaacgacagcgagaagcagccctacatcaccaaggccgccaagctgaaggagaagtacgagaaggacgtggccgactacaagagcaagggcaagttcgacggcgccaagggccccgccaaggtggccagaaagaaggtggaggaggaggacgaggaggaggagtag

SEQ ID NO: 84491 - DNA, 462 bp, Artificial Sequence
  Description of Artificial Sequence: Synthetic coding sequence
atggccaagggcgaccccaagaagcccaagggcaagatgagcgcctacgccttcttcgtgcagacctgcagagaggagcacaagaagaagaaccccgaggtgcccgtgaacttcgccgagttcagcaagaagtgcagcgagagatggaagaccatgagcggcaaggagaagagcaagttcgacgagatggccaaggccgacaaggtgagatacgacagagagatgaaggactacggccccgccaagggcggcaagaagaagaaggaccccaacgcccccaagagaccccccagcggcttcttcctgttctgcagcgagttcagacccaagatcaagagcaccaaccccggcatcagcatcggcgacgtggccaagaagctgggcgagatgtggaacaacctgaacgacagcgagaagcagccctacatcaccaaggccgccaagctgaaggagaagtactag

SEQ ID NO: 84492 - DNA, 603 bp, Artificial Sequence; identical to SEQ ID NO: 84489
  Description of Artificial Sequence: Synthetic coding sequence

SEQ ID NO: 84493 - DNA, 582 bp, Artificial Sequence
  Description of Artificial Sequence: Synthetic coding sequence
atggccaagggcgaccccaagaagcccaagggcaagatgagcgcctacgccttcttcgtgcagacctgcagagaggagcacaagaagaagaaccccgaggtgcccgtgaacttcgccgagttcagcaagaagtgcagcgagagatggaagaccatgagcggcaaggagaagagcaagttcgacgagatggccaaggccgacaaggtgagatacgacagagagatgaaggactacggccccgccaagggcggcaagaagaagaaggaccccaacgcccccaagagaccccccagcggcttcttcctgttctgcagcgagttcagacccaagatcaagagcaccaaccccggcatcagcatcggcgacgtggccaagaagctgggcgagatgtggaacaacctgaacgacagcgagaagcagccctacatcaccaaggccgccaagctgaaggagaagtacgagaaggacgtggccgactacaagagcaagggcaagttcgacggcgccaagggccccgccaaggtggccagaaagaaggtggaggaggaggacgaggaggaggaggaggaggaggaggagtag

SEQ ID NO: 84494 - DNA, 273 bp, Artificial Sequence
  Description of Artificial Sequence: Synthetic coding sequence
atgcccaagagaaaggccgagggcgacgccaagggcgacaaggccaaggtgaaggacgagccccagagaagaagcgccagactgagcgccaagcccgccccccccaagcccgagcccaagcccaagaaggcccccgccaagaagggcgagaaggtgcccaagggcaagaagggcaaggccgacgccggcaaggagggcaacaaccccgccgagaacggcgacgccaagaccgaccaggcccagaaggccgagggcgccggcgacgccaagtag

SEQ ID NO: 84495 - DNA, 234 bp, Artificial Sequence
  Description of Artificial Sequence: Synthetic coding sequence
atgcccaagagaaagagccccgagaacaccgagggcaaggacggcagcaaggtgaccaagcaggagcccaccagaagaagcgccagactgagcgccaagcccgccccccccaagcccgagcccaagcccagaaagaccagcgccaagaaggagcccggcgccaagatcagcagaggcgccaagggcaagaaggaggagaagcaggaggccggcaaggagggcaccgagaactag

SEQ ID NO: 84496 - DNA, 300 bp, Artificial Sequence
  Description of Artificial Sequence: Synthetic coding sequence
atgcccaagagaaagagccccgagaacaccgagggcaaggacggcagcaaggtgaccaagcaggagcccaccagaagaagcgccagactgagcgccaagcccgccccccccaagcccgagcccaagcccagaaagaccagcgccaagaaggagcccggcgccaagatcagcagaggcgccaagggcaagaaggaggagaagcaggaggccggcaaggagggcaccgcccccagcgagaacggcgagaccaaggccgaggaggcccagaagaccgagagcgtggacaacgagggcgagtag

SEQ ID NO: 84497 - DNA, 507 bp, Artificial Sequence
  Description of Artificial Sequence: Synthetic coding sequence
atggtgctgttcttcagaatcaacctgcagaccaagaagtgcaagcagaagggcaagggcgagcagagagagaacagacccaagtggctgaccaagaagctgaagaagacctacctgagaaagaccggcaagagaagactgagaagagtgcagcccctgatgaagcaggagagaaagaagcccagcctgatcaacaaccacatcccctgcctgatcagcggcccctgcctgcccagctgcaccatccagagaaacatcttcatcaactacttcgtgaacgccagcttcctggtggccctggagaccttcctgagaagaagagagagccacctgatccccttcttcaagtgcaagtgcttcttcctgagaggcgagatcatctgctggctgttcatcttctggtacaaccagaagatcgtgtgggacatcgagctgtgggaggccctgaccgtgagcggcgtgagcctgaccttccacagatggggcgtgagcttctacatcctgtag

SEQ ID NO: 84498 - DNA, 303 bp, Artificial Sequence
  Description of Artificial Sequence: Synthetic coding sequence
atgcccaagagaaaggtgagcagcgccgagggcgccgccaaggaggagcccaagagaagaagcgccagactgagcgccaagccccccgccaaggtggaggccaagcccaagaaggccgccgccaaggacaagagcagcgacaagaaggtgcagaccaagggcaagagaggcgccaagggcaagcaggccgaggtggccaaccaggagaccaaggaggacctgcccgccgagaacggcgagaccaagaccgaggagagccccgccagcgacgaggccggcgagaaggaggccaagagcgactag

SEQ ID NO: 84499 - DNA, 582 bp, Artificial Sequence
  Description of Artificial Sequence: Synthetic coding sequence
atgggcaagcagaacagcaagctgagacccgagatgctgcaggacctgagagagaacaccgagttcagcgagctggagctgcaggagtggtacaagggcttcctgaaggactgccccaccggcatcctgaacgtggacgagttcaagaagatctacgccaacttcttcccctacggcgacgccagcaagttcgccgagcacgtgttcagaaccttcgacaccaacagcgacggcaccatcgacttcagagagttcatcatcgccctgagcgtgaccagcagaggcagactggagcagaagctgatgtgggccttcagcatgtacgacctggacggcaacggctacatcagcagagaggagatgctggagatcgtgcaggccatctacaagatggtgagcagcgtgatgaagatgcccgaggacgagagcacccccgagaagagaaccgagaagatcttcagacagatggacaccaacaacgacggcaagctgagcctggaggagttcatcagaggcgccaagagcgaccccagcatcgtgagactgctgcagtgcgaccccagcagcgccagccagttctag

SEQ ID NO: 84500 - DNA, 582 bp, Artificial Sequence
  Description of Artificial Sequence: Synthetic coding sequence
atgggcaagcagaacagcaagctgagacccgaggtgctgcaggacctgagagagaacaccgagttcaccgaccacgagctgcaggagtggtacaagggcttcctgaaggactgccccaccggccacctgaccgtggacgagttcaagaagatctacgccaacttcttcccctacggcgacgccagcaagttcgccgagcacgtgttcagaaccttcgacaccaacggcgacggcaccatcgacttcagagagttcatcatcgccctgagcgtgaccagcagaggcaagctggagcagaagctgaagtgggccttcagcatgtacgacctggacggcaacggctacatcagcagaagcgagatgctggagatcgtgcaggccatctacaagatggtgagcagcgtgatgaagatgcccgaggacgagagcacccccgagaagagaaccgacaagatcttcagacagatggacaccaacaacgacggcaagctgagcctggaggagttcatcagaggcgccaagagcgaccccagcatcgtgagactgctgcagtgcgaccccagcagcgccagccagttctag

SEQ ID NO: 84501 - DNA, 582 bp, Artificial Sequence; identical to SEQ ID NO: 84500
  Description of Artificial Sequence: Synthetic coding sequence

SEQ ID NO: 84502 - DNA, 93 bp, Artificial Sequence
  Description of Artificial Sequence: Synthetic coding sequence
atgggcaagcagaacagcaagctgagacccgaggtgctgcaggacctgagagagaacaccgagttcaccgaccacgagctgcaggagtggtag

SEQ ID NO: 84503 - DNA, 3054 bp, Artificial Sequence
  Description of Artificial Sequence: Synthetic coding sequence
atgaagctgctgaagcccacctgggtgaaccacaacggcaagcccatcttcagcgtggacatccaccccgacggcaccaagttcgccaccggcggccagggccaggacagcggcaaggtggtgatctggaacatgagccccgtgctgcaggaggacgacgagaaggacgagaacatccccaagatgctgtgccagatggacaaccacctggcctgcgtgaactgcgtgagatggagcaacagcggcatgtacctggccagcggcggcgacgacaagctgatcatggtgtggaagagagccacctacatcggccccagcaccgtgttcggcagcagcggcaagctggccaacgtggagcagtggagatgcgtgagcatcctgagaaaccacagcggcgacgtgatggacgtggcctggagcccccacgacgcctggctggccagctgcagcgtggacaacaccgtggtgatctggaacgccgtgaagttccccgagatcctggccaccctgagaggccacagcggcctggtgaagggcctgacctgggaccccgtgggcaagtacatcgccagccaggccgacgacagaagcctgaaggtgtggagaaccctggactggcagctggagaccagcatcaccaagcccttcgacgagtgcggcggcaccacccacgtgctgagactgagctggagccccgacggccactacctggtgagcgcccacgccatgaacaacagcggccccaccgcccagatcatcgagagagagggctggaagaccaacatggacttcgtgggccacagaaaggccgtgaccgtggtgaagttcaaccccaagatcttcaagaagaagcagaagaacggcagcagcgccaagcccagctgcccctactgctgctgcgccgtgggcagcaaggacagaagcctgagcgtgtggctgacctgcctgaagagacccctggtggtgatccacgagctgttcgacaagagcatcatggacatcagctggaccctgaacggcctgggcatcctggtgtgcagcatggacggcagcgtggccttcctggacttcagccaggacgagctgggcgaccccctgagcgaggaggagaagagcagaatccaccagagcacctacggcaagagcctggccatcatgaccgaggcccagctgagcaccgccgtgatcgagaaccccgagatgctgaagtaccagagaagacagcagcagcagcagctggaccagaagagcgccgccaccagagagatgggcagcgccaccagcgtggccggcgtggtgaacggcgagagcctggaggacatcagaaagaacctgctgaagaagcaggtggagaccagaaccgccgacggcagaagaagaatcacccccctgtgcatcgcccagctggacaccggcgacttcagcaccgccttcttcaacagcatccccctgagcggcagcctggccggcaccatgctgagcagccacagcagcccccagctgctgcccctggacagcagcacccccaacagcttcggcgccagcaagccctgcaccgagcccgtggtggccgccagcgccagacccgccggcgacagcgtgaacaaggacagcatgaacgccaccagcacccccgccgccctgagccccagcgtgctgaccacccccagcaagatcgagcccatgaaggccttcgacagcagattcaccgagagaagcaaggccacccccggcgcccccgccctgaccagcatgacccccaccgccgtggagagactgaaggagcagaacctggtgaaggagctgagacccagagacctgctggagagcagcagcgacagcgacgagaaggtgcccctggccaaggccagcagcctgagcaagagaaagctggagctggaggtggagaccgtggagaagaagaagaagggcagacccagaaaggacagcagactgatgcccgtgagcctgagcgtgcagagccccgccgccctgaccgccgagaaggaggccatgtgcctgagcgcccccgccctggccctgaagctgcccatccccagcccccagagagccttcaccctgcaggtgagcagcgaccccagcatgtacatcgaggtggagaacgaggtgaccgtggtgggcggcgtgaagctgagcagactgaagtgcaacagagagggcaaggagtgggagaccgtgctgaccagcagaatcctgaccgccgccggcagctgcgacgtggtgtgcgtggcctgcgagaagagaatgctgagcgtgttcagcacctgcggcagaagactgctgagccccatcctgctgcccagccccatcagcaccctgcactgcaccggcagctacgtgatggccctgaccgccgccgccaccctgagcgtgtgggacgtgcacagacaggtggtggtggtgaaggaggagagcctgcacagcatcctggccggcagcgacatgaccgtgagccagatcctgctgacccagcacggcatccccgtgatgaacctgagcgacggcaaggcctactgcttcaaccccagcctgagcacctggaacctggtgagcgacaagcaggacagcctggcccagtgcgccgacttcagaagcagcctgcccagccaggacgccatgctgtgcagcggccccctggccatcatccagggcagaaccagcaacagcggcagacaggccgccagactgttcagcgtgccccacgtggtgcagcaggagaccaccctggcctacctggagaaccaggtggccgccgccctgaccctgcagagcagccacgagtacagacactggctgctggtgtacgccagatacctggtgaacgagggcttcgagtacagactgagagagatctgcaaggacctgctgggccccgtgcactacagcaccggcagccagtgggagagcaccgtggtgggcctgagaaagagagagctgctgaaggagctgctgcccgtgatcggccagaacctgagattccagagactgttcaccgagtgccaggagcagctggacatcctgagagacaagtag

SEQ ID NO: 84504 - DNA, 2433 bp, Artificial Sequence
  Description of Artificial Sequence: Synthetic coding sequence
atgaagctgctgaagcccacctgggtgaaccacaacggcaagcccatcttcagcgtggacatccaccccgacggcaccaagttcgccaccggcggccagggccaggacagcggcaaggtggtgatctggaacatgagccccgtgctgcaggaggacgacgagaaggacgagaacatccccaagatgctgtgccagatggacaaccacctggcctgcgtgaactgcgtgagatggagcaacagcggcatgtacctggccagcggcggcgacgacaagctgatcatggtgtggaagagagccacctacatcggccccagcaccgtgttcggcagcagcggcaagctggccaacgtggagcagtggagatgcgtgagcatcctgagaaaccacagcggcgacgtgatggacgtggcctggagcccccacgacgcctggctggccagctgcagcgtggacaacaccgtggtgatctggaacgccgtgaagttccccgagatcctggccaccctgagaggccacagcggcctggtgaagggcctgacctgggaccccgtgggcaagtacatcgccagccaggccgacgacagaagcctgaaggtgtggagaaccctggactggcagctggagaccagcatcaccaagcccttcgacgagtgcggcggcaccacccacgtgctgagactgagctggagccccgacggccactacctggtgagcgcccacgccatgaacaacagcggccccaccgcccagatcatcgagagagagggctggaagaccaacatggacttcgtgggccacagaaaggccgtgaccgtggtgaagttcaaccccaagatcttcaagaagaagcagaagaacggcagcagcgccaagcccagctgcccctactgctgctgcgccgtgggcagcaaggacagaagcctgagcgtgtggctgacctgcctgaagagacccctggtggtgatccacgagctgttcgacaagagcatcatggacatcagctggaccctgaacggcctgggcatcctggtgtgcagcatggacggcagcgtggccttcctggacttcagccaggacgagctgggcgaccccctgagcgaggaggagaagagcagaatccaccagagcacctacggcaagagcctggccatcatgaccgaggcccagctgagcaccgccgtgatcgagaaccccgagatgctgaagtaccagagaagacagcagcagcagcagctggaccagaagagcgccgccaccagagagatgggcagcgccaccagcgtggccggcgtggtgaacggcgagagcctggaggacatcagaaagaacctgctgaagaagcaggtggagaccagaaccgccgacggcagaagaagaatcacccccctgtgcatcgcccagctggacaccggcgacttcagcaccgccttcttcaacagcatccccctgagcggcagcctggccggcaccatgctgagcagccacagcagcccccagctgctgcccctggacagcagcacccccaacagcttcggcgccagcaagccctgcaccgagcccgtggtggccgccagcgccagacccgccggcgacagcgtgaacaaggacagcatgaacgccaccagcacccccgccgccctgagccccagcgtgctgaccacccccagcaagatcgagcccatgaaggccttcgacagcagattcaccgagagaagcaaggccacccccggcgcccccgccctgaccagcatgacccccaccgccgtggagagagacgtgcacagacaggtggtggtggtgaaggaggagagcctgcacagcatcctggccggcagcgacatgaccgtgagccagatcctgctgacccagcacggcatccccgtgatgaacctgagcgacggcaaggcctactgcttcaaccccagcctgagcacctggaacctggtgagcgacaagcaggacagcctggcccagtgcgccgacttcagaagcagcctgcccagccaggacgccatgctgtgcagcggccccctggccatcatccagggcagaaccagcaacagcggcagacaggccgccagactgttcagcgtgccccacgtggtgcagcaggagaccaccctggcctacctggagaaccaggtggccgccgccctgaccctgcagagcagccacgagtacagacactggctgctggtgtacgccagatacctggtgaacgagggcttcgagtacagactgagagagatctgcaaggacctgctgggccccgtgcactacagcaccggcagccagtgggagagcaccgtggtgggcctgagaaagagagagctgctgaaggagctgctgcccgtgatcggccagaacctgagattccagagactgttcaccgagtgccaggagcagctggacatcctgagagacaagtag

SEQ ID NO: 84505 - DNA, 1815 bp, Artificial Sequence
  Description of Artificial Sequence: Synthetic coding sequence
atgctgagcagccacagcagcccccagctgctgcccctggacagcagcacccccaacagcttcggcgccagcaagccctgcaccgagcccgtggtggccgccagcgccagacccgccggcgacagcgtgaacaaggacagcatgaacgccaccagcacccccgccgccctgagccccagcgtgctgaccacccccagcaagatcgagcccatgaaggccttcgacagcagattcaccgagagaagcaaggccacccccggcgcccccgccctgaccagcatgacccccaccgccgtggagagactgaaggagcagaacctggtgaaggagctgagacccagagacctgctggagagcagcagcgacagcgacgagaaggtgcccctggccaaggccagcagcctgagcaagagaaagctggagctggaggtggagaccgtggagaagaagaagaagggcagacccagaaaggacagcagactgatgcccgtgagcctgagcgtgcagagccccgccgccctgaccgccgagaaggaggccatgtgcctgagcgcccccgccctggccctgaagctgcccatccccagcccccagagagccttcaccctgcaggtgagcagcgaccccagcatgtacatcgaggtggagaacgaggtgaccgtggtgggcggcgtgaagctgagcagactgaagtgcaacagagagggcaaggagtgggagaccgtgctgaccagcagaatcctgaccgccgccggcagctgcgacgtggtgtgcgtggcctgcgagaagagaatgctgagcgtgttcagcacctgcggcagaagactgctgagccccatcctgctgcccagccccatcagcaccctgcactgcaccggcagctacgtgatggccctgaccgccgccgccaccctgagcgtgtgggacgtgcacagacaggtggtggtggtgaaggaggagagcctgcacagcatcctggccggcagcgacatgaccgtgagccagatcctgctgacccagcacggcatccccgtgatgaacctgagcgacggcaaggcctactgcttcaaccccagcctgagcacctggaacctggtgagcgacaagcaggacagcctggcccagtgcgccgacttcagaagcagcctgcccagccaggacgccatgctgtgcagcggccccctggccatcatccagggcagaaccagcaacagcggcagacaggccgccagactgttcagcgtgccccacgtggtgcagcaggagaccaccctggcctacctggagaaccaggtggccgccgccctgaccctgcagagcagccacgagtacagacactggctgctggtgtacgccagatacctggtgaacgagggcagcgccgaggagggcgccgccgagggcgccgccaccagccacagagccgagccccccatccccgcccccctgcacagagtgagcggcaccgccagacaccccgagggccaggtggcctgccccagcctgccctggctgcagcagggccagggccacaccctggccgccgacgacatgcaggacagactgagccccgaccaggccgtgggcggcggcgacaccggcagaagatgcgccgtgctgcaccagagacagcccagcagcctgggcagatgcgccctgtgccccggcagcgacatcgccagcggcggcggcagcagcagcctgccccccagccccagatgcggcgccagagccggcgccctgcccagatgccccggcgccagcaaggccgtgcccggcctgcccagccccgccagaccccagggcggccactag

SEQ ID NO: 84506 - DNA, 2922 bp, Artificial Sequence
  Description of Artificial Sequence: Synthetic coding sequence
atgagccccgtgctgcaggaggacgacgagaaggacgagaacatccccaagatgctgtgccagatggacaaccacctggcctgcgtgaactgcgtgagatggagcaacagcggcatgtacctggccagcggcggcgacgacaagctgatcatggtgtggaagagagccacctacatcggccccagcaccgtgttcggcagcagcggcaagctggccaacgtggagcagtggagatgcgtgagcatcctgagaaaccacagcggcgacgtgatggacgtggcctggagcccccacgacgcctggctggccagctgcagcgtggacaacaccgtggtgatctggaacgccgtgaagttccccgagatcctggccaccctgagaggccacagcggcctggtgaagggcctgacctgggaccccgtgggcaagtacatcgccagccaggccgacgacagaagcctgaaggtgtggagaaccctggactggcagctggagaccagcatcaccaagcccttcgacgagtgcggcggcaccacccacgtgctgagactgagctggagccccgacggccactacctggtgagcgcccacgccatgaacaacagcggccccaccgcccagatcatcgagagagagggctggaagaccaacatggacttcgtgggccacagaaaggccgtgaccgtggtgaagttcaaccccaagatcttcaagaagaagcagaagaacggcagcagcgccaagcccagctgcccctactgctgctgcgccgtgggcagcaaggacagaagcctgagcgtgtggctgacctgcctgaagagacccctggtggtgatccacgagctgttcgacaagagcatcatggacatcagctggaccctgaacggcctgggcatcctggtgtgcagcatggacggcagcgtggccttcctggacttcagccaggacgagctgggcgaccccctgagcgaggaggagaagagcagaatccaccagagcacctacggcaagagcctggccatcatgaccgaggcccagctgagcaccgccgtgatcgagaaccccgagatgctgaagtaccagagaagacagcagcagcagcagctggaccagaagagcgccgccaccagagagatgggcagcgccaccagcgtggccggcgtggtgaacggcgagagcctggaggacatcagaaagaacctgctgaagaagcaggtggagaccagaaccgccgacggcagaagaagaatcacccccctgtgcatcgcccagctggacaccggcgacttcagcaccgccttcttcaacagcatccccctgagcggcagcctggccggcaccatgctgagcagccacagcagcccccagctgctgcccctggacagcagcacccccaacagcttcggcgccagcaagccctgcaccgagcccgtggtggccgccagcgccagacccgccggcgacagcgtgaacaaggacagcatgaacgccaccagcacccccgccgccctgagccccagcgtgctgaccacccccagcaagatcgagcccatgaaggccttcgacagcagattcaccgagagaagcaaggccacccccggcgcccccgccctgaccagcatgacccccaccgccgtggagagactgaaggagcagaacctggtgaaggagctgagacccagagacctgctggagagcagcagcgacagcgacgagaaggtgcccctggccaaggccagcagcctgagcaagagaaagctggagctggaggtggagaccgtggagaagaagaagaagggcagacccagaaaggacagcagactgatgcccgtgagcctgagcgtgcagagccccgccgccctgaccgccgagaaggaggccatgtgcctgagcgcccccgccctggccctgaagctgcccatccccagcccccagagagccttcaccctgcaggtgagcagcgaccccagcatgtacatcgaggtggagaacgaggtgaccgtggtgggcggcgtgaagctgagcagactgaagtgcaacagagagggcaaggagtgggagaccgtgctgaccagcagaatcctgaccgccgccggcagctgcgacgtggtgtgcgtggcctgcgagaagagaatgctgagcgtgttcagcacctgcggcagaagactgctgagccccatcctgctgcccagccccatcagcaccctgcactgcaccggcagctacgtgatggccctgaccgccgccgccaccctgagcgtgtgggacgtgcacagacaggtggtggtggtgaaggaggagagcctgcacagcatcctggccggcagcgacatgaccgtgagccagatcctgctgacccagcacggcatccccgtgatgaacctgagcgacggcaaggcctactgcttcaaccccagcctgagcacctggaacctggtgagcgacaagcaggacagcctggcccagtgcgccgacttcagaagcagcctgcccagccaggacgccatgctgtgcagcggccccctggccatcatccagggcagaaccagcaacagcggcagacaggccgccagactgttcagcgtgccccacgtggtgcagcaggagaccaccctggcctacctggagaaccaggtggccgccgccctgaccctgcagagcagccacgagtacagacactggctgctggtgtacgccagatacctggtgaacgagggcttcgagtacagactgagagagatctgcaaggacctgctgggccccgtgcactacagcaccggcagccagtgggagagcaccgtggtgggcctgagaaagagagagctgctgaaggagctgctgcccgtgatcggccagaacctgagattccagagactgttcaccgagtgccaggagcagctggacatcctgagagacaagtag

SEQ ID NO: 84507 - DNA, 2421 bp, Artificial Sequence
  Description of Artificial Sequence: Synthetic coding sequence
atgagccccgtgctgcaggaggacgacgagaaggacgagaacatccccaagatgctgtgccagatggacaaccacctggcctgcgtgaactgcgtgagatggagcaacagcggcatgtacctggccagcggcggcgacgacaagctgatcatggtgtggaagagagccacctacatcggccccagcaccgtgttcggcagcagcggcaagctggccaacgtggagcagtggagatgcgtgagcatcctgagaaaccacagcggcgacgtgatggacgtggcctggagcccccacgacgcctggctggccagctgcagcgtggacaacaccgtggtgatctggaacgccgtgaagttccccgagatcctggccaccctgagaggccacagcggcctggtgaagggcctgacctgggaccccgtgggcaagtacatcgccagccaggccgacgacagaagcctgaaggtgtggagaaccctggactggcagctggagaccagcatcaccaagcccttcgacgagtgcggcggcaccacccacgtgctgagactgagctggagccccgacggccactacctggtgagcgcccacgccatgaacaacagcggccccaccgcccagatcatcgagagagagggctggaagaccaacatggacttcgtgggccacagaaaggccgtgaccgtggtgaagttcaaccccaagatcttcaagaagaagcagaagaacggcagcagcgccaagcccagctgcccctactgctgctgcgccgtgggcagcaaggacagaagcctgagcgtgtggctgacctgcctgaagagacccctggtggtgatccacgagctgttcgacaagagcatcatggacatcagctggaccctgaacggcctgggcatcctggtgtgcagcatggacggcagcgtggccttcctggacttcagccaggacgagctgggcgaccccctgagcgaggaggagaagagcagaatccaccagagcacctacggcaagagcctggccatcatgaccgaggcccagctgagcaccgccgtgatcgagaaccccgagatgctgaagtaccagagaagacagcagcagcagcagctggaccagaagagcgccgccaccagagagatgggcagcgccaccagcgtggccggcgtggtgaacggcgagagcctggaggacatcagaaagaacctgctgaagaagcaggtggagaccagaaccgccgacggcagaagaagaatcacccccctgtgcatcgcccagctggacaccggcgacttcagcaccgccttcttcaacagcatccccctgagcggcagcctggccggcaccatgctgagcagccacagcagcccccagctgctgcccctggacagcagcacccccaacagcttcggcgccagcaagccctgcaccgagcccgtggtggccgccagcgccagacccgccggcgacagcgtgaacaaggacagcatgaacgccaccagcacccccgccgccctgagccccagcgtgctgaccacccccagcaagatcgagcccatgaaggccttcgacagcagattcaccgagagaagcaaggccacccccggcgcccccgccctgaccagcatgacccccaccgccgtggagagactgaaggagcagaacctggtgaaggagctgagacccagagacctgctggagagcagcagcgacagcgacgagaaggtgcccctggccaaggccagcagcctgagcaagagaaagctggagctggaggtggagaccgtggagaagaagaagaagggcagacccagaaaggacagcagactgatgcccgtgagcctgagcgtgcagagccccgccgccctgaccgccgagaaggaggccatgtgcctgagcgcccccgccctggccctgaagctgcccatccccagcccccagagagccttcaccctgcaggtgagcagcgaccccagcatgtacatcgaggtggagaacgaggtgaccgtggtgggcggcgtgaagctgagcagactgaagtgcaacagagagggcaaggagtgggagaccgtgctgaccagcagaatcctgaccgccgccggcagctgcgacgtggtgtgcgtggcctgcgagaagagaatgctgagcgtgttcagcacctgcggcagaagactgctgagccccatcctgctgcccagccccatcagcaccctgcactgcaccggcagctacgtgatggccctgaccgccgccgccaccctgagcgtgtgggacgtgcacagacaggtggtggtggtgaaggaggagagcctgcacagcatcctggccggcacctggttcctgaccagcagaacccactggctgagcgtgcagaccctgggcgccgcctgccaccccagaaccccctgctgcgcccaggacagatag

SEQ ID NO: 84508 - DNA, 156 bp, Artificial Sequence
  Description of Artificial Sequence: Synthetic coding sequence
atggccagcagcatgagaagcctgttcagcgaccacggcaagtacgtggagagcttcagaagattcctgaaccacagcaccgagcaccagtgcatgcaggagttcatggacaagaagctgcccggcatcatcggcagataccagaactgctgctag

SEQ ID NO: 84509 - DNA, 879 bp, Artificial Sequence
  Description of Artificial Sequence: Synthetic coding sequence
atggccagcagcatgagaagcctgttcagcgaccacggcaagtacgtggagagcttcagaagattcctgaaccacagcaccgagcaccagtgcatgcaggagttcatggacaagaagctgcccggcatcatcggcagaatcggcgacaccaagagcgagatcaagatcctgagcatcggcggcggcgccggcgagatcgacctgcagatcctgagcaaggtgcaggcccagtaccccggcgtgtgcatcaacaacgaggtggtggagcccagcgccgagcagatcgccaagtacaaggagctggtggccaagaccagcaacctggagaacgtgaagttcgcctggcacaaggagaccagcagcgagtaccagagcagaatgctggagaagaaggagctgcagaagtgggacttcatccacatgatccagatgctgtactacgtgaaggacatccccgccaccctgaagttcttccacagcctgctgggcaccaacgccaagatgctgatcatcgtggtgagcggcagcagcggctgggacaagctgtggaagaagtacggcagcagattcccccaggacgacctgtgccagtacatcaccagcgacgacctgacccagatgctggacaacctgggcctgaagtacgagtgctacgacctgctgagcaccatggacatcagcgactgcttcatcgacggcaacgagaacggcgacctgctgtgggacttcctgaccgagacctgcaacttcaacgccaccgccccccccgacctgagagccgagctgggcaaggacctgcaggagcccgagttcagcgccaagaaggagggcaaggtgctgttcaacaacaccctgagcttcatcgtgatcgaggcctag

SEQ ID NO: 84510 - DNA, 381 bp, Artificial Sequence
  Description of Artificial Sequence: Synthetic coding sequence
atggccagcagcatgagaagcctgttcagcgaccacggcaagtacgtggagagcttcagaagattcctgaaccacagcaccgagcaccagtgcatgcaggagttcatggacaagaagctgcccggcatcatcggcagaatcggcgacaccaagagcgagatcaagatcctgagcatcggcggcggcgccgactgcctgatcagaggcagcagcagagtgctgaagagaaacagctgcttcatcctgtgcagcaccagacagaaggacaagcccggcatgagaatccacgacgagagaagcagcgagctgcccttcggcgccgccagactggagagcaagagcgccttccccagcttcctggtgagcttcatcctgttctag

SEQ ID NO: 84511 - DNA, 879 bp, Artificial Sequence; identical to SEQ ID NO: 84509
  Description of Artificial Sequence: Synthetic coding sequence

SEQ ID NO: 84512 - DNA, 1464 bp, Artificial Sequence
  Description of Artificial Sequence: Synthetic coding sequence
atgagcctgcccaacagcagctgcctgctggaggacaagatgtgcgagggcaacaagaccaccatggccagcccccagctgatgcccctggtggtggtgctgagcaccatctgcctggtgaccgtgggcctgaacctgctggtgctgtacgccgtgagaagcgagagaaagctgcacaccgtgggcaacctgtacatcgtgagcctgagcgtggccgacctgatcgtgggcgccgtggtgatgcccatgaacatcctgtacctgctgatgagcaagtggagcctgggcagacccctgtgcctgttctggctgagcatggactacgtggccagcaccgccagcatcttcagcgtgttcatcctgtgcatcgacagatacagaagcgtgcagcagcccctgagatacctgaagtacagaaccaagaccagagccagcgccaccatcctgggcgcctggttcctgagcttcctgtgggtgatccccatcctgggctggaaccacttcatgcagcagaccagcgtgagaagagaggacaagtgcgagaccgacttctacgacgtgacctggttcaaggtgatgaccgccatcatcaacttctacctgcccaccctgctgatgctgtggttctacgccaagatctacaaggccgtgagacagcactgccagcacagagagctgatcaacagaagcctgcccagcttcagcgagatcaagctgagacccgagaaccccaagggcgacgccaagaagcccggcaaggagagcccctgggaggtgctgaagagaaagcccaaggacgccggcggcggcagcgtgctgaagagccccagccagacccccaaggagatgaagagccccgtggtgttcagccaggaggacgacagagaggtggacaagctgtactgcttccccctggacatcgtgcacatgcaggccgccgccgagggcagcagcagagactacgtggccgtgaacagaagccacggccagctgaagaccgacgagcagggcctgaacacccacggcgccagcgagatcagcgaggaccagatgctgggcgacagccagagcttcagcagaaccgacagcgacaccaccaccgagaccgcccccggcaagggcaagctgagaagcggcagcaacaccggcctggactacatcaagttcacctggaagagactgagaagccacagcagacagtacgtgagcggcctgcacatgaacagagagagaaaggccgccaagcagctgggcttcatcatggccgccttcatcctgtgctggatcccctacttcatcttcttcatggtgatcgccttctgcaagaactgctgcaacgagcacctgcacatgttcaccatctggctgggctacatcaacagcaccctgaaccccctgatctaccccctgtgcaacgagaacttcaagaagaccttcaagagaatcctgcacatcagaagctag

SEQ ID NO: 84513 - DNA, 39 bp, Artificial Sequence
  Description of Artificial Sequence: Synthetic coding sequence
atgagcctgcccaacagcagctgcctgctggaggactag

SEQ ID NO: 84514 - DNA, 1464 bp, Artificial Sequence; identical to SEQ ID NO: 84512
  Description of Artificial Sequence: Synthetic coding sequence

SEQ ID NO: 84515 - DNA, 1464 bp, Artificial Sequence; identical to SEQ ID NO: 84512
  Description of Artificial Sequence: Synthetic coding sequence

SEQ ID NO: 84516 - DNA, 816 bp, Artificial Sequence
  Description of Artificial Sequence: Synthetic coding sequence
atggccgccccccaggacgtgcacgtgagaatctgcaaccaggagatcgtgaagttcgacctggaggtgaaggccctgatccaggacatcagagactgcagcggccccctgagcgccctgaccgagctgaacaccaaggtgaaggagaagttccagcagctgagacacagaatccagcccgtgctgtaccagagagccttcatctggaccgccagcaccttcttcttcaagctgacctacagcctgaccgacttcagcagcacccagcacgacttcaacagccccaccacccccgtgaccttcagcgacctggagcagctggccaaggagcaggacaaggagagcgagaagcagctgctgctgcaggaggtggagaaccacaagaagcagatgctgagcaaccaggccagctggagaaaggccaacctgacctgcaagatcgccatcgacaacctggagaaggccgagctgctgcagggcggcgacctgctgagacagagaaagaccaccaaggagagcctggcccagaccagcagcaccatcaccgagagcctgatgggcatcagcagaatgatggcccagcaggtgcagcagagcgaggaggccatgcagagcctggtgaccagcagcagaaccatcctggacgccaacgaggagttcaagagcatgagcggcaccatccagctgggcagaaagctgatcaccaagtacaacagaagagagctgaccgacaagctgctgatcttcctggccctggccctgttcctggccaccgtgctgtacatcgtgaagaagagactgttccccttcctgtag

SEQ ID NO: 84517 - DNA, 1194 bp, Artificial Sequence
  Description of Artificial Sequence: Synthetic coding sequence
atggcccccaacggcaccgccagcagcttctgcctggacagcaccgcctgcaagatcaccatcaccgtggtgctggccgtgctgatcctgatcaccgtggccggcaacgtggtggtgtgcctggccgtgggcctgaacagaagactgagaaacctgaccaactgcttcatcgtgagcctggccatcaccgacctgctgctgggcctgctggtgctgcccttcagcgccatctaccagctgagctgcaagtggagcttcggcaaggtgttctgcaacatctacaccagcctggacgtgatgctgtgcaccgccagcatcctgaacctgttcatgatcagcctggacagatactgcgccgtgatggaccccctgagataccccgtgctggtgacccccgtgagagtggccatcagcctggtgctgatctgggtgatcagcatcaccctgagcttcctgagcatccacctgggctggaacagcagaaacgagaccagcaagggcaaccacaccaccagcaagtgcaaggtgcaggtgaacgaggtgtacggcctggtggacggcctggtgaccttctacctgcccctgctgatcatgtgcatcacctactacagaatcttcaaggtggccagagaccaggccaagagaatcaaccacatcagcagctggaaggccgccaccatcagagagcacaaggccaccgtgaccctggccgccgtgatgggcgccttcatcatctgctggttcccctacttcaccgccttcgtgtacagaggcctgagaggcgacgacgccatcaacgaggtgctggaggccatcgtgctgtggctgggctacgccaacagcgccctgaaccccatcctgtacgccgccctgaacagagacttcagaaccggctaccagcagctgttctgctgcagactggccaacagaaacagccacaagaccagcctgagaagcaacgccagccagctgagcagaacccagagcagagagcccagacagcaggaggagaagcccctgaagctgcaggtgtggagcggcaccgaggtgaccgccccccagggcgccaccgacagaccctggctgtgcctgcccgagtgctggagcgtggagctgacccacagcttcatccacctgttcatccacagcttcgccaacatccaccccatccccaccacctgccaggagctgtag

SEQ ID NO: 84518 - DNA, 1173 bp, Artificial Sequence
  Description of Artificial Sequence: Synthetic coding sequence
atgcccgacaccaacagcaccatcaacctgagcctgagcaccagagtgaccctggccttcttcatgagcctggtggccttcgccatcatgctgggcaacgccctggtgatcctggccttcgtggtggacaagaacctgagacacagaagcagctacttcttcctgaacctggccatcagcgacttcttcgtgggcgtgatcagcatccccctgtacatcccccacaccctgttcgagtgggacttcggcaaggagatctgcgtgttctggctgaccaccgactacctgctgtgcaccgccagcgtgtacaacatcgtgctgatcagctacgacagatacctgagcgtgagcaacgccgtgagctacagaacccagcacaccggcgtgctgaagatcgtgaccctgatggtggccgtgtgggtgctggccttcctggtgaacggccccatgatcctggtgagcgagagctggaaggacgagggcagcgagtgcgagcccggcttcttcagcgagtggtacatcctggccatcaccagcttcctggagttcgtgatccccgtgatcctggtggcctacttcaacatgaacatctactggagcctgtggaagagagaccacctgagcagatgccagagccaccccggcctgaccgccgtgagcagcaacatctgcggccacagcttcagaggcagactgagcagcagaagaagcctgagcgccagcaccgaggtgcccgccagcttccacagcgagagacagagaagaaagagcagcctgatgttcagcagcagaaccaagatgaacagcaacaccatcgccagcaagatgggcagcttcagccagagcgacagcgtggccctgcaccagagagagcacgtggagctgctgagagccagaagactggccaagagcctggccatcctgctgggcgtgttcgccgtgtgctgggccccctacagcctgttcaccatcgtgctgagcttctacagcagcgccaccggccccaagagcgtgtggtacagaatcgccttctggctgcagtggttcaacagcttcgtgaaccccctgctgtaccccctgtgccacaagagattccagaaggccttcctgaagatcttctgcatcaagaagcagcccctgcccagccagcacagcagaagcgtgagcagctag

SEQ ID NO: 84519 - DNA, 909 bp, Artificial Sequence
  Description of Artificial Sequence: Synthetic coding sequence
atgcccgacaccaacagcaccatcaacctgagcctgagcaccagagtgaccctggccttcttcatgagcctggtggccttcgccatcatgctgggcaacgccctggtgatcctggccttcgtggtggacaagaacctgagacacagaagcagctacttcttcctgaacctggccatcagcgacttcttcgtggtgagcgagagctggaaggacgagggcagcgagtgcgagcccggcttcttcagcgagtggtacatcctggccatcaccagcttcctggagttcgtgatccccgtgatcctggtggcctacttcaacatgaacatctactggagcctgtggaagagagaccacctgagcagatgccagagccaccccggcctgaccgccgtgagcagcaacatctgcggccacagcttcagaggcagactgagcagcagaagaagcctgagcgccagcaccgaggtgcccgccagcttccacagcgagagacagagaagaaagagcagcctgatgttcagcagcagaaccaagatgaacagcaacaccatcgccagcaagatgggcagcttcagccagagcgacagcgtggccctgcaccagagagagcacgtggagctgctgagagccagaagactggccaagagcctggccatcctgctgggcgtgttcgccgtgtgctgggccccctacagcctgttcaccatcgtgctgagcttctacagcagcgccaccggccccaagagcgtgtggtacagaatcgccttctggctgcagtggttcaacagcttcgtgaaccccctgctgtaccccctgtgccacaagagattccagaaggccttcctgaagatcttctgcatcaagaagcagcccctgcccagccagcacagcagaagcgtgagcagctag

SEQ ID NO: 84520 - DNA, 174 bp, Artificial Sequence
  Description of Artificial Sequence: Synthetic coding sequence
atgaagttcttcgtgttcgccctggtgctggccctgatgatcagcatgatcagcgccgacagccacgagaagagacaccacggctacagaagaaagttccacgagaagcaccacagccacagagagttccccttctacggcgactacggcagcaactacctgtacgacaactag

SEQ ID NO: 84521 - DNA, 174 bp, Artificial Sequence; identical to SEQ ID NO: 84520
  Description of Artificial Sequence: Synthetic coding sequence

SEQ ID NO: 84522 - DNA, 156 bp, Artificial Sequence
  Description of Artificial Sequence: Synthetic coding sequence
atgaagttcttcgtgttcgccctgatcctggccctgatgctgagcatgaccggcgccgacagccacgccaagagacaccacggctacaagagaaagttccacgagaagcaccacagccacagaggctacagaagcaactacctgtacgacaactag

SEQ ID NO: 84523 - DNA, 156 bp, Artificial Sequence; identical to SEQ ID NO: 84522
  Description of Artificial Sequence: Synthetic coding sequence

SEQ ID NO: 84524 - DNA, 1989 bp, Artificial Sequence
  Description of Artificial Sequence: Synthetic coding sequence
atgatggagcccgaggagtacagagagagaggcagagagatggtggactacatctgccagtacctgagcaccgtgagagagagaagagtgacccccgacgtgcagcccggctacctgagagcccagctgcccgagagcgcccccgaggaccccgacagctgggacagcatcttcggcgacatcgagagaatcatcatgcccggcgtggtgcactggcagagcccccacatgcacgcctactaccccgccctgaccagctggcccagcctgctgggcgacatgctggccgacgccatcaactgcctgggcttcacctgggccagcagccccgcctgcaccgagctggagatgaacgtgatggactggctggccaagatgctgggcctgcccgagcacttcctgcaccaccaccccagcagccagggcggcggcgtgctgcagagcaccgtgagcgagagcaccctgatcgccctgctggccgccagaaagaacaagatcctggagatgaagaccagcgagcccgacgccgacgagagctgcctgaacgccagactggtggcctacgccagcgaccaggcccacagcagcgtggagaaggccggcctgatcagcctggtgaagatgaagttcctgcccgtggacgacaacttcagcctgagaggcgaggccctgcagaaggccatcgaggaggacaagcagagaggcctggtgcccgtgttcgtgtgcgccaccctgggcaccaccggcgtgtgcgccttcgactgcctgagcgagctgggccccatctgcgccagagagggcctgtggctgcacatcgacgccgcctacgccggcaccgccttcctgtgccccgagttcagaggcttcctgaagggcatcgagtacgccgacagcttcaccttcaaccccagcaagtggatgatggtgcacttcgactgcaccggcttctgggtgaaggacaagtacaagctgcagcagaccttcagcgtgaaccccatctacctgagacacgccaacagcggcgtggccaccgacttcatgcactggcagatccccctgagcagaagattcagaagcgtgaagctgtggttcgtgatcagaagcttcggcgtgaagaacctgcaggcccacgtgagacacggcaccgagatggccaagtacttcgagagcctggtgagaaacgaccccagcttcgagatccccgccaagagacacctgggcctggtggtgttcagactgaagggccccaactgcctgaccgagaacgtgctgaaggagatcgccaaggccggcagactgttcctgatccccgccaccatccaggacaagctgatcatcagattcaccgtgaccagccagttcaccaccagagacgacatcctgagagactggaacctgatcagagacgccgccaccctgatcctgagccagcactgcaccagccagcccagccccagagtgggcaacctgatcagccagatcagaggcgccagagcctgggcctgcggcaccagcctgcagagcgtgagcggcgccggcgacgaccccgtgcaggccagaaagatcatcaagcagccccagagagtgggcgccggccccatgaagagagagaacggcctgcacctggagaccctgctggaccccgtggacgactgcttcagcgaggaggcccccgacgccaccaagcacaagctgagcagcttcctgttcagctacctgagcgtgcagaccaagaagaagaccgtgagaagcctgagctgcaacagcgtgcccgtgagcgcccagaagcccctgcccaccgaggccagcgtgaagaacggcggcagcagcagagtgagaatcttcagcagattccccgaggacatgatgatgctgaagaagagcgccttcaagaagctgatcaagttctacagcgtgcccagcttccccgagtgcagcagccagtgcggcctgcagctgccctgctgccccctgcaggccatggtgtag

SEQ ID NO: 84525 - DNA, 2100 bp, Artificial Sequence
  Description of Artificial Sequence: Synthetic coding sequence
atgggccaccacagaccctggctgcacgccagcgtgctgtgggccggcgtggccagcctgctgctgccccccgccatgacccagcagctgagaggcgacggcctgggcttcagaaacagaaacaacagcaccggcgtggccggcctgagcgaggaggccagcgccgagctgagacaccacctgcacagccccagagaccaccccgacgagaacaaggacgtgagcaccgagaacggccaccacttctggagccaccccgacagagagaaggaggacgaggacgtgagcaaggagtacggccacctgctgcccggccacagaagccaggaccacaaggtgggcgacgagggcgtgagcggcgaggaggtgttcgccgagcacggcggccaggccagaggccacagaggccacggcagcgaggacaccgaggacagcgccgagcacagacaccacctgcccagccacagaagccacagccaccaggacgaggacgaggacgaggtggtgagcagcgagcaccaccaccacatcctgagacacggccacagaggccacgacggcgaggacgacgagggcgaggaggaggaggaggaggaggaggaggaggaggaggccagcaccgagtacggccaccaggcccacagacacagaggccacggcagcgaggaggacgaggacgtgagcgacggccaccaccaccacggccccagccacagacaccagggccacgaggaggacgacgacgacgacgacgacgacgacgacgacgacgacgacgacgacgtgagcatcgagtacagacaccaggcccacagacaccagggccacggcatcgaggaggacgaggacgtgagcgacggccaccaccacagagaccccagccacagacacagaagccacgaggaggacgacaacgacgacgacgacgtgagcaccgagtacggccaccaggcccacagacaccaggaccacagaaaggaggaggtggaggccgtgagcggcgagcaccaccaccacgtgcccgaccacagacaccagggccacagagacgaggaggaggacgaggacgtgagcaccgagagatggcaccagggcccccagcacgtgcaccacggcctggtggacgaggaggaggaggaggaggagatcaccgtgcagttcggccactacgtggccagccaccagcccagaggccacaagagcgacgaggaggacttccaggacgagtacaagaccgaggtgccccaccaccaccaccacagagtgcccagagaggaggacgaggaggtgagcgccgagctgggccaccaggcccccagccacagacagagccaccaggacgaggagaccggccacggccagagaggcagcatcaaggagatgagccaccacccccccggccacaccgtggtgaaggacagaagccacctgagaaaggacgacagcgaggaggagaaggagaaggaggaggaccccggcagccacgaggaggacgacgagagcagcgagcagggcgagaagggcacccaccacggcagcagagaccaggaggacgaggaggacgaggaggagggccacggcctgagcctgaaccaggaggaggaggaggaggaggacaaggaggaggaggaggaggaggaggacgaggagagaagagaggagagagccgaggtgggcgcccccctgagccccgaccacagcgaggaggaggaggaggaggaggagggcctggaggaggacgagcccagattcaccatcatccccaaccccctggacagaagagaggaggccggcggcgccagcagcgaggaggagagcggcgaggacaccggcccccaggacgcccaggagtacggcaactaccagcccggcagcctgtgcggctactgcagcttctgcaacagatgcaccgagtgcgagagctgccactgcgacgaggagaacatgggcgagcactgcgaccagtgccagcactgccagttctgctacctgtgccccctggtgtgcgagaccgtgtgcgcccccggcagctacgtggactacttcagcagcagcctgtaccaggccctggccgacatgctggagacccccgagccctag

SEQ ID NO: 84526 - DNA, 1170 bp, Artificial Sequence
  Description of Artificial Sequence: Synthetic coding sequence
gaggacgacaacgacgacgacgacgtgagcaccgagtacggccaccaggcccacagacaccaggaccacagaaaggaggaggtggaggccgtgagcggcgagcaccaccaccacgtgcccgaccacagacaccagggccacagagacgaggaggaggacgaggacgtgagcaccgagagatggcaccagggcccccagcacgtgcaccacggcctggtggacgaggaggaggaggaggaggagatcaccgtgcagttcggccactacgtggccagccaccagcccagaggccacaagagcgacgaggaggacttccaggacgagtacaagaccgaggtgccccaccaccaccaccacagagtgcccagagaggaggacgaggaggtgagcgccgagctgggccaccaggcccccagccacagacagagccaccaggacgaggagaccggccacggccagagaggcagcatcaaggagatgagccaccacccccccggccacaccgtggtgaaggacagaagccacctgagaaaggacgacagcgaggaggagaaggagaaggaggaggaccccggcagccacgaggaggacgacgagagcagcgagcagggcgagaagggcacccaccacggcagcagagaccaggaggacgaggaggacgaggaggagggccacggcctgagcctgaaccaggaggaggaggaggaggaggacgaggagagaagagaggagagagccgaggtgggcgcccccctgagccccgaccacagcgaggaggaggaggaggaggaggagggcctggaggaggacgagcccagattcaccatcatccccaaccccctggacagaagagaggaggccggcggcgccagcagcgaggaggagagcggcgaggacaccggcccccaggacgcccaggagtacggcaactaccagcccggcagcctgtgcggctactgcagcttctgcaacagatgcaccgagtgcgagagctgccactgcgacgaggagaacatgggcgagcactgcgaccagtgccagcactgccagttctgctacctgtgccccctggtgtgcgagaccgtgtgcgcccccggcagctacgtggactacttcagcagcagcctgtaccaggccctggccgacatgctggagacccccgagccctag

SEQ ID NO: 84527 - DNA, 1365 bp, Artificial Sequence
  Description of Artificial Sequence: Synthetic coding sequence
atgggccaccacagaccctggctgcacgccagcgtgctgtgggccggcgtggccagcctgctgctgccccccgccatgacccagcagctgagaggcgacggcctgggcttcagaaacagaaacaaggacgtgagcaccgagaacggccaccacttctggagccaccccgacagagagaaggaggacgaggacgtgagcaaggagtacggccacctgctgcccggccacagaagccaggaccacaaggtgggcgacgagggcgtgagcggcgaggaggtgttcgccgagcacggcggccaggccagaggccacagaggccacggcagcgaggacaccgaggacagcgccgagcacagacaccacctgcccagccacagaagccacagccaccaggacgaggacgaggacgaggtggtgagcagcgagcaccaccaccacatcctgagacacggccacagaggccacgacggcgaggacgacgagggcgaggaggaggaggaggaggaggaggaggaggaggaggccagcaccgagtacggccaccaggcccacagacacagaggccacggcagcgaggaggacgaggacgtgagcgacggccaccaccaccacggccccagccacagacaccagggccacgaggaggacgacgacgacgacgacgacgacgacgacgacgacgacgacgacgacgtgagcatcgagtacagacaccaggcccacagacaccagggccacggcatcgaggaggacgaggacgtgagcgacggccaccaccacagagaccccagccacagacacagaagccacgaggaggacgacaacgacgacgacgacgtgagcaccgagtacggccaccaggcccacagacaccaggaccacagaaaggaggaggtggaggccgtgagcggcgagcaccaccaccacgtgcccgaccacagacaccagggccacagagacgaggaggaggacgaggacgtgagcaccgagagatggcaccagggcccccagcacgtgcaccacggcctggtggacgaggaggaggaggaggaggagatcaccgtgcagttcggccactacgtggccagccaccagcccagaggccacaagagcgacgaggaggacttccaggacgagtacaagaccgaggtgccccaccaccaccaccacagagtgcccagagaggaggacgaggaggtgagcgccgagctgggccaccaggcccccagccacagacagagccaccaggacgaggagaccggccacggccagagaggcagcatcaaggagatgagccaccacccccccggccacaccgtggtgaaggacagaagccacctgagaaaggacgacagcgaggagtag

SEQ ID NO: 84528 - DNA, 381 bp, Artificial Sequence
  Description of Artificial Sequence: Synthetic coding sequence
atggccgacgagatcgccaaggcccaggtggccagacccggcggcgacaccatcttcggcaagatcatcagaaaggagatccccgccaagatcatcttcgaggacgacagatgcctggccttccacgacatcagcccccaggcccccacccacttcctggtgatccccaagaagcacatcagccagatcagcgtggccgaggacgacgacgagagcctgctgggccacctgatgatcgtgggcaagaagtgcgccgccgacctgggcctgaacaagggctacagaatggtggtgaacgagggcagcgacggcggccagagcgtgtaccacgtgcacctgcacgtgctgggcggcagacagatgcactggccccccggctag

SEQ ID NO: 84529 - DNA, 492 bp, Artificial Sequence
  Description of Artificial Sequence: Synthetic coding sequence
atggccgccgccgtggtgctggccgccggcctgagagccgccagaagagccgtggccgccaccggcgtgagaggcggccaggtgagaggcgccgccggcgtgaccgacggcaacgaggtggccaaggcccagcaggccacccccggcggcgccgcccccaccatcttcagcagaatcctggacaagagcctgcccgccgacatcctgtacgaggaccagcagtgcctggtgttcagagacgtggccccccaggcccccgtgcacttcctggtgatccccaagaagcccatccccagaatcagccaggccgaggaggaggaccagcagctgctgggccacctgctgctggtggccaagcagaccgccaaggccgagggcctgggcgacggctacagactggtgatcaacgacggcaagctgggcgcccagagcgtgtaccacctgcacatccacgtgctgggcggcagacagctgcagtggccccccggctag

SEQ ID NO: 84530 - DNA, 615 bp, Artificial Sequence
  Description of Artificial Sequence: Synthetic coding sequence
atggccaaggtgcaggtgaacaacgtggtggtgctggacaaccccagccccttctacaaccccttccagttcgagatcaccttcgagtgcatcgaggacctgagcgaggacctggagtggaagatcatctacgtgggcagcgccgagagcgaggagtacgaccaggtgctggacagcgtgctggtgggccccgtgcccgccggcagacacatgttcgtgttccaggccgacgcccccaaccccggcctgatccccgacgccgacgccgtgggcgtgaccgtggtgctgatcacctgcacctacagaggccaggagttcatcagagtgggctactacgtgaacaacgagtacaccgagaccgagctgagagagaacccccccgtgaagcccgacttcagcaagctgcagagaaacatcctggccagcaaccccagagtgaccagattccacatcaactgggaggacaacaccgagaagctggaggacgccgagagcagcaaccccaacctgcagagcctgctgagcaccgacgccctgcccagcgccagcaagggctggagcaccagcgagaacagcctgaacgtgatgctggagagccacatggactgcatgtag

SEQ ID NO: 84531 - DNA, 1329 bp, Artificial Sequence
  Description of Artificial Sequence: Synthetic coding sequence
atggccggcgagggcgaccagcaggacgccgcccacaacatgggcaaccacctgcccctgctgcccgccgagagcgaggaggaggacgagatggaggtggaggaccaggacagcaaggaggccaagaagcccaacatcatcaacttcgacaccagcctgcccaccagccacacctacctgggcgccgacatggaggagttccacggcagaaccctgcacgacgacgacagctgccaggtgatccccgtgctgccccaggtgatgatgatcctgatccccggccagaccctgcccctgcagctgttccacccccaggaggtgagcatggtgagaaacctgatccagaaggacagaaccttcgccgtgctggcctacagcaacgtgcaggagagagaggcccagttcggcaccaccgccgagatctacgcctacagagaggagcaggacttcggcatcgagatcgtgaaggtgaaggccatcggcagacagagattcaaggtgctggagctgagaacccagagcgacggcatccagcaggccaaggtgcagatcctgcccgagtgcgtgctgcccagcaccatgagcgccgtgcagctggagagcctgaacaagtgccagatcttccccagcaagcccgtgagcagagaggaccagtgcagctacaagtggtggcagaagtaccagaagagaaagttccactgcgccaacctgaccagctggcccagatggctgtacagcctgtacgacgccgagaccctgatggacagaatcaagaagcagctgagagagtgggacgagaacctgaaggacgacagcctgcccagcaaccccatcgacttcagctacagagtggccgcctgcctgcccatcgacgacgtgctgagaatccagctgctgaagatcggcagcgccatccagagactgagatgcgagctggacatcatgaacaagtgcaccagcctgtgctgcaagcagtgccaggagaccgagatcaccaccaagaacgagatcttcagcctgagcctgtgcggccccatggccgcctacgtgaacccccacggctacgtgcacgagaccctgaccgtgtacaaggcctgcaacctgaacctgatcggcagacccagcaccgagcacagctggttccccggctacgcctggaccgtggcccagtgcaagatctgcgccagccacatcggctggaagttcaccgccaccaagaaggacatgagcccccagaagttctggggcctgaccagaagcgccctgctgcccaccatccccgacaccgaggacgagatcagccccgacaaggtgatcctgtgcctgtag

SEQ ID NO: 84532 - DNA, 1308 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaagggcaccagagactacagccccagacagatggccgtgagagagaaggtgttcgacgtgatcatcagatgcttcaagagacacggcgccgaggtgatcgacacccccgtgttcgagctgaaggacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84533 - DNA, 1188 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaaggacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84534 - DNA, 1410 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaaggagaccctgatgggcaagtacggcgaggacagcaagctgatctacgacctgaaggaccagggcggcgagctgctgagcctgagatacgacctgaccgtgcccttcgccagatacctggccatgaacaagctgaccaacatcaagagataccacatcgccaaggtgtacagaagagacaaccccgccatgaccagaggcagatacagagagttctaccagtgcgacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84535 - DNA, 945 bp, Artificial Sequence
  Description of Artificial Sequence: Synthetic coding sequence
atgaccagaggcagatacagagagttctaccagtgcgacttcgacatcgccggcaacttcgaccccatgatccccgacgccgagtgcctgaagatcatgtgcgagatcctgagcagcctgcagatcggcgacttcctggtgaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84536 - DNA, 1530 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaagggcaccagagactacagccccagacagatggccgtgagagagaaggtgttcgacgtgatcatcagatgcttcaagagacacggcgccgaggtgatcgacacccccgtgttcgagctgaaggagaccctgatgggcaagtacggcgaggacagcaagctgatctacgacctgaaggaccagggcggcgagctgctgagcctgagatacgacctgaccgtgcccttcgccagatacctggccatgaacaagctgaccaacatcaagagataccacatcgccaaggtgtacagaagagacaaccccgccatgaccagaggcagatacagagagttctaccagtgcgacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84537 - DNA, 1323 bp, Artificial Sequence
  Description of Artificial Sequence: Synthetic coding sequence
atggccgtgagagagaaggtgttcgacgtgatcatcagatgcttcaagagacacggcgccgaggtgatcgacacccccgtgttcgagctgaaggagaccctgatgggcaagtacggcgaggacagcaagctgatctacgacctgaaggaccagggcggcgagctgctgagcctgagatacgacctgaccgtgcccttcgccagatacctggccatgaacaagctgaccaacatcaagagataccacatcgccaaggtgtacagaagagacaaccccgccatgaccagaggcagatacagagagttctaccagtgcgacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84538 - DNA, 867 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaagggcaccagagactacagccccagacagatggccgtgagagagaaggtgttcgacgtgatcatcagatgcttcaagagacacggcgccgaggtgatcgacacccccgtgttcgagctgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggagtag

SEQ ID NO: 84539 - DNA, 1350 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaaggagaccctgatgggcaagtacggcgaggacagcaagctgatctacgacctgaaggaccagggcggcgagctgctgagcctgagatacgacctgaccgtgcccttcgccagatacctggccatgaacaagctgaccaacatcaagagataccacatcgccaaggacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84540 - DNA, 1470 bp, Artificial Sequence
  Description of Artificial Sequence: Synthetic coding sequence
atggccgagagagccgccctggaggagctggtgaagctgcagggcgagagagtgagaggcctgaagcagcagaaggccagcgccgagctgatcgaggaggaggtggccaagctgctgaagctgaaggcccagctgggccccgacgagagcaagcagaagttcgtgctgaagacccccaagggcaccagagactacagccccagacagatggccgtgagagagaaggtgttcgacgtgatcatcagatgcttcaagagacacggcgccgaggtgatcgacacccccgtgttcgagctgaaggagaccctgatgggcaagtacggcgaggacagcaagctgatctacgacctgaaggaccagggcggcgagctgctgagcctgagatacgacctgaccgtgcccttcgccagatacctggccatgaacaagctgaccaacatcaagagataccacatcgccaaggacttcgacatcgccggcaacttcgaccccatgatccccgacgccgagtgcctgaagatcatgtgcgagatcctgagcagcctgcagatcggcgacttcctggtgaaggtgaacgacagaagaatcctggacggcatgttcgccatctgcggcgtgagcgacagcaagttcagaaccatctgcagcagcgtggacaagctggacaaggtgagctgggaggaggtgaagaacgagatggtgggcgagaagggcctggcccccgaggtggccgacagaatcggcgactacgtgcagcagcacggcggcgtgagcctggtggagcagctgctgcaggaccccaagctgagccagaacaagcaggccctggagggcctgggcgacctgaagctgctgttcgagtacctgaccctgttcggcatcgacgacaagatcagcttcgacctgagcctggccagaggcctggactactacaccggcgtgatctacgaggccgtgctgctgcagacccccgcccaggccggcgaggagcccctgggcgtgggcagcgtggccgccggcggcagatacgacggcctggtgggcatgttcgaccccaagggcagaaaggtgccctgcgtgggcctgagcatcggcgtggagagaatcttcagcatcgtggagcagagactggaggccctggaggagaagatcagaaccaccgagacccaggtgctggtggccagcgcccagaagaagctgctggaggagagactgaagctggtgagcgagctgtgggacgccggcatcaaggccgagctgctgtacaagaagaaccccaagctgctgaaccagctgcagtactgcgaggaggccggcatccccctggtggccatcatcggcgagcaggagctgaaggacggcgtgatcaagctgagaagcgtgaccagcagagaggaggtggacgtgagaagagaggacctggtggaggagatcaagagaagaaccggccagcccctgtgcatctgctag

SEQ ID NO: 84541 - DNA, 1017 bp, Artificial Sequence
  Description of Artificial Sequence: Synthetic coding sequence
atgatggccatgaacagcaagcagcccttcggcatgcaccccgtgctgcaggagcccaagttcagcagcctgcacagcggcagcgaggccatgagaagagtgtgcctgcccgccccccagctgcagggcaacatcttcggcagcttcgacgagagcctgctggccagagccgaggccctggccgccgtggacatcgtgagccacggcaagaaccaccccttcaagcccgacgccacctaccacaccatgagcagcgtgccctgcaccagcaccagcagcaccgtgcccatcagccaccccgccgccctgaccagccacccccaccacgccgtgcaccagggcctggagggcgacctgctggagcacatcagccccaccctgagcgtgagcggcctgggcgcccccgagcacagcgtgatgcccgcccagatccacccccaccacctgggcgccatgggccacctgcaccaggccatgggcatgagccacccccacaccgtggccccccacagcgccatgcccgcctgcctgagcgacgtggagagcgaccccagagagctggaggccttcgccgagagattcaagcagagaagaatcaagctgggcgtgacccaggccgacgtgggcgccgccctggccaacctgaagatccccggcgtgggcagcctgagccagagcaccatctgcagattcgagagcctgaccctgagccacaacaacatgatcgccctgaagcccgtgctgcaggcctggctggaggaggccgaggccgcctacagagagaagaacagcaagcccgagctgttcaacggcagcgagagaaagagaaagagaaccagcatcgccgcccccgagaagagaagcctggaggcctacttcgccatccagcccagacccagcagcgagaagatcgccgccatcgccgagaagctggacctgaagaagaacgtggtgagagtgtggttctgcaaccagagacagaagcagaagagaatgaagtacagcgccgtgcactag

SEQ ID NO: 84542 - DNA, 1038 bp, Artificial Sequence
  Description of Artificial Sequence: Synthetic coding sequence
atgaccctgctggaggtgcccttcgccagatacctggccatgaacaaggtgaagaagatgaagagataccacgtgggcaaggtgtggagaagagagagccccaccatcgtgcagggcagatacagagagttctgccagtgcgacttcgacatcgccggccagttcgaccccatgatccccgacgccgagtgcctgaagatcatgtgcgagatcctgagcggcctgcagctgggcgacttcctgatcaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 84543 - DNA, 1179 bp, Artificial Sequence
  Description of Artificial Sequence: Synthetic coding sequence
atgcccctgctgggcctgctgcccagaagagcctgggccagcctgctgagccagctgctgagacccccctgcgccagctgcaccggcgccgtgagatgccagagccaggtggccgaggccgtgctgaccagccagctgaaggcccaccaggagaagcccaacttcatcatcaagacccccaaggacttcgacatcgccggccagttcgaccccatgatccccgacgccgagtgcctgaagatcatgtgcgagatcctgagcggcctgcagctgggcgacttcctgatcaaggtgaacgacagaagaatcgtggacggcatgttcgccgtgtgcggcgtgcccgagagcaagttcagagccatctgcagcagcatcgacaagctggacaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 84544 - DNA, 1401 bp, Artificial Sequence
  Description of Artificial Sequence: Synthetic coding sequence
atgcccctgctgggcctgctgcccagaagagcctgggccagcctgctgagccagctgctgagacccccctgcgccagctgcaccggcgccgtgagatgccagagccaggtggccgaggccgtgctgaccagccagctgaaggcccaccaggagaagcccaacttcatcatcaagacccccaaggagaccctgaccgagaagtacggcgaggacagcggcctgatgtacgacctgaaggaccagggcggcgagctgctgagcctgagatacgacctgaccgtgcccttcgccagatacctggccatgaacaaggtgaagaagatgaagagataccacgtgggcaaggtgtggagaagagagagccccaccatcgtgcagggcagatacagagagttctgccagtgcgacttcgacatcgccggccagttcgaccccatgatccccgacgccgagtgcctgaagatcatgtgcgagatcctgagcggcctgcagctgggcgacttcctgatcaaggtgaacgacagaagaatcgtggacggcatgttcgccgtgtgcggcgtgcccgagagcaagttcagagccatctgcagcagcatcgacaagctggacaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 84545 - DNA, 1005 bp, Artificial Sequence
  Description of Artificial Sequence: Synthetic coding sequence
atgcccctgctgggcctgctgcccagaagagcctgggccagcctgctgagccagctgctgagacccccctgcgccagctgcaccggcgccgtgagatgccagagccaggacttcgacatcgccggccagttcgaccccatgatccccgacgccgagtgcctgaagatcatgtgcgagatcctgagcggcctgcagctgggcgacttcctgatcaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 84546 - DNA, 1446 bp, Artificial Sequence
  Description of Artificial Sequence: Synthetic coding sequence
atgcccctgctgggcctgctgcccagaagagcctgggccagcctgctgagccagctgctgagacccccctgcgccagctgcaccggcgccgtgagatgccagagccagggcaccagagacctgagcccccagcacatggtggtgagagagaagatcctggacctggtgatcagctgcttcaagagacacggcgccaagggcatggacacccccgccttcgagctgaaggagaccctgaccgagaagtacggcgaggacagcggcctgatgtacgacctgaaggaccagggcggcgagctgctgagcctgagatacgacctgaccgtgcccttcgccagatacctggccatgaacaaggtgaagaagatgaagagataccacgtgggcaaggtgtggagaagagagagccccaccatcgtgcagggcagatacagagagttctgccagtgcgacttcgacatcgccggccagttcgaccccatgatccccgacgccgagtgcctgaagatcatgtgcgagatcctgagcggcctgcagctgggcgacttcctgatcaaggtgaacgacagaagaatcgtggacggcatgttcgccgtgtgcggcgtgcccgagagcaagttcagagccatctgcagcagcatcgacaagctggacaagatggcctggaaggacgtgagacacgagatggtggtgaagaagggcctggcccccgaggtggccgacagaatcggcgactacgtgcagtgccacggcggcgtgagcctggtggagcagatgttccaggaccccagactgagccagaacaagcaggccctggagggcctgggcgacctgaagctgctgttcgagtacctgaccctgttcggcatcgccgacaagatcagcttcgacctgagcctggccagaggcctggactactacaccggcgtgatctacgaggccgtgctgctgcagacccccacccaggccggcgaggagcccctgaacgtgggcagcgtggccgccggcggcagatacgacggcctggtgggcatgttcgaccccaagggccacaaggtgccctgcgtgggcctgagcatcggcgtggagagaatcttctacatcgtggagcagagaatgaagaccaagggcgagaaggtgagaaccaccgagacccaggtgttcgtggccaccccccagaagaacttcctgcaggagagactgaagctgatcgccgagctgtgggacagcggcatcaaggccgagatgctgtacaagaacaaccccaagctgctgacccagctgcactactgcgagagcaccggcatccccctggtggtgatcatcggcgagcaggagctgaaggagggcgtgatcaagatcagaagcgtggccagcagagaggaggtggccatcaagagagagaacttcgtggccgagatccagaagagactgagcgagagctag

SEQ ID NO: 84547 - DNA, 1185 bp, Artificial Sequence
  Description of Artificial Sequence: Synthetic coding sequence
atggacagcgccctgagcgacccccacaacggcagcgccgaggccggcggccccaccaacagcaccaccagaccccccagcacccccgagggcatcgccctggcctacggcagcctgctgctgatggccctgctgcccatcttcttcggcgccctgagaagcgtgagatgcgccagaggcaagaacgccagcgacatgcccgagaccatcaccagcagagacgccgccagattccccatcatcgccagctgcaccctgctgggcctgtacctgttcttcaagatcttcagccaggagtacatcaacctgctgctgagcatgtacttcttcgtgctgggcatcctggccctgagccacaccatcagccccttcatgaacaagttcttccccgccagcttccccaacagacagtaccagctgctgttcacccagggcagcggcgagaacaaggaggagatcatcaactacgagttcgacaccaaggacctggtgtgcctgggcctgagcagcatcgtgggcgtgtggtacctgctgagaaagcactggatcgccaacaacctgttcggcctggccttcagcctgaacggcgtggagctgctgcacctgaacaacgtgagcaccggctgcatcctgctgggcggcctgttcatctacgacgtgttctgggtgttcggcaccaacgtgatggtgaccgtggccaagagcttcgaggcccccatcaagctggtgttcccccaggacctgctggagaagggcctggaggccaacaacttcgccatgctgggcctgggcgacgtggtgatccccggcatcttcatcgccctgctgctgagattcgacatcagcctgaagaagaacacccacacctacttctacaccagcttcgccgcctacatcttcggcctgggcctgaccatcttcatcatgcacatcttcaagcacgcccagcccgccctgctgtacctggtgcccgcctgcatcggcttccccgtgctggtggccctggccaagggcgaggtgaccgagatgttcagctacgagagcagcgccgagatcctgccccacacccccagactgacccacttccccaccgtgagcggcagccccgccagcctggccgacagcatgcagcagaagctggccggccccagaagaagaagaccccagaaccccagcgccatgtag

SEQ ID NO: 84548 - DNA, 1134 bp, Artificial Sequence
  Description of Artificial Sequence: Synthetic coding sequence
atggacagcgccctgagcgacccccacaacggcagcgccgaggccggcggccccaccaacagcaccaccagaccccccagcacccccgagggcatcgccctggcctacggcagcctgctgctgatggccctgctgcccatcttcttcggcgccctgagaagcgtgagatgcgccagaggcaagaacgccagcgacatgcccgagaccatcaccagcagagacgccgccagattccccatcatcgccagctgcaccctgctgggcctgtacctgttcttcaagatcttcagccaggagtacatcaacctgctgctgagcatgtacttcttcgtgctgggcatcctggccctgagccacaccatcagccccttcatgaacaagttcttccccgccagcttccccaacagacagtaccagctgctgttcacccagggcagcggcgagaacaaggaggagatcatcaactacgagttcgacaccaaggacctggtgtgcctgggcctgagcagcatcgtgggcgtgtggtacctgctgagaaagcactggatcgccaacaacctgttcggcctggccttcagcctgaacggcgtggagctgctgcacctgaacaacgtgagcaccggctgcatcctgctgggcggcctgttcatctacgacgtgttctgggtgttcggcaccaacgtgatggtgaccgtggccaagagcttcgaggcccccatcaagctggtgttcccccaggacctgctggagaagggcctggaggccaacaacttcgccatgctgggcctgggcgacgtggtgatccccggcatcttcatcgccctgctgctgagattcgacatcagcctgaagaagaacacccacacctacttctacaccagcttcgccgcctacatcttcggcctgggcctgaccatcttcatcatgcacatcttcaagcacgcccagcccgccctgctgtacctggtgcccgcctgcatcggcttccccgtgctggtggccctggccaagggcgaggtgaccgagatgttcagctacgaggagagcaaccccaaggaccccgccgccgtgaccgagagcaaggagggcaccgaggccagcgccagcaagggcctggagaagaaggagaagtag

SEQ ID NO: 84549 - DNA, 1008 bp, Artificial Sequence
  Description of Artificial Sequence: Synthetic coding sequence
atggacagcgccctgagcgacccccacaacggcagcgccgaggccggcggccccaccaacagcaccaccagaccccccagcacccccgagggcatcgccctggcctacggcagcctgctgctgatggccctgctgcccatcttcttcggcgccctgagaagcgtgagatgcgccagaggcaagaacgccagcgacatgcccgagaccatcaccagcagagacgccgccagattccccatcatcgccagctgcaccctgctgggcctgtacctgttcttcaagatcttcagccaggagtacatcaacctgctgctgagcatgtacttcttcgtgctgggcatcctggccctgagccacaccatcagccccttcatgaacaagttcttccccgccagcttccccaacagacagtaccagctgctgttcacccagggcagcggcgagaacaaggaggagatcatcaactacgagttcgacaccaaggacctggtgtgcctgggcctgagcagcatcgtgggcgtgtggtacctgctgagaaaggtgttcggcaccaacgtgatggtgaccgtggccaagagcttcgaggcccccatcaagctggtgttcccccaggacctgctggagaagggcctggaggccaacaacttcgccatgctgggcctgggcgacgtggtgatccccggcatcttcatcgccctgctgctgagattcgacatcagcctgaagaagaacacccacacctacttctacaccagcttcgccgcctacatcttcggcctgggcctgaccatcttcatcatgcacatcttcaagcacgcccagcccgccctgctgtacctggtgcccgcctgcatcggcttccccgtgctggtggccctggccaagggcgaggtgaccgagatgttcagctacgaggagagcaaccccaaggaccccgccgccgtgaccgagagcaaggagggcaccgaggccagcgccagcaagggcctggagaagaaggagaagtag

SEQ ID NO: 84550 - DNA, 1281 bp, Artificial Sequence
  Description of Artificial Sequence: Synthetic coding sequence
atggacagcgccctgagcgacccccacaacggcagcgccgaggccggcggccccaccaacagcaccaccagaccccccagcacccccgagggcatcgccctggcctacggcagcctgctgctgatggccctgctgcccatcttcttcggcgccctgagaagcgtgagatgcgccagaggcaagaacgccagcgacatgcccgagaccatcaccagcagagacgccgccagattccccatcatcgccagctgcaccctgctgggcctgtacctgttcttcaagatcttcagccaggagtacatcaacctgctgctgagcatgtacttcttcgtgctgggcatcctggccctgagccacaccatcagccccttcatgaacaagttcttccccgccagcttccccaacagacagtaccagctgctgttcacccagggcagcggcgagaacaaggaggagatcatcaactacgagttcgacaccaaggacctggtgtgcctgggcctgagcagcatcgtgggcgtgtggtacctgctgagaaagcactggatcgccaacaacctgttcggcctggccttcagcctgaacggcgtggagctgctgcacctgaacaacgtgagcaccggctgcatcctgctgggcggcctgttcatctacgacgtgttctgggtgttcggcaccaacgtgatggtgaccgtggccaagagcttcgaggcccccatcaagctggtgttcccccaggacctgctggagaagggcctggaggccaacaacttcgccatgctgggcctgggcgacgtggtgatccccggcatcttcatcgccctgctgctgagattcgacatcagcctgaagaagaacacccacacctacttctacaccagcttcgccgcctacatcttcggcctgggcctgaccatcttcatcatgcacatcttcaagcacgcccagcccgccctgctgtacctggtgcccgcctgcatcggcttccccgtgctggtggccctggccaagggcgaggtgaccgagatgttcagctacgagagcagcgccgagatcctgccccacacccccagactgacccacttccccaccgtgagcggcagccccgccagcctggccgacagcatgcagcagaagctggccggccccagaagaagaagaccccagaaccccagcgccatctacgaggagagcaaccccaaggaccccgccgccgtgaccgagagcaaggagggcaccgaggccagcgccagcaagggcctggagaagaaggagaagtag

SEQ ID NO: 84551 - DNA, 3411 bp, Artificial Sequence
  Description of Artificial Sequence: Synthetic coding sequence
atgttcagcagaaagaagagagagctgatgaagacccccagcatcagcaagaagaacagagccggcagccccagcccccagcccagcggcgagctgcccagaaaggacggcgccgacgccgtgttccccggccccagcctggagccccccgccggcagcagcggcgtgaaggccaccggcaccctgaagagacccaccagcctgagcagacacgccagcgccgccggcttccccctgagcggcgccgccagctggaccctgggcagaagccacagaagccccctgaccgccgccagccccggcgagctgcccaccgagggcgccggccccgacgtggtggaggacatcagccacctgctggccgacgtggccagattcgccgagggcctggagaagctgaaggagtgcgtgctgagagacgacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84552 - DNA, 3393 bp, Artificial Sequence
  Description of Artificial Sequence: Synthetic coding sequence
agctacagcccctacagagccggcagacagggcccccagcagagaggcagagaccccggcatccagctgaccgagctgcccagaaaggacggcgccgacgccgtgttccccggccccagcctggagccccccgccggcagcagcggcgtgaaggccaccggcaccctgaagagacccaccagcctgagcagacacgccagcgccgccggcttccccctgagcggcgccgccagctggaccctgggcagaagccacagaagccccctgaccgccgccagccccggcgagctgcccaccgagggcgccggccccgacgtggtggaggacatcagccacctgctggccgacgtggccagattcgccgagggcctggagaagctgaaggagtgcgtgctgagagacgacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84553 - DNA, 3015 bp, Artificial Sequence
  Description of Artificial Sequence: Synthetic coding sequence
atgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagaggcgagtgccccgccggccccagaggcggcagatggctgcccgccacccaccccggccccagccccgagacccccctgagccccgccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84554 - DNA, 3459 bp, Artificial Sequence
  Description of Artificial Sequence: Synthetic coding sequence
atgagcagaggccagagagtgctgaagggcctgctgggctgggtgtgcacctggacctgggcctggagagccagactgggcgccagaggctgcggcctgcacgtgctgtgccccagagacctgcccctgccccccgaggagctgcccagaaaggacggcgccgacgccgtgttccccggccccagcctggagccccccgccggcagcagcggcgtgaaggccaccggcaccctgaagagacccaccagcctgagcagacacgccagcgccgccggcttccccctgagcggcgccgccagctggaccctgggcagaagccacagaagccccctgaccgccgccagccccggcgagctgcccaccgagggcgccggccccgacgtggtggaggacatcagccacctgctggccgacgtggccagattcgccgagggcctggagaagctgaaggagtgcgtgctgagagacgacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84555 - DNA, 3060 bp, Artificial Sequence
  Description of Artificial Sequence: Synthetic coding sequence
atgtgcatctgcggcaccgcccaccccgtgctggacgagggccccgtgagatgcagagccggccccagagacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84556 - DNA, 2847 bp, Artificial Sequence
  Description of Artificial Sequence: Synthetic coding sequence
atgttcagcagaaagaagagagagctgatgaagacccccagcatcagcaagaagaacagagccggcagccccagcccccagcccagcggcgagctgcccagaaaggacggcgccgacgccgtgttccccggccccagcctggagccccccgccggcagcagcggcgtgaaggccaccggcaccctgaagagacccaccagcctgagcagacacgccagcgccgccggcttccccctgagcggcgccgccagctggaccctgggcagaagccacagaagccccctgaccgccgccagccccggcgagctgcccaccgagggcgccggccccgacgtggtggaggacatcagccacctgctggccgacgtggccagattcgccgagggcctggagaagctgaaggagtgcgtgctgagagacgacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccatgagactgagaggcggcagaatgaccctgggcagctgcagagagagacagcccgagttcgtgtag

SEQ ID NO: 84557 - DNA, 3492 bp, Artificial Sequence
  Description of Artificial Sequence: Synthetic coding sequence
atgttcagcagaaagaagagagagctgatgaagacccccagcatcagcaagaagaacagagccggcagccccagcccccagcccagcggcccccacttcatcagcggcgagaccgaggccgtgagcagacccgagaaccccttcaacgagctgcccagcgacctgcccaaggagctgcccagaaaggacggcgccgacgccgtgttccccggccccagcctggagccccccgccggcagcagcggcgtgaaggccaccggcaccctgaagagacccaccagcctgagcagacacgccagcgccgccggcttccccctgagcggcgccgccagctggaccctgggcagaagccacagaagccccctgaccgccgccagccccggcgagctgcccaccgagggcgccggccccgacgtggtggaggacatcagccacctgctggccgacgtggccagattcgccgagggcctggagaagctgaaggagtgcgtgctgagagacgacctgctggaggccagaagacccagagcccacgagtgcctgggcgaggccctgagagtgatgcaccagatcatcagcaagtaccccctgctgaacaccgtggagaccctgaccgccgccggcaccctgatcgccaaggtgaaggccttccactacgagagcaacaacgacctggagaagcaggagttcgagaaggccctggagaccatcgccgtggccttcagcagcaccgtgagcgagttcctgatgggcgaggtggacagcagcaccctgctggccgtgccccccggcgacagcagccagagcatggagagcctgtacggccccggcagcgagggcaccccccccagcctggaggactgcgacgccggctgcctgcccgccgaggaggtggacgtgctgctgcagagatgcgagggcggcgtggacgccgccctgctgtacgccaagaacatggccaagtacatgaaggacctgatcagctacctggagaagagaaccaccctggagatggagttcgccaagggcctgcagaagatcgcccacaactgcagacagagcgtgatgcaggagccccacatgcccctgctgagcatctacagcctggccctggagcaggacctggagttcggccacagcatggtgcaggccgtgggcaccctgcagacccagaccttcatgcagcccctgaccctgagaagactggagcacgagaagagaagaaaggagatcaaggaggcctggcacagagcccagagaaagctgcaggaggccgagagcaacctgagaaaggccaagcagggctacgtgcagagatgcgaggaccacgacaaggccagattcctggtggccaaggccgaggaggagcaggccggcagcgcccccggcgccggcagcaccgccaccaagaccctggacaagagaagaagactggaggaggaggccaagaacaaggccgaggaggccatggccacctacagaacctgcgtggccgacgccaagacccagaagcaggagctggaggacaccaaggtgaccgccctgagacagatccaggaggtgatcagacagagcgaccagaccatcaagagcgccaccatcagctactaccagatgatgcacatgcagaccgcccccctgcccgtgcacttccagatgctgtgcgagagcagcaagctgtacgaccccggccagcagtacgccagccacgtgagacagctgcagagagaccaggagcccgacgtgcactacgacttcgagccccacgtgagcgccaacgcctggagccccgtgatgagagccagaaagagcagcttcaacgtgagcgacgtggccagacccgaggccgccggcagcccccccgaggagggcggctgcaccgagggcacccccgccaaggaccacagagccggcagaggccaccaggtgcacaagagctggcccctgagcatcagcgacagcgacagcggcctggaccccggccccggcgccggcgacttcaagaagttcgagagaaccagcagcagcggcaccatgagcagcaccgaggagctggtggaccccgacggcggcgccggcgccagcgccttcgagcaggccgacctgaacggcatgacccccgagctgcccgtggccgtgcccagcggccccttcagacacgagggcctgagcaaggccgccagaacccacagactgagaaagctgagaacccccgccaagtgcagagagtgcaacagctacgtgtacttccagggcgccgagtgcgaggagtgctgcctggcctgccacaagaagtgcctggagaccctggccatccagtgcggccacaagaagctgcagggcagactgcagctgttcggccaggacttcagccacgccgccagaagcgcccccgacggcgtgcccttcatcgtgaagaagtgcgtgtgcgagatcgagagaagagccctgagaaccaagggcatctacagagtgaacggcgtgaagaccagagtggagaagctgtgccaggccttcgagaacggcaaggagctggtggagctgagccaggccagcccccacgacatcagcaacgtgctgaagctgtacctgagacagctgcccgagcccctgatcagcttcagactgtaccacgagctggtgggcctggccaaggacagcctgaaggccgaggccgaggccaaggccgccagcagaggcagacaggacggcagcgagagcgaggccgtggccgtggccctggccggcagactgagagagctgctgagagacctgccccccgagaacagagccagcctgcagtacctgctgagacacctgagaagaatcgtggaggtggagcaggacaacaagatgacccccggcaacctgggcatcgtgttcggccccaccctgctgagacccagacccaccgaggccaccgtgagcctgagcagcctggtggactacccccaccaggccagagtgatcgagaccctgatcgtgcactacggcctggtgttcgaggaggagcccgaggagacccccggcggccaggacgagagcagcaaccagagagccgaggtggtggtgcaggtgccctacctggaggccggcgaggccgtggtgtaccccctgcaggaggccgccgccgacggctgcagagagagcagagtggtgagcaacgacagcgacagcgacctggaggaggccagcgagctgctgagcagcagcgaggccagcgccctgggccacctgagcttcctggagcagcagcagagcgaggccagcctggaggtggccagcggcagccacagcggcagcgaggagcagctggaggccaccgccagagaggacggcgacggcgacgaggacggccccgcccagcagctgagcggcttcaacaccaaccagagcaacaacgtgctgcaggcccccctgccccccatgagactgagaggcggcagaatgaccctgggcagctgcagagagagacagcccgagttcgtgtag

SEQ ID NO: 84558 - DNA, 420 bp, Artificial Sequence
  Description of Artificial Sequence: Synthetic coding sequence
atgagcatcagcagcgccctggccatggtgttcatgggcgccaagggcaacaccgccgcccagatgagccaggccctgtgcttcagcaagatcggcggcgaggacggcgacatccacagaggcttccagagcctgctggtggccatcaacagaaccgacaccgagtacgtgctgagaaccgccaacggcctgttcggcgagaagagctacgacttcctgaccggcttcaccgacagctgcggcaagttctaccaggccaccatcaagcagctggacttcgtgaacgacaccgagaagagcaccaccagagtgaacagctgggtggccgacaagaccaagggcgagaacatcctgctgttctacttcgacaacatcctgaacagcttcatcgtgagcagcctgcagaactgccagatctag

SEQ ID NO: 84559 - DNA, 162 bp, Artificial Sequence
  Description of Artificial Sequence: Synthetic coding sequence
atggagatcttcatcgaggtgttcagccacttcctgctgcagctgaccgagctgaccctgaacatgtgcctggagctgcccaccggcagcctggagaagagcctgatgatcagcagccaggtgctgcagatccccgtggccaacagcaccaagcagagatag

SEQ ID NO: 84560 - DNA, 648 bp, Artificial Sequence
  Description of Artificial Sequence: Synthetic coding sequence
atgagcgagaccgtgccccccgcccccgccgccagcgccgcccccgagaagcccctggccggcaagaaggccaagaagcccgccaaggccgccgccgccagcaagaagaagcccgccggccccagcgtgagcgagctgatcgtgcaggccgccagcagcagcaaggagagaggcggcgtgagcctggccgccctgaagaaggccctggccgccgccggctacgacgtggagaagaacaacagcagaatcaagctgggcatcaagagcctggtgagcaagggcaccctggtgcagaccaagggcaccggcgccagcggcagcttcaagctgaacaagaaggccagcagcgtggagaccaagcccggcgccagcaaggtggccaccaagaccaaggccaccggcgccagcaagaagctgaagaaggccaccggcgccagcaagaagagcgtgaagacccccaagaaggccaagaagcccgccgccaccagaaagagcagcaagaaccccaagaagcccaagaccgtgaagcccaagaaggtggccaagagccccgccaaggccaaggccgtgaagcccaaggccgccaaggccagagtgaccaagcccaagaccgccaagcccaagaaggccgcccccaagaagaagtag

SEQ ID NO: 84561 - DNA, 681 bp, Artificial Sequence
  Description of Artificial Sequence: Synthetic coding sequence
atgagcgagaccgcccccgccgagaccgccacccccgcccccgtggagaagagccccgccaagaagaaggccaccaagaaggccgccggcgccggcgccgccaagagaaaggccaccggcccccccgtgagcgagctgatcaccaaggccgtggccgccagcaaggagagaaacggcctgagcctggccgccctgaagaaggccctggccgccggcggctacgacgtggagaagaacaacagcagaatcaagctgggcctgaagagcctggtgagcaagggcaccctggtgcagaccaagggcaccggcgccagcggcagcttcaagctgaacaagaaggccgccagcggcgaggccaagcccaaggccaagaaggccggcgccgccaaggccaagaagcccgccggcgccacccccaagaaggccaagaaggccgccggcgccaagaaggccgtgaagaagacccccaagaaggccaagaagcccgccgccgccggcgtgaagaaggtggccaagagccccaagaaggccaaggccgccgccaagcccaagaaggccaccaagagccccgccaagcccaaggccgtgaagcccaaggccgccaagcccaaggccgccaagcccaaggccgccaagcccaaggccgccaaggccaagaaggccgccgccaagaagaagtag

SEQ ID NO: 84562 - DNA, 642 bp, Artificial Sequence
  Description of Artificial Sequence: Synthetic coding sequence
atgagcgagaccgcccccgccgcccccgccgccgccccccccgccgagaaggcccccgtgaagaagaaggccgccaagaaggccggcggcacccccagaaaggccagcggcccccccgtgagcgagctgatcaccaaggccgtggccgccagcaaggagagaagcggcgtgagcctggccgccctgaagaaggccctggccgccgccggctacgacgtggagaagaacaacagcagaatcaagctgggcctgaagagcctggtgagcaagggcaccctggtgcagaccaagggcaccggcgccagcggcagcttcaagctgaacaagaaggccgccagcggcgaggccaagcccaaggtgaagaaggccggcggcaccaagcccaagaagcccgtgggcgccgccaagaagcccaagaaggccgccggcggcgccacccccaagaagagcgccaagaagacccccaagaaggccaagaagcccgccgccgccaccgtgaccaagaaggtggccaagagccccaagaaggccaaggtggccaagcccaagaaggccgccaagagcgccgccaaggccgtgaagcccaaggccgccaagcccaaggtggtgaagcccaagaaggccgcccccaagaagaagtag

SEQ ID NO: 84563 - DNA, 666 bp, Artificial Sequence
  Description of Artificial Sequence: Synthetic coding sequence
atgagcgagaccgcccccctggcccccaccatccccgcccccgccgagaagacccccgtgaagaagaaggccaagaaggccggcgccaccgccggcaagagaaaggccagcggcccccccgtgagcgagctgatcaccaaggccgtggccgccagcaaggagagaagcggcgtgagcctggccgccctgaagaaggccctggccgccgccggctacgacgtggagaagaacaacagcagaatcaagctgggcctgaagagcctggtgagcaagggcaccctggtgcagaccaagggcaccggcgccagcggcagcttcaagctgaacaagaaggccgccagcggcgagggcaagcccaaggccaagaaggccggcgccgccaagcccagaaagcccgccggcgccgccaagaagcccaagaaggtggccggcgccgccacccccaagaagagcatcaagaagacccccaagaaggtgaagaagcccgccaccgccgccggcaccaagaaggtggccaagagcgccaagaaggtgaagaccccccagcccaagaaggccgccaagagccccgccaaggccaaggcccccaagcccaaggccgccaagcccaagagcggcaagcccaaggtgaccaaggccaagaaggccgcccccaagaagaagtag

SEQ ID NO: 84564 - DNA, 660 bp, Artificial Sequence
  Description of Artificial Sequence: Synthetic coding sequence
atgagcgagaccgcccccgccgcccccgccgcccccgcccccgccgagaagacccccgtgaagaagaaggccagaaagagcgccggcgccgccaagagaaaggccagcggcccccccgtgagcgagctgatcaccaaggccgtggccgccagcaaggagagaagcggcgtgagcctggccgccctgaagaaggccctggccgccgccggctacgacgtggagaagaacaacagcagaatcaagctgggcctgaagagcctggtgagcaagggcaccctggtgcagaccaagggcaccggcgccagcggcagcttcaagctgaacaagaaggccgccagcggcgaggccaagcccaaggccaagaaggccggcgccgccaaggccaagaagcccgccggcgccgccaagaagcccaagaaggccaccggcgccgccacccccaagaagagcgccaagaagacccccaagaaggccaagaagcccgccgccgccgccggcgccaagaaggccaagagccccaagaaggccaaggccgccaagcccaagaaggcccccaagagccccgccaaggccaaggccgtgaagcccaaggccgccaagcccaagaccgccaagcccaaggccgccaagcccaagaaggccgccgccaagaagaagtag

SEQ ID NO: 84565 - DNA, 624 bp, Artificial Sequence
  Description of Artificial Sequence: Synthetic coding sequence
atgagcgagaccgtgcccgccgccagcgccagcgccggcgtggccgccatggagaagctgcccaccaagaagagaggcagaaagcccgccggcctgatcagcgccagcagaaaggtgcccaacctgagcgtgagcaagctgatcaccgaggccctgagcgtgagccaggagagagtgggcatgagcctggtggccctgaagaaggccctggccgccgccggctacgacgtggagaagaacaacagcagaatcaagctgagcctgaagagcctggtgaacaagggcatcctggtgcagaccagaggcaccggcgccagcggcagcttcaagctgagcaagaaggtgatccccaagagcaccagaagcaaggccaagaagagcgtgagcgccaagaccaagaagctggtgctgagcagagacagcaagagccccaagaccgccaagaccaacaagagagccaagaagcccagagccaccacccccaagaccgtgagaagcggcagaaaggccaagggcgccaagggcaagcagcagcagaagagccccgtgaaggccagagccagcaagagcaagctgacccagcaccacgaggtgaacgtgagaaaggccaccagcaagaagtag

SEQ ID NO: 84566 - DNA, 393 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacagcgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcagagtgaccatcgcccagggcggcgtgctgcccaacatccaggccgtgctgctgcccaagaagaccgagagccaccacaaggccaagggcaagtag

SEQ ID NO: 84567 - DNA, 393 bp, Artificial Sequence
  Description of Artificial Sequence: Synthetic coding sequence
atgagcggcagaggcaagcagggcggcaaggccagagccaaggccaagagcagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcagagtgaccatcgcccagggcggcgtgctgcccaacatccaggccgtgctgctgcccaagaagaccgagagccaccacaaggccaagggcaagtag

SEQ ID NO: 84568 - DNA, 393 bp, Artificial Sequence; identical to SEQ ID NO: 84567
  Description of Artificial Sequence: Synthetic coding sequence

SEQ ID NO: 84569 - DNA, 393 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacagcgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaaggccaagggcaagtag

SEQ ID NO: 84570 - DNA, 393 bp, Artificial Sequence; identical to SEQ ID NO: 84566
  Description of Artificial Sequence: Synthetic coding sequence

SEQ ID NO: 84571 - DNA, 393 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaaggccaagggcaagtag

SEQ ID NO: 84572 - DNA, 387 bp, Artificial Sequence
  Description of Artificial Sequence: Synthetic coding sequence
atgagcggcagaggcaagcagggcggcaaggccagagccaaggccaagaccagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccaccacaagaccaagtag

SEQ ID NO: 84573 - DNA, 393 bp, Artificial Sequence; identical to SEQ ID NO: 84571
  Description of Artificial Sequence: Synthetic coding sequence

SEQ ID NO: 84574 - DNA, 393 bp, Artificial Sequence; identical to SEQ ID NO: 84571
  Description of Artificial Sequence: Synthetic coding sequence

SEQ ID NO: 84575 - DNA, 393 bp, Artificial Sequence; identical to SEQ ID NO: 84571
  Description of Artificial Sequence: Synthetic coding sequence

SEQ ID NO: 84576 - DNA, 384 bp, Artificial Sequence
  Description of Artificial Sequence: Synthetic coding sequence
atgcccgaggtgagcagcaagggcgccaccatcagcaagaagggcttcaagaaggccgtggtgaagacccagaagaaggagggcaagaagagaaagagaaccagaaaggagagctacagcatctacatctacaaggtgctgaagcaggtgcaccccgacaccggcatcagcagcaaggccatgagcatcatgaacagcttcgtgaccgacatcttcgagagaatcgccagcgaggccagcagactggcccactacagcaagagaagcaccatcagcagcagagagatccagaccgccgtgagactgctgctgcccggcgagctggccaagcacgccgtgagcgagggcaccaaggccgtgaccaagtacaccagcagcaagtag

SEQ ID NO: 84577 - DNA, 381 bp, Artificial Sequence
  Description of Artificial Sequence: Synthetic coding sequence
atgcccgagcccagcaagagcgcccccgcccccaagaagggcagcaagaaggccatcaccaaggcccagaagaaggacggcaagaagagaaagagaagcagaaaggagagctacagcatctacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84578 - DNA, 381 bp, Artificial Sequence
  Description of Artificial Sequence: Synthetic coding sequence
atgcccgagcccgccaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84579 - DNA, 381 bp, Artificial Sequence; identical to SEQ ID NO: 84578
  Description of Artificial Sequence: Synthetic coding sequence

SEQ ID NO: 84580 - DNA, 381 bp, Artificial Sequence
  Description of Artificial Sequence: Synthetic coding sequence
atgcccgagcccaccaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84581 - DNA, 381 bp, Artificial Sequence; identical to SEQ ID NO: 84580
  Description of Artificial Sequence: Synthetic coding sequence

SEQ ID NO: 84582 - DNA, 381 bp, Artificial Sequence; identical to SEQ ID NO: 84578
  Description of Artificial Sequence: Synthetic coding sequence

SEQ ID NO: 84583 - DNA, 381 bp, Artificial Sequence; identical to SEQ ID NO: 84578
  Description of Artificial Sequence: Synthetic coding sequence

SEQ ID NO: 84584 - DNA, 381 bp, Artificial Sequence; identical to SEQ ID NO: 84578
  Description of Artificial Sequence: Synthetic coding sequence

SEQ ID NO: 84585 - DNA, 381 bp, Artificial Sequence
  Description of Artificial Sequence: Synthetic coding sequence
atgcccgaccccgccaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84586 - DNA, 381 bp, Artificial Sequence; identical to SEQ ID NO: 84578
  Description of Artificial Sequence: Synthetic coding sequence

SEQ ID NO: 84587 - DNA, 381 bp, Artificial Sequence
  Description of Artificial Sequence: Synthetic coding sequence
atgcccgagctggccaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccagcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84588 - DNA, 381 bp, Artificial Sequence
  Description of Artificial Sequence: Synthetic coding sequence
atgcccgagcccgtgaagagcgcccccgtgcccaagaagggcagcaagaaggccatcaacaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84589 - DNA, 381 bp, Artificial Sequence
  Description of Artificial Sequence: Synthetic coding sequence
atgcccgagcccagcaagagcgcccccgcccccaagaagggcagcaagaaggccgtgaccaaggcccagaagaaggacggcaagaagagaaagagaagcagaaaggagagctacagcgtgtacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84590 - DNA, 381 bp, Artificial Sequence; identical to SEQ ID NO: 84589
  Description of Artificial Sequence: Synthetic coding sequence

SEQ ID NO: 84591 - DNA, 381 bp, Artificial Sequence
  Description of Artificial Sequence: Synthetic coding sequence
atgcccgaccccgccaagagcgcccccgcccccaagaagggcagcaagaaggccgtgaccaaggcccagaagaaggacggcaagaagagaaagagaagcagaaaggagagctacagcatctacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84592 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccgccaccggcggcgtgaagaagccccacagatacagacccggcaccgtggccctgagagagatcagaagataccagaagagcaccgagctgctgatcagaaagctgcccttccagagactggtgagagagatcgcccaggacttcaagaccgacctgagattccagagcagcgccgtgatggccctgcaggaggcctgcgaggcctacctggtgggcctgttcgaggacaccaacctgtgcgccatccacgccaagagagtgaccatcatgcccaaggacatccagctggccagaagaatcagaggcgagagagcctag

SEQ ID NO: 84593 - DNA, 411 bp, Artificial Sequence; identical to SEQ ID NO: 84592
  Description of Artificial Sequence: Synthetic coding sequence

SEQ ID NO: 84594 - DNA, 411 bp, Artificial Sequence; identical to SEQ ID NO: 84592
  Description of Artificial Sequence: Synthetic coding sequence

SEQ ID NO: 84595 - DNA, 411 bp, Artificial Sequence; identical to SEQ ID NO: 84592
  Description of Artificial Sequence: Synthetic coding sequence

SEQ ID NO: 84596 - DNA, 411 bp, Artificial Sequence; identical to SEQ ID NO: 84592
  Description of Artificial Sequence: Synthetic coding sequence

SEQ ID NO: 84597 - DNA, 411 bp, Artificial Sequence; identical to SEQ ID NO: 84592
  Description of Artificial Sequence: Synthetic coding sequence

SEQ ID NO: 84598 - DNA, 411 bp, Artificial Sequence; identical to SEQ ID NO: 84592
  Description of Artificial Sequence: Synthetic coding sequence

SEQ ID NO: 84599 - DNA, 411 bp, Artificial Sequence; identical to SEQ ID NO: 84592
  Description of Artificial Sequence: Synthetic coding sequence

SEQ ID NO: 84600 - DNA, 411 bp, Artificial Sequence; identical to SEQ ID NO: 84592
  Description of Artificial Sequence: Synthetic coding sequence

SEQ ID NO: 84601 - DNA, 411 bp, Artificial Sequence; identical to SEQ ID NO: 84592
  Description of Artificial Sequence: Synthetic coding sequence

SEQ ID NO: 84602 - DNA, 411 bp, Artificial Sequence; identical to SEQ ID NO: 84592
  Description of Artificial Sequence: Synthetic coding sequence

SEQ ID NO: 84603 - DNA, 339 bp, Artificial Sequence
  Description of Artificial Sequence: Synthetic coding sequence
atgagcggcagaggcaagggcggcaagggcctggccaaggccaagacctgcagcagcctgcccggcctgcagttccccggcagagtgagacacctgttcagaaagggcaactacttcgagcccgtgggcgccggcgcccccgtgtacctgcagtacctggccgccgagatcctggagctggtgggcagcgccatcagagacaagaccagaagcatcatccccagacacctgcagctggccatcagaaacgacgaggaggtgaacaagcagctgggcaacgtgaccatcgcccagggcggcgtgctgagcaacatccaggccgtgctgctgcccaagtag

SEQ ID NO: 84604 - DNA, 312 bp, Artificial Sequence
  Description of Artificial Sequence: Synthetic coding sequence
atgagcggcagaggcaagggcggcaagggcctgggcaagggcggcgccaagagacacagaaaggtgctgagagacaacatccagggcatcaccaagcccgccatcagaagactggccagaagaggcggcgtgaagagaatcagcggcctgatctacgaggagaccagaggcgtgctgaaggtgttcctggagaacgtgatcagagacgccgtgacctacaccgagcacgccaagagaaagaccgtgaccgccatggacgtggtgtacgccctgaagagacagggcagaaccctgtacggcttcggcggctag

SEQ ID NO: 84605 - DNA, 312 bp, Artificial Sequence; identical to SEQ ID NO: 84604
  Description of Artificial Sequence: Synthetic coding sequence

SEQ ID NO: 84606 - DNA, 312 bp, Artificial Sequence; identical to SEQ ID NO: 84604
  Description of Artificial Sequence: Synthetic coding sequence

SEQ ID NO: 84607 - DNA, 312 bp, Artificial Sequence; identical to SEQ ID NO: 84604
  Description of Artificial Sequence: Synthetic coding sequence

SEQ ID NO: 84608 - DNA, 312 bp, Artificial Sequence; identical to SEQ ID NO: 84604
  Description of Artificial Sequence: Synthetic coding sequence

SEQ ID NO: 84609 - DNA, 312 bp, Artificial Sequence; identical to SEQ ID NO: 84604
  Description of Artificial Sequence: Synthetic coding sequence

SEQ ID NO: 84610 - DNA, 297 bp, Artificial Sequence
  Description of Artificial Sequence: Synthetic coding sequence
atgagcgtgagaggcaaggccggcaagggcctgggcaagggcggcgccaagtgccacagaaaggtgctgagcgacaacatccagggcatcaccaagtgcaccatcagaagactggccagacacggcggcgtgaagagaatcctgggcctgatctacgaggagaccagaagagtgttcaaggtgttcctggagaacgtgatctggtacgccgtgaccaacaccgagcacgccaagagaaagaccgtgaccgccatggccgtggtgtacgtgctgaagagacagggcagaaccctgtag

SEQ ID NO: 84611 - DNA, 312 bp, Artificial Sequence; identical to SEQ ID NO: 84604
  Description of Artificial Sequence: Synthetic coding sequence

SEQ ID NO: 84612 - DNA, 312 bp, Artificial Sequence; identical to SEQ ID NO: 84604
  Description of Artificial Sequence: Synthetic coding sequence

SEQ ID NO: 84613 - DNA, 312 bp, Artificial Sequence; identical to SEQ ID NO: 84604
  Description of Artificial Sequence: Synthetic coding sequence

SEQ ID NO: 84614 - DNA, 312 bp, Artificial Sequence; identical to SEQ ID NO: 84604
  Description of Artificial Sequence: Synthetic coding sequence

SEQ ID NO: 84615 - DNA, 312 bp, Artificial Sequence; identical to SEQ ID NO: 84604
  Description of Artificial Sequence: Synthetic coding sequence

SEQ ID NO: 84616 - DNA, 312 bp, Artificial Sequence; identical to SEQ ID NO: 84604
  Description of Artificial Sequence: Synthetic coding sequence

SEQ ID NO: 84617 - DNA, 390 bp, Artificial Sequence
  Description of Artificial Sequence: Synthetic coding sequence
atgagcggcagaggcaagcagggcggcaaggccagagccaaggccaagagcagaagcagcagagccggcctgcagttccccgtgggcagagtgcacagactgctgagaaagggcaactacgccgagagagtgggcgccggcgcccccgtgtacatggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccaagaagaccgagagccacaaggccaagagcaagtag

SEQ ID NO: 84618 - DNA, 381 bp, Artificial Sequence
  Description of Artificial Sequence: Synthetic coding sequence
atgcccgagcccgccaagagcgcccccgcccccaagaagggcagcaagaaggccgtgaccaaggcccagaagaaggacggcaagaagagaaagagaagcagaaaggagagctacagcatctacgtgtacaaggtgctgaagcaggtgcaccccgacaccggcatcagcagcaaggccatgggcatcatgaacagcttcgtgaacgacatcttcgagagaatcgccggcgaggccagcagactggcccactacaacaagagaagcaccatcaccagcagagagatccagaccgccgtgagactgctgctgcccggcgagctggccaagcacgccgtgagcgagggcaccaaggccgtgaccaagtacaccagcagcaagtag

SEQ ID NO: 84619 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggccgccagaaagagcgcccccgccaccggcggcgtgaagaagccccacagatacagacccggcaccgtggccctgagagagatcagaagataccagaagagcaccgagctgctgatcagaaagctgcccttccagagactggtgagagagatcgcccaggacttcaagaccgacctgagattccagagcagcgccgtgatggccctgcaggaggccagcgaggcctacctggtgggcctgttcgaggacaccaacctgtgcgccatccacgccaagagagtgaccatcatgcccaaggacatccagctggccagaagaatcagaggcgagagagcctag

SEQ ID NO: 84620 - DNA, 411 bp, Artificial Sequence
  Description of Artificial Sequence: Synthetic coding sequence
atggccagaaccaagcagaccgccagaaagagcaccggcggcaaggcccccagaaagcagctggccaccaaggtggccagaaagagcgcccccgccaccggcggcgtgaagaagccccacagatacagacccggcaccgtggccctgagagagatcagaagataccagaagagcaccgagctgctgatcagaaagctgcccttccagagactgatgagagagatcgcccaggacttcaagaccgacctgagattccagagcagcgccgtgatggccctgcaggaggcctgcgagagctacctggtgggcctgttcgaggacaccaacctgtgcgtgatccacgccaagagagtgaccatcatgcccaaggacatccagctggccagaagaatcagaggcgagagagcctag

SEQ ID NO: 84621 - DNA, 684 bp, Artificial Sequence
  Description of Artificial Sequence: Synthetic coding sequence
atggagggccagagcggcagatgcaagatcgtggtggtgggcgacgccgagtgcggcaagaccgccctgctgcaggtgttcgccaaggacgcctaccccggcagctacgtgcccaccgtgttcgagaactacaccgccagcttcgagatcgacaagagaagaatcgagctgaacatgtgggacaccagcggcagcagctactacgacaacgtgagacccctggcctaccccgacagcgacgccgtgctgatctgcttcgacatcagcagacccgagaccctggacagcgtgctgaagaagtggcagggcgagacccaggagttctgccccaacgccaaggtggtgctggtgggctgcaagctggacatgagaaccgacctggccaccctgagagagctgagcaagcagagactgatccccgtgacccacgagcagggcaccgtgctggccaagcaggtgggcgccgtgagctacgtggagtgcagcagcagaagcagcgagagaagcgtgagagacgtgttccacgtggccaccgtggccagcctgggcagaggccacagacagctgagaagaaccgacagcagaagaggcatgcagagaagcgcccagctgagcggcagacccgacagaggcaacgagggcgagatccacaaggacagagccaagagctgcaacctgatgtag

SEQ ID NO: 84622 - DNA, 3114 bp, Artificial Sequence
  Description of Artificial Sequence: Synthetic coding sequence
atgaacagccccaacgagagcgacggcatgagcggcagagagcccagcctggagatcctgcccagaaccagcctgcacagcatccccgtgaccgtggaggtgaagcccgtgctgcccagagccatgcccagcagcatgggcggcggcggcggcggcagccccagccccgtggagctgagaggcgccctggtgggcagcgtggaccccaccctgagagagcagcagctgcagcaggagctgctggccctgaagcagcagcagcagctgcagaagcagctgctgttcgccgagttccagaagcagcacgaccacctgaccagacagcacgaggtgcagctgcagaagcacctgaagcagcagcaggagatgctggccgccaagcagcagcaggagatgctggccgccaagagacagcaggagctggagcagcagagacagagagagcagcagagacaggaggagctggagaagcagagactggagcagcagctgctgatcctgagaaacaaggagaagagcaaggagagcgccatcgccagcaccgaggtgaagctgagactgcaggagttcctgctgagcaagagcaaggagcccacccccggcggcctgaaccacagcctgccccagcaccccaagtgctggggcgcccaccacgccagcctggaccagagcagccccccccagagcggcccccccggcaccccccccagctacaagctgcccctgcccggcccctacgacagcagagacgacttccccctgagaaagaccgccagcgagcccaacctgaaggtgagaagcagactgaagcagaaggtggccgagagaagaagcagccccctgctgagaagaaaggacggcaccgtgatcagcaccttcaagaagagagccgtggagatcaccggcgccggccccggcgccagcagcgtgtgcaacagcgcccccggcagcggccccagcagccccaacagcagccacagcaccatcgccgagaacggcttcaccggcagcgtgcccaacatccccaccgagatgctgccccagcacagagccctgcccctggacagcagccccaaccagttcagcctgtacaccagccccagcctgcccaacatcagcctgggcctgcaggccaccgtgaccgtgaccaacagccacctgaccgccagccccaagctgagcacccagcaggaggccgagagacaggccctgcagagcctgagacagggcggcaccctgaccggcaagttcatgagcaccagcagcatccccggctgcctgctgggcgtggccctggagggcgacggcagcccccacggccacgccagcctgctgcagcacgtgctgctgctggagcaggccagacagcagagcaccctgatcgccgtgcccctgcacggccagagccccctggtgaccggcgagagagtggccaccagcatgagaaccgtgggcaagctgcccagacacagacccctgagcagaacccagagcagccccctgccccagagcccccaggccctgcagcagctggtgatgcagcagcagcaccagcagttcctggagaagcagaagcagcagcagctgcagctgggcaagatcctgaccaagaccggcgagctgcccagacagcccaccacccaccccgaggagaccgaggaggagctgaccgagcagcaggaggtgctgctgggcgagggcgccctgaccatgcccagagagggcagcaccgagagcgagagcacccaggaggacctggaggaggaggacgaggaggacgacggcgaggaggaggaggactgcatccaggtgaaggacgaggagggcgagagcggcgccgaggagggccccgacctggaggagcccggcgccggctacaagaagctgttcagcgacgcccagcccctgcagcccctgcaggtgtaccaggcccccctgagcctggccaccgtgccccaccaggccctgggcagaacccagagcagccccgccgcccccggcggcatgaagagcccccccgaccagcccgtgaagcacctgttcaccaccggccccatcagccagaagatgtacgccgtgctgccctgcggcggcatcggcgtggacagcgacaccgtgtggaacgagatgcacagcagcagcgccgtgagaatggccgtgggctgcctgctggagctggccttcaaggtggccgccggcgagctgaagaacggcttcgccatcatcagaccccccggccaccacgccgaggagagcaccgccatgggcttctgcttcttcaacagcgtggccatcaccgccaagctgctgcagcagaagctgaacgtgggcaaggtgctgatcgtggactgggacatccaccacggcaacggcacccagcaggccttctacaacgaccccagcgtgctgtacatcagcctgcacagatacgacaacggcaacttcttccccggcagcggcgcccccgaggaggtgggcggcggccccggcgtgggctacaacgtgaacgtggcctggaccggcggcgtggacccccccatcggcgacgtggagtacctgaccgccttcagaaccgtggtgatgcccatcgcccacgagttcagccccgacgtggtgctggtgagcgccggcttcgacgccgtggagggccacctgagccccctgggcggctacagcgtgaccgccagatgcttcggccacctgaccagacagctgatgaccctggccggcggcagagtggtgctggccctggagggcggccacgacctgaccgccatctgcgacgccagcgaggcctgcgtgagcgccctgctgagcgtggagctgcagcccctggacgaggccgtgctgcagcagaagcccaacatcaacgccgtggccaccctggagaaggtgatcgagatccagagcaagcactggagctgcgtgcagaagttcgccgccggcctgggcagaagcctgagagaggcccaggccggcgagaccgaggaggccgagaccgtgagcgccatggccctgctgagcgtgggcgccgagcaggcccaggccgccgccgccagagagcacagccccagacccgccgaggagcccatggagcaggagcccgccctgtag

SEQ ID NO: 84623 - DNA, 3369 bp, Artificial Sequence
  Description of Artificial Sequence: Synthetic coding sequence
atgaacagccccaacgagagcgacggcatgagcggcagagagcccagcctggagatcctgcccagaaccagcctgcacagcatccccgtgaccgtggaggtgaagcccgtgctgcccagagccatgcccagcagcatgggcggcggcggcggcggcagccccagccccgtggagctgagaggcgccctggtgggcagcgtggaccccaccctgagagagcagcagctgcagcaggagctgctggccctgaagcagcagcagcagctgcagaagcagctgctgttcgccgagttccagaagcagcacgaccacctgaccagacagcacgaggtgcagctgcagaagcacctgaagcagcagcaggagatgctggccgccaagcagcagcaggagatgctggccgccaagagacagcaggagctggagcagcagagacagagagagcagcagagacaggaggagctggagaagcagagactggagcagcagctgctgatcctgagaaacaaggagaagagcaaggagagcgccatcgccagcaccgaggtgaagctgagactgcaggagttcctgctgagcaagagcaaggagcccacccccggcggcctgaaccacagcctgccccagcaccccaagtgctggggcgcccaccacgccagcctggaccagagcagccccccccagagcggcccccccggcaccccccccagctacaagctgcccctgcccggcccctacgacagcagagacgacttccccctgagaaagaccgccagcgagcccaacctgaaggtgagaagcagactgaagcagaaggtggccgagagaagaagcagccccctgctgagaagaaaggacggcaccgtgatcagcaccttcaagaagagagccgtggagatcaccggcgccggccccggcgccagcagcgtgtgcaacagcgcccccggcagcggccccagcagccccaacagcagccacagcaccatcgccgagaacggcttcaccggcagcgtgcccaacatccccaccgagatgctgccccagcacagagccctgcccctggacagcagccccaaccagttcagcctgtacaccagccccagcctgcccaacatcagcctgggcctgcaggccaccgtgaccgtgaccaacagccacctgaccgccagccccaagctgagcacccagcaggaggccgagagacaggccctgcagagcctgagacagggcggcaccctgaccggcaagttcatgagcaccagcagcatccccggctgcctgctgggcgtggccctggagggcgacggcagcccccacggccacgccagcctgctgcagcacgtgctgctgctggagcaggccagacagcagagcaccctgatcgccgtgcccctgcacggccagagccccctggtgaccggcgagagagtggccaccagcatgagaaccgtgggcaagctgcccagacacagacccctgagcagaacccagagcagccccctgccccagagcccccaggccctgcagcagctggtgatgcagcagcagcaccagcagttcctggagaagcagaagcagcagcagctgcagctgggcaagatcctgaccaagaccggcgagctgcccagacagcccaccacccaccccgaggagaccgaggaggagctgaccgagcagcaggaggtgctgctgggcgagggcgccctgaccatgcccagagagggcagcaccgagagcgagagcacccaggaggacctggaggaggaggacgaggaggacgacggcgaggaggaggaggactgcatccaggtgaaggacgaggagggcgagagcggcgccgaggagggccccgacctggaggagcccggcgccggctacaagaagctgttcagcgacgcccagcccctgcagcccctgcaggtgtaccaggcccccctgagcctggccaccgtgccccaccaggccctgggcagaacccagagcagccccgccgcccccggcggcatgaagagcccccccgaccagcccgtgaagcacctgttcaccaccggcgtggtgtacgacaccttcatgctgaagcaccagtgcatgtgcggcaacacccacgtgcaccccgagcacgccggcagaatccagagcatctggagcagactgcaggagaccggcctgctgagcaagtgcgagagaatcagaggcagaaaggccaccctggacgagatccagaccgtgcacagcgagtaccacaccctgctgtacggcaccagccccctgaacagacagaagctggacagcaagaagctgctgggccccatcagccagaagatgtacgccgtgctgccctgcggcggcatcggcgtggacagcgacaccgtgtggaacgagatgcacagcagcagcgccgtgagaatggccgtgggctgcctgctggagctggccttcaaggtggccgccggcgagctgaagaacggcttcgccatcatcagaccccccggccaccacgccgaggagagcaccgccatgggcttctgcttcttcaacagcgtggccatcaccgccaagctgctgcagcagaagctgaacgtgggcaaggtgctgatcgtggactgggacatccaccacggcaacggcacccagcaggccttctacaacgaccccagcgtgctgtacatcagcctgcacagatacgacaacggcaacttcttccccggcagcggcgcccccgaggaggtgggcggcggccccggcgtgggctacaacgtgaacgtggcctggaccggcggcgtggacccccccatcggcgacgtggagtacctgaccgccttcagaaccgtggtgatgcccatcgcccacgagttcagccccgacgtggtgctggtgagcgccggcttcgacgccgtggagggccacctgagccccctgggcggctacagcgtgaccgccagatgcttcggccacctgaccagacagctgatgaccctggccggcggcagagtggtgctggccctggagggcggccacgacctgaccgccatctgcgacgccagcgaggcctgcgtgagcgccctgctgagcgtggagctgcagcccctggacgaggccgtgctgcagcagaagcccaacatcaacgccgtggccaccctggagaaggtgatcgagatccagagcaagcactggagctgcgtgcagaagttcgccgccggcctgggcagaagcctgagagaggcccaggccggcgagaccgaggaggccgagaccgtgagcgccatggccctgctgagcgtgggcgccgagcaggcccaggccgccgccgccagagagcacagccccagacccgccgaggagcccatggagcaggagcccgccctgtag

SEQ ID NO: 84624 - DNA, 1776 bp, Artificial Sequence
  Description of Artificial Sequence: Synthetic coding sequence
atgatgagcagccccgcccagagcagaagccccgacctgatgtggaacctggtgccctgggtgctgttctgcggctgctgcagaatcttccccgacggcgtggccggcagagagcagctgctggcccagcagagaatgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84625 - DNA, 2772 bp, Artificial Sequence
  Description of Artificial Sequence: Synthetic coding sequence
ctgcacaagctgagcagcctggtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagcccttcctggagcccacccacaccagagccctgagcgtgagacaggcccccctggccgccgtgggcatggacggcctggagaagcacagactggtgagcagaacccacagcagccccgccgccagcgtgctgccccaccccgccatggacagacccctgcagcccggcagcgccaccggcatcgcctacgaccccctgatgctgaagcaccagtgcgtgtgcggcaacagcaccacccaccccgagcacgccggcagaatccagagcatctggagcagactgcaggagaccggcctgctgaacaagtgcgagagaatccagggcagaaaggccagcctggaggagatccagctggtgcacagcgagcaccacagcctgctgtacggcaccaaccccctggacggccagaagctggaccccagaatcctgctgggcgacgacagccagaagttcttcagcagcctgccctgcggcggcctgggcgtggacagcgacaccatctggaacgagctgcacagcagcggcgccgccagaatggccgtgggctgcgtgatcgagctggccagcaaggtggccagcggcgagctgaagaacggcttcgccgtggtgagaccccccggccaccacgccgaggagagcaccgccatgggcttctgcttcttcaacagcgtggccatcaccgccaagtacctgagagaccagctgaacatcagcaagatcctgatcgtggacctggacgtgcaccacggcaacggcacccagcaggccttctacgccgaccccagcatcctgtacatcagcctgcacagatacgacgagggcaacttcttccccggcagcggcgcccccaacgaggtgggcaccggcctgggcgagggctacaacatcaacatcgcctggaccggcggcctggacccccccatgggcgacgtggagtacctggaggccttcagaaccatcgtgaagcccgtggccaaggagttcgaccccgacatggtgctggtgagcgccggcttcgacgccctggagggccacaccccccccctgggcggctacaaggtgaccgccaagtgcttcggccacctgaccaagcagctgatgaccctggccgacggcagagtggtgctggccctggagggcggccacgacctgaccgccatctgcgacgccagcgaggcctgcgtgaacgccctgctgggcaacgagctggagcccctggccgaggacatcctgcaccagagccccaacatgaacgccgtgatcagcctgcagaagatcatcgagatccagagcatgagcctgaagttcagctag

SEQ ID NO: 84626 - DNA, 3078 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcagcccttcctggagcccacccacaccagagccctgagcgtgagacaggcccccctggccgccgtgggcatggacggcctggagaagcacagactggtgagcagaacccacagcagccccgccgccagcgtgctgccccaccccgccatggacagacccctgcagcccggcagcgccaccggcatcgcctacgaccccctgatgctgaagcaccagtgcgtgtgcggcaacagcaccacccaccccgagcacgccggcagaatccagagcatctggagcagactgcaggagaccggcctgctgaacaagtgcgagagaatccagggcagaaaggccagcctggaggagatccagctggtgcacagcgagcaccacagcctgctgtacggcaccaaccccctggacggccagaagctggaccccagaatcctgctgggcgacgacagccagaagttcttcagcagcctgccctgcggcggcctgggcgtggacagcgacaccatctggaacgagctgcacagcagcggcgccgccagaatggccgtgggctgcgtgatcgagctggccagcaaggtggccagcggcgagctgaagaacggcttcgccgtggtgagaccccccggccaccacgccgaggagagcaccgccatgggcttctgcttcttcaacagcgtggccatcaccgccaagtacctgagagaccagctgaacatcagcaagatcctgatcgtggacctggacgtgcaccacggcaacggcacccagcaggccttctacgccgaccccagcatcctgtacatcagcctgcacagatacgacgagggcaacttcttccccggcagcggcgcccccaacgaggtgggcaccggcctgggcgagggctacaacatcaacatcgcctggaccggcggcctggacccccccatgggcgacgtggagtacctggaggccttcagaaccatcgtgaagcccgtggccaaggagttcgaccccgacatggtgctggtgagcgccggcttcgacgccctggagggccacaccccccccctgggcggctacaaggtgaccgccaagtgcttcggccacctgaccaagcagctgatgaccctggccgacggcagagtggtgctggccctggagggcggccacgacctgaccgccatctgcgacgccagcgaggcctgcgtgaacgccctgctgggcaacgagctggagcccctggccgaggacatcctgcaccagagccccaacatgaacgccgtgatcagcctgcagaagatcatcgagatccagagcaagtactggaagagcgtgagaatggtggccgtgcccagaggctgcgccctggccggcgcccagctgcaggaggagaccgagaccgtgagcgccctggccagcctgaccgtggacgtggagcagcccttcgcccaggaggacagcagaaccgccggcgagcccatggaggaggagcccgccctgtag

SEQ ID NO: 84627 - DNA, 1773 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84628 - DNA, 1734 bp, Artificial Sequence
  Description of Artificial Sequence: Synthetic coding sequence
atgctgcagaccatctacgagagcgacagctgcttcagcagcgacggcgtggccggcagagagcagctgctggcccagcagagaatgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84629 - DNA, 3201 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcagcccttcctggagcccacccacaccagagccctgagcgtgagacaggcccccctggccgccgtgggcatggacggcctggagaagcacagactggtgagcagaacccacagcagccccgccgccagcgtgctgccccaccccgccatggacagacccctgcagcccggcagcgccaccggcatcgcctacgaccccctgatgctgaagcaccagtgcgtgtgcggcaacagcaccacccaccccgagcacgccggcagaatccagagcatctggagcagactgcaggagaccggcctgctgaacaagtgcgagagaatccagggcagaaaggccagcctggaggagatccagctggtgcacagcgagcaccacagcctgctgtacggcaccaaccccctggacggccagaagctggaccccagaatcctgctgggcgacgacagccagaagttcttcagcagcctgccctgcggcggcctgggcgtggacagcgacaccatctggaacgagctgcacagcagcggcgccgccagaatggccgtgggctgcgtgatcgagctggccagcaaggtggccagcggcgagctgaagaacggcttcgccgtggtgagaccccccggccaccacgccgaggagagcaccgccatgggcttctgcttcttcaacagcgtggccatcaccgccaagtacctgagagaccagctgaacatcagcaagatcctgatcgtggacctggacgtgcaccacggcaacggcacccagcaggccttctacgccgaccccagcatcctgtacatcagcctgcacagatacgacgagggcaacttcttccccggcagcggcgcccccaacgaggtgggcaccggcctgggcgagggctacaacatcaacatcgcctggaccggcggcctggacccccccatgggcgacgtggagtacctggaggccttcagaaccatcgtgaagcccgtggccaaggagttcgaccccgacatggtgctggtgagcgccggcttcgacgccctggagggccacaccccccccctgggcggctacaaggtgaccgccaagtgcttcggccacctgaccaagcagctgatgaccctggccgacggcagagtggtgctggccctggagggcggccacgacctgaccgccatctgcgacgccagcgaggcctgcgtgaacgccctgctgggcaacgagctggagcccctggccgaggacatcctgcaccagagccccaacatgaacgccgtgatcagcctgcagaagatcatcgagatccagagcaagtactggaagagcgtgagaatggtggccgtgcccagaggctgcgccctggccggcgcccagctgcaggaggagaccgagaccgtgagcgccctggccagcctgaccgtggacgtggagcagcccttcgcccaggaggacagcagaaccgccggcgagcccatggaggaggagcccgccctgtag

SEQ ID NO: 84630 - DNA, 447 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagtag

SEQ ID NO: 84631 - DNA, 417 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagtag

SEQ ID NO: 84632 - DNA, 1767 bp, Artificial Sequence
  Description of Artificial Sequence: Synthetic coding sequence
atgatgagcagccccgcccagcccgacctgatgtggaacctggtgccctgggtgctgttctgcggctgctgcagaatcttccccgacggcgtggccggcagagagcagctgctggcccagcagagaatgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84633 - DNA, 1641 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84634 - DNA, 3036 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcagcccttcctggagcccacccacaccagagccctgagcgtgagacaggcccccctggccgccgtgggcatggacggcctggagaagcacagactggtgagcagaacccacagcagccccgccgccagcgtgctgccccaccccgccatggacagacccctgcagcccggcagcgccaccggcatcgcctacgaccccctgatgctgaagcaccagtgcgtgtgcggcaacagcaccacccaccccgagcacgccggcagaatccagagcatctggagcagactgcaggagaccggcctgctgaacaagtgcgagagaatccagggcagaaaggccagcctggaggagatccagctggtgcacagcgagcaccacagcctgctgtacggcaccaaccccctggacggccagaagctggaccccagaatcctgctgggcgacgacagccagaagttcttcagcagcctgccctgcggcggcctgggcgtggacagcgacaccatctggaacgagctgcacagcagcggcgccgccagaatggccgtgggctgcgtgatcgagctggccagcaaggtggccagcggcgagctgaagaacggcttcgccgtggtgagaccccccggccaccacgccgaggagagcaccgccatgggcttctgcttcttcaacagcgtggccatcaccgccaagtacctgagagaccagctgaacatcagcaagatcctgatcgtggacctggacgtgcaccacggcaacggcacccagcaggccttctacgccgaccccagcatcctgtacatcagcctgcacagatacgacgagggcaacttcttccccggcagcggcgcccccaacgaggtgggcaccggcctgggcgagggctacaacatcaacatcgcctggaccggcggcctggacccccccatgggcgacgtggagtacctggaggccttcagaaccatcgtgaagcccgtggccaaggagttcgaccccgacatggtgctggtgagcgccggcttcgacgccctggagggccacaccccccccctgggcggctacaaggtgaccgccaagtgcttcggccacctgaccaagcagctgatgaccctggccgacggcagagtggtgctggccctggagggcggccacgacctgaccgccatctgcgacgccagcgaggcctgcgtgaacgccctgctgggcaacgagctggagcccctggccgaggacatcctgcaccagagccccaacatgaacgccgtgatcagcctgcagaagatcatcgagatccagagcatgagcctgaagttcagctag

SEQ ID NO: 84635 - DNA, 72 bp, Artificial Sequence
  Description of Artificial Sequence: Synthetic coding sequence
atgcacagcatgatcagcagcgtggacgtgaagagcgaggtgcccgtgggcctggagcccatcagcccctag

SEQ ID NO: 84636 - DNA, 3210 bp, Artificial Sequence
  Description of Artificial Sequence: Synthetic coding sequence
atgcacagcatgatcagcagcgtggacgtgaagagcgaggtgcccgtgggcctggagcccatcagccccctggacctgagaaccgacctgagaatgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcagcccttcctggagcccacccacaccagagccctgagcgtgagacaggcccccctggccgccgtgggcatggacggcctggagaagcacagactggtgagcagaacccacagcagccccgccgccagcgtgctgccccaccccgccatggacagacccctgcagcccggcagcgccaccggcatcgcctacgaccccctgatgctgaagcaccagtgcgtgtgcggcaacagcaccacccaccccgagcacgccggcagaatccagagcatctggagcagactgcaggagaccggcctgctgaacaagtgcgagagaatccagggcagaaaggccagcctggaggagatccagctggtgcacagcgagcaccacagcctgctgtacggcaccaaccccctggacggccagaagctggaccccagaatcctgctgggcgacgacagccagaagttcttcagcagcctgccctgcggcggcctgggcgtggacagcgacaccatctggaacgagctgcacagcagcggcgccgccagaatggccgtgggctgcgtgatcgagctggccagcaaggtggccagcggcgagctgaagaacggcttcgccgtggtgagaccccccggccaccacgccgaggagagcaccgccatgggcttctgcttcttcaacagcgtggccatcaccgccaagtacctgagagaccagctgaacatcagcaagatcctgatcgtggacctggacgtgcaccacggcaacggcacccagcaggccttctacgccgaccccagcatcctgtacatcagcctgcacagatacgacgagggcaacttcttccccggcagcggcgcccccaacgaggtgggcaccggcctgggcgagggctacaacatcaacatcgcctggaccggcggcctggacccccccatgggcgacgtggagtacctggaggccttcagaaccatcgtgaagcccgtggccaaggagttcgaccccgacatggtgctggtgagcgccggcttcgacgccctggagggccacaccccccccctgggcggctacaaggtgaccgccaagtgcttcggccacctgaccaagcagctgatgaccctggccgacggcagagtggtgctggccctggagggcggccacgacctgaccgccatctgcgacgccagcgaggcctgcgtgaacgccctgctgggcaacgagctggagcccctggccgaggacatcctgcaccagagccccaacatgaacgccgtgatcagcctgcagaagatcatcgagatccagagcaagtactggaagagcgtgagaatggtggccgtgcccagaggctgcgccctggccggcgcccagctgcaggaggagaccgagaccgtgagcgccctggccagcctgaccgtggacgtggagcagcccttcgcccaggaggacagcagaaccgccggcgagcccatggaggaggagcccgccctgtag

SEQ ID NO: 84637 - DNA, 1689 bp, Artificial Sequence
  Description of Artificial Sequence: Synthetic coding sequence
atgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaagctgcagcaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtggtacaccgccgcccaccacaccagcctggaccagagcagcccccccctgagcggcaccagccccagctacaagtacaccctgcccggcgcccaggacgccaaggacgacttccccctgagaaagaccgccagcgagcccaacctgaaggtgagaagcagactgaagcagaaggtggccgagagaagaagcagccccctgctgagaagaaaggacggcaacgtggtgaccagcttcaagaagagaatgttcgaggtgaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84638 - DNA, 1542 bp, Artificial Sequence
  Description of Artificial Sequence: Synthetic coding sequence
atgatgatgcccgtggtggaccccgtggtgagagagaagcagctgcagcaggagctgctgctgatccagcagcagcagcagatccagaagcagctgctgatcgccgagttccagaagcagcacgagaacctgaccagacagcaccaggcccagctgcaggagcacatcaaggagctgctggccatcaagcagcagcaggagctgctggagaaggagcagaagctggagcagcagagacaggagcaggaggtggagagacacagaagagagcagcagctgccccccctgagaggcaaggacagaggcagagagagagccgtggccagcaccgaggtgaagcagaagctgcaggagttcctgctgagcaagagcgccaccaaggacacccccaccaacggcaagaaccacagcgtgagcagacaccccaagctgtgggccgcccaccacaccagcctggaccagagcagcccccccctgagcggcaccagccccagctacaagtacaccctgcccggcgcccaggacgccaaggacgacttccccctgagaaagaccgagagcagcgtgagcagcagcagccccggcagcggccccagcagccccaacaacggccccaccggcagcgtgaccgagaacgagaccagcgtgctgccccccaccccccacgccgagcagatggtgagccagcagagaatcctgatccacgaggacagcatgaacctgctgagcctgtacaccagccccagcctgcccaacatcaccctgggcctgcccgccgtgcccagccagctgaacgccagcaacagcctgaaggagaagcagaagtgcgagacccagaccctgagacagggcgtgcccctgcccggccagtacggcggcagcatccccgccagcagcagccacccccacgtgaccctggagggcaagccccccaacagcagccaccaggccctgctgcagcacctgctgctgaaggagcagatgagacagcagaagctgctggtggccggcggcgtgcccctgcacccccagagccccctggccaccaaggagagaatcagccccggcatcagaggcacccacaagctgcccagacacagacccctgaacagaacccagagcgcccccctgccccagagcaccctggcccagctggtgatccagcagcagcaccagcagttcctggagaagcagaagcagtaccagcagcagatccacatgaacaagctgctgagcaagagcatcgagcagctgaagcagcccggcagccacctggaggaggccgaggaggagctgcagggcgaccaggccatgcaggaggacagagcccccagcagcggcaacagcaccagaagcgacagcagcgcctgcgtggacgacaccctgggccaggtgggcgccgtgaaggtgaaggaggagcccgtggacagcgacgaggacgcccagatccaggagatggagagcggcgagcaggccgccttcatgcagcaggtgatcggcaaggacctggcccccggcttcgtgatcaaggtgatcatctag

SEQ ID NO: 84639 - DNA, 1980 bp, Artificial Sequence
  Description of Artificial Sequence: Synthetic coding sequence
atgagagtgaaccacaccgtgagcaccatgctgcccacctgcatggtgcacagacagaccatgagctgcagcggcgccggcggcatcaccgccttcgtggccttcagagacgtggccgtgtacttcacccaggaggagtggagactgctgagccccgcccagagaaccctgcacagagaggtgatgctggagacctacaaccacctggtgagcctggagatccccagcagcaagcccaagctgatcgcccagctggagagaggcgaggccccctggagagaggagagaaagtgccccctggacctgtgccccgagagcaagcccgagatccagctgagccccagctgccccctgatcttcagcagccagcaggccctgagccagcacgtgtggctgagccacctgagccagctgttcagcagcctgtgggccggcaaccccctgcacctgggcaagcactaccccgaggaccagaagcagcagcaggaccccttctgcttcagcggcaaggccgagtggatccaggagggcgaggacagcagactgctgttcggcagagtgagcaagaacggcaccagcaaggccctgagcagcccccccgaggagcagcagcccgcccagagcaaggaggacaacaccgtggtggacatcggcagcagccccgagagaagagccgacctggaggagaccgacaaggtgctgcacggcctggaggtgagcggcttcggcgagatcaagtacgaggagttcggccccggcttcatcaaggagagcaacctgctgagcctgcagaagacccagaccggcgagaccccctacatgtacaccgagtggggcgacagcttcggcagcatgagcgtgctgatcaagaaccccagaacccacagcggcggcaagccctacgtgtgcagagagtgcggcagaggcttcacctggaagagcaacctgatcacccaccagagaacccacagcggcgagaagccctacgtgtgcaaggactgcggcagaggcttcacctggaagagcaacctgttcacccaccagagaacccacagcggcctgaagccctacgtgtgcaaggagtgcggccagagcttcagcctgaagagcaacctgatcacccaccagagagcccacaccggcgagaagccctacgtgtgcagagagtgcggcagaggcttcagacagcacagccacctggtgagacacaagagaacccacagcggcgagaagccctacatctgcagagagtgcgagcagggcttcagccagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacgccggcggcaagccccacgtgtgcagagagtgcggccagggcttcagcagacagagccacctgatcagacaccagagaacccacagcggcgagaagccctacatctgcagaaagtgcggcagaggcttcagcagaaagagcaacctgatcagacaccagagaacccacagcggctag

SEQ ID NO: 84640 - DNA, 1923 bp, Artificial Sequence
  Description of Artificial Sequence: Synthetic coding sequence
atggccaccggcctgctgagagccaagaaggaggccttcgtggccttcagagacgtggccgtgtacttcacccaggaggagtggagactgctgagccccgcccagagaaccctgcacagagaggtgatgctggagacctacaaccacctggtgagcctggagatccccagcagcaagcccaagctgatcgcccagctggagagaggcgaggccccctggagagaggagagaaagtgccccctggacctgtgccccgagagcaagcccgagatccagctgagccccagctgccccctgatcttcagcagccagcaggccctgagccagcacgtgtggctgagccacctgagccagctgttcagcagcctgtgggccggcaaccccctgcacctgggcaagcactaccccgaggaccagaagcagcagcaggaccccttctgcttcagcggcaaggccgagtggatccaggagggcgaggacagcagactgctgttcggcagagtgagcaagaacggcaccagcaaggccctgagcagcccccccgaggagcagcagcccgcccagagcaaggaggacaacaccgtggtggacatcggcagcagccccgagagaagagccgacctggaggagaccgacaaggtgctgcacggcctggaggtgagcggcttcggcgagatcaagtacgaggagttcggccccggcttcatcaaggagagcaacctgctgagcctgcagaagacccagaccggcgagaccccctacatgtacaccgagtggggcgacagcttcggcagcatgagcgtgctgatcaagaaccccagaacccacagcggcggcaagccctacgtgtgcagagagtgcggcagaggcttcacctggaagagcaacctgatcacccaccagagaacccacagcggcgagaagccctacgtgtgcaaggactgcggcagaggcttcacctggaagagcaacctgttcacccaccagagaacccacagcggcctgaagccctacgtgtgcaaggagtgcggccagagcttcagcctgaagagcaacctgatcacccaccagagagcccacaccggcgagaagccctacgtgtgcagagagtgcggcagaggcttcagacagcacagccacctggtgagacacaagagaacccacagcggcgagaagccctacatctgcagagagtgcgagcagggcttcagccagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacgccggcggcaagccccacgtgtgcagagagtgcggccagggcttcagcagacagagccacctgatcagacaccagagaacccacagcggcgagaagccctacatctgcagaaagtgcggcagaggcttcagcagaaagagcaacctgatcagacaccagagaacccacagcggctag

SEQ ID NO: 84641 - DNA, 1317 bp, Artificial Sequence
  Description of Artificial Sequence: Synthetic coding sequence
atgctggagacctacaaccacctggtgagcctggagatccccagcagcaagcccaagctgatcgcccagctggagagaggcgaggccccctggagagaggagagaaagtgccccctggacctgtgccccgagagcaagcccgagatccagctgagccccagctgccccctgatcttcagcagccagcaggccctgagccagcacgtgtggctgagccacctgagccagctgttcagcagcctgtgggccggcaaccccctgcacctgggcaagcactaccccgaggaccagaagcagcagcaggaccccttctgcttcagcggcaaggccgagtggatccaggagggcgaggacagcagactgctgttcggcagagtgagcaagaacggcaccagcaaggccctgagcagcccccccgaggagcagcagcccgcccagagcaaggaggacaacaccgtggtggacatcggcagcagccccgagagaagagccgacctggaggagaccgacaaggtgctgcacggcctggaggtgagcggcttcggcgagatcaagtacgaggagttcggccccggcttcatcaaggagagcaacctgctgagcctgcagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacgccggcggcaagccccacgtgtgcagagagtgcggccagggcttcagcagacagagccacctgatcagacaccagagaacccacagcggcgagaagccctacatctgcagaaagtgcggcagaggcttcagcagaaagagcaacctgatcagacaccagagaacccacagcggctag

SEQ ID NO: 84642 - DNA, 1797 bp, Artificial Sequence
  Description of Artificial Sequence: Synthetic coding sequence
atgctggagacctacaaccacctggtgagcctggagatccccagcagcaagcccaagctgatcgcccagctggagagaggcgaggccccctggagagaggagagaaagtgccccctggacctgtgccccgagagcaagcccgagatccagctgagccccagctgccccctgatcttcagcagccagcaggccctgagccagcacgtgtggctgagccacctgagccagctgttcagcagcctgtgggccggcaaccccctgcacctgggcaagcactaccccgaggaccagaagcagcagcaggaccccttctgcttcagcggcaaggccgagtggatccaggagggcgaggacagcagactgctgttcggcagagtgagcaagaacggcaccagcaaggccctgagcagcccccccgaggagcagcagcccgcccagagcaaggaggacaacaccgtggtggacatcggcagcagccccgagagaagagccgacctggaggagaccgacaaggtgctgcacggcctggaggtgagcggcttcggcgagatcaagtacgaggagttcggccccggcttcatcaaggagagcaacctgctgagcctgcagaagacccagaccggcgagaccccctacatgtacaccgagtggggcgacagcttcggcagcatgagcgtgctgatcaagaaccccagaacccacagcggcggcaagccctacgtgtgcagagagtgcggcagaggcttcacctggaagagcaacctgatcacccaccagagaacccacagcggcgagaagccctacgtgtgcaaggactgcggcagaggcttcacctggaagagcaacctgttcacccaccagagaacccacagcggcctgaagccctacgtgtgcaaggagtgcggccagagcttcagcctgaagagcaacctgatcacccaccagagagcccacaccggcgagaagccctacgtgtgcagagagtgcggcagaggcttcagacagcacagccacctggtgagacacaagagaacccacagcggcgagaagccctacatctgcagagagtgcgagcagggcttcagccagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacgccggcggcaagccccacgtgtgcagagagtgcggccagggcttcagcagacagagccacctgatcagacaccagagaacccacagcggcgagaagccctacatctgcagaaagtgcggcagaggcttcagcagaaagagcaacctgatcagacaccagagaacccacagcggctag

SEQ ID NO: 84643 - DNA, 2190 bp, Artificial Sequence
  Description of Artificial Sequence: Synthetic coding sequence
agctggctgggccccggcaaggccagcctgctgagaagcttcccccacctgtgcaccctgctgcccgacttcagactgcaggacccccagagagcccccgccttccacctgagcagcgagaccctgcccttcagcagaaagagcacccaggagaccagaaagatggccaccggcctgctgagagccaagaaggaggccttcgtggccttcagagacgtggccgtgtacttcacccaggaggagtggagactgctgagccccgcccagagaaccctgcacagagaggtgatgctggagacctacaaccacctggtgagcctggagatccccagcagcaagcccaagctgatcgcccagctggagagaggcgaggccccctggagagaggagagaaagtgccccctggacctgtgccccgccgagagcaagcccgagatccagctgagccccagctgccccctgatcttcagcagccagcaggccctgagccagcacgtgtggctgagccacctgagccagctgttcagcagcctgtgggccggcaaccccctgcacctgggcaagcactaccccgaggaccagaagcagcagcaggaccccttctgcttcagcggcaaggccgagtggatccaggagggcgaggacagcagactgctgttcggcagagtgagcaagaacggcaccagcaaggccctgagcagcccccccgaggagcagcagcccgcccagagcaaggaggacaacaccgtggtggacatcggcagcagccccgagagaagagccgacctggaggagaccgacaaggtgctgcacggcctggaggtgagcggcttcggcgagatcaagtacgaggagttcggccccggcttcatcaaggagagcaacctgctgagcctgcagaagacccagaccggcgagaccccctacatgtacaccgagtggggcgacagcttcggcagcatgagcgtgctgatcaagaaccccagaacccacagcggcggcaagccctacgtgtgcagagagtgcggcagaggcttcacctggaagagcaacctgatcacccaccagagaacccacagcggcgagaagccctacgtgtgcaaggactgcggcagaggcttcacctggaagagcaacctgttcacccaccagagaacccacagcggcctgaagccctacgtgtgcaaggagtgcggccagagcttcagcctgaagagcaacctgatcacccaccagagagcccacaccggcgagaagccctacgtgtgcagagagtgcggcagaggcttcagacagcacagccacctggtgagacacaagagaacccacagcggcgagaagccctacatctgcagagagtgcgagcagggcttcagccagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacggcggcagcctgatgtgcgccggcagcgtgggcaaggccctggccggcagccacaccagcctggacaccagaggccacatccaggagagaagcctgatcttcgccgagagcgtggacggcgccctggtgggcagccccaccctgagcgacatcagaggccacacccaggacagaaacttcatgtgcatcggcaacgtggtgcagcccctggccagaagccacaccagcagcgacaccagaggccacacccagtgctgcggcttcttcagccactgctag

SEQ ID NO: 84644 - DNA, 1161 bp, Artificial Sequence
  Description of Artificial Sequence: Synthetic coding sequence
atgtacaccgagtggggcgacagcttcggcagcatgagcgtgctgatcaagaaccccagaacccacagcggcggcaagccctacgtgtgcagagagtgcggcagaggcttcacctggaagagcaacctgatcacccaccagagaacccacagcggcgagaagccctacgtgtgcaaggactgcggcagaggcttcacctggaagagcaacctgttcacccaccagagaacccacagcggcctgaagccctacgtgtgcaaggagtgcggccagagcttcagcctgaagagcaacctgatcacccaccagagagcccacaccggcgagaagccctacgtgtgcagagagtgcggcagaggcttcagacagcacagccacctggtgagacacaagagaacccacagcggcgagaagccctacatctgcagagagtgcgagcagggcttcagccagaagagccacctgatcagacacctgagaacccacaccggcgagaagccctacgtgtgcaccgagtgcggcagacacttcagctggaagagcaacctgaagacccaccagagaacccacagcggcgtgaagccctacgtgtgcctggagtgcggccagtgcttcagcctgaagagcaacctgaacaagcaccagagaagccacaccggcgagaagcccttcgtgtgcaccgagtgcggcagaggcttcaccagaaagagcaccctgagcacccaccagagaacccacagcggcgagaagcccttcgtgtgcgccgagtgcggcagaggcttcaacgacaagagcaccctgatcagccaccagagaacccacagcggcgagaagcccttcatgtgcagagagtgcggcagaagattcagacagaagcccaacctgttcagacacaagagagcccacagcggcgccttcgtgtgcagagagtgcggccagggcttctgcgccaagctgaccctgatcaagcaccagagagcccacgccggcggcaagccccacgtgtgcagagagtgcggccagggcttcagcagacagagccacctgatcagacaccagagaacccacagcggcgagaagccctacatctgcagaaagtgcggcagaggcttcagcagaaagagcaacctgatcagacaccagagaacccacagcggctag

SEQ ID NO: 84645 - DNA, 612 bp, Artificial Sequence
  Description of Artificial Sequence: Synthetic coding sequence
atgggcggcagcctgagagtggccgtgctgggcgcccccggcgtgggcaagaccgccatcatcagacagttcctgttcggcgactaccccgagagacacagacccaccgacggccccagactgtacagacccgccgtgctgctggacggcgccgtgtacgacctgagcatcagagacggcgacgtggccggccccggcagcagccccggcggccccgaggagtggcccgacgccaaggactggagcctgcaggacaccgacgccttcgtgctggtgtacgacatctgcagccccgacagcttcgactacgtgaaggccctgagacagagaatcgccgagaccagacccgccggcgcccccgaggcccccatcctggtggtgggcaacaagagagacagacagagactgagattcggccccagaagagccctggccgccctggtgagaagaggctggagatgcggctacctggagtgcagcgccaagtacaactggcacgtgctgagactgttcagagagctgctgagatgcgccctggtgagagccagacccgcccaccccgccctgagactgcagggcgccctgcaccccgccagatgcagcctgatgtag

SEQ ID NO: 84646 - DNA, 1479 bp, Artificial Sequence
  Description of Artificial Sequence: Synthetic coding sequence
atggacctgctgaaggccatcaccagccccctggccgccggcagcaagcccagcaagaagaccggcgagaagagcagcggcagcagcagccacagcgagagcaagaaggagcaccacagaaagaaggtgagcggcagcagcggcgagctgcccctggaggacggcggcagccacaagagcaagaagatgaagcccctgtacgtgaacaccgagaccctgaccctgagagagcccgacggcctgaagatgaagctgatcctgagccccaaggagaagggcagcagcagcgtggacgaggagagcttccagtaccccagccagcaggccaccgtgaagaagagcagcaagaagagcgccagagacgagcagggcgccctgctgctgggccacgagctgcagagcttcctgaagaccgccagaaagaagcacaagagcagcagcgacgcccacagcagccccggccccgagggctgcggcagcgacgccagccagttcgccgagagccacagcgccaacctggacctgagcggcctggagcccatcctggtggagagcgacagcagcagcggcggcgagctggaggccggcgagctggtgatcgacgacagctacagagagatcaagaagaagaagaagagcaagaagagcaagaagaagaaggacaaggagaagcacaaggagaagagacacagcaagagcaagagaagcctgggcctgagcgccgtgcccgtgggcgaggtgaccgtgaccagcggccccccccccagcatcccctacgccggcgccgccgccccccccctgcccctgcccggcctgcacaccgacggccacagcgagaagaagaagaagaaggaggagaaggacaaggagagagagagaggcgagaagcccaagaagaagaacatgagcgcctaccaggtgttctgcaaggagtacagagtgaccatcgtggccgaccaccccggcatcgacttcggcgagctgagcaagaagctggccgaggtgtggaagcagctgcccgagaaggacaagctgatctggaagcagaaggcccagtacctgcagcacaagcagaacaaggccgaggccaccaccgtgaagagaaaggccagcagcagcgagggcagcatgaaggtgaaggccagcagcgtgggcgtgctgagcccccagaagaagagcccccccaccaccatgctgctgcccgccagccccgccaaggcccccgagaccgagcccatcgacgtggccgcccacctgcagctgctgggcgagagcctgagcctgatcggccacagactgcaggagaccgagggcatggtggccgtgagcggcagcctgagcgtgctgctggacagcatcatctgcgccctgggccccctggcctgcctgaccacccagctgcccgagctgaacggctgccccaagcaggtgctgagcaacaccctggacaacatcgcctacatcatgcccggcctgtag

SEQ ID NO: 84647 - DNA, 1896 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcagcgacagcagcaacggccagagccacctgctgcccagcaaccacagcgtgatcgagaccttcatcagcacccagatggccagcagcagccagtag

SEQ ID NO: 84648 - DNA, 1719 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacggcgagagacccgtgccccacaccgccggcgacgacgacagaggctggctgagcatggacgccggcgagagaggcgcctggcaggccctgcagagcgcctgcgtgagcggcaccagcgtgttcccctacagcagcaacggccagagccacctgctgcccagcaaccacagcgtgatcgagaccttcatcagcacccagatggccagcagcagccagtag

SEQ ID NO: 84649 - DNA, 1566 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcaagctggtgggcatgggcggccacctgggcggcagactgatgggccagccccagaaccccggcgccggcagagccaccggcacccacagcttcatccaccagcacgtgttcatccagtgcctgctgtggaccagccactgcgccaccagcgtgatccccggcgacagcagcaacggccagagccacctgctgcccagcaaccacagcgtgatcgagaccttcatcagcacccagatggccagcagcagccagtag

SEQ ID NO: 84650 - DNA, 1572 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcagcgacagcagcaacggccagagccacctgctgcccagcaaccacagcgtgatcgagaccttcatcagcacccagatggccagcagcagccagtag

SEQ ID NO: 84651 - DNA, 1812 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcctgggcctgtag

SEQ ID NO: 84652 - DNA, 837 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagagaagaaacgccagcagagagggctgcccccaccacagacacagaggctgggcccccaccagcagcagaagatgcgtgagcaccaccggcctgcccaccggcgccaagaagaagcccagcggcaccagctggccctggaccagaaccgccggccccccccagggccaggccagagacctgagatgccccctgaccgcccccctggcctgcctgcacctgcccagcccccccgtgagaagcaccgtgtgcgccatggacagcctgagacccgtgagactgcagaagtacccccaggccgccgccgtgccctag

SEQ ID NO: 84653 - DNA, 360 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggtgcacccctgcagagccggcagagccgactag

SEQ ID NO: 84654 - DNA, 1989 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggtgagaagcagacccgccggcccccccctggcctgcgacagagccccccacccccacatccccagagcccaggaggccgccctgctgccccaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcagcgacagcagcaacggccagagccacctgctgcccagcaaccacagcgtgatcgagaccttcatcagcacccagatggccagcagcagccagtag

SEQ ID NO: 84655 - DNA, 744 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagatgcgccctgtggaccgcctgcgaccagtag

SEQ ID NO: 84656 - DNA, 1359 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcagcgacagcagcaacggccagagccacctgctgcccagcaaccacagcgtgatcgagaccttcatcagcacccagatggccagcagcagccagtag

SEQ ID NO: 84657 - DNA, 1212 bp, Artificial Sequence
  Description of Artificial Sequence: Synthetic coding sequence
atggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcaagctggtgggcatgggcggccacctgggcggcagactgatgggccagccccagaaccccggcgccggcagagccaccggcacccacagcttcatccacaccacctgcatctaccccgtgcccaccctggaccagagcctgtgctacatcagcgacacctgggtgaaccagaccgaccagaacctgagcaacagcagcagagaggccggcaccaagcacaacaccagcatcctgtggtacctgagaagatag

SEQ ID NO: 84658 - DNA, 1185 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgccgcctgcagccagcccggcagagtggccagactgttcaacttctag

SEQ ID NO: 84659 - DNA, 1917 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcccctgcaccccagctaccagcagcccctgatgccccccgtgcagagccacgtgacccagagccccttcatggccaccatggcccagctgcagagcccccacgccctgtacagccacaagcccgaggtggcccagtacacccacaccggcctgctgccccagaccatgctgatcaccgacaccaccaacctgagcgccctggccagcctgacccccaccaagcaggaggccgccctgctgccccaggtgttcaccagcgacaccgaggccagcagcgagagcggcctgcacacccccgccagccaggccaccaccctgcacgtgcccagccaggaccccgccagcatccagcacctgcagcccgcccacagactgagcgccagccccaccgtgagcagcagcagcctggtgctgtaccagagcagcgacagcagcaacggccagagccacctgctgcccagcaaccacagcgtgatcgagaccttcatcagcacccagatggccagcagcagccagtag

SEQ ID NO: 84660 - DNA, 1416 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctggtgatcggcctggccagcacccaggcccagagcgtgcccgtgatcaacagcatgggcagcagcctgaccaccctgcagcccgtgcagttcagccagcagggccccagcagctag

SEQ ID NO: 84661 - DNA, 1359 bp, Artificial Sequence
  Description of Artificial Sequence: Synthetic coding sequence
atggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccaggcccagggcctgggcagcaacctggtgaccgaggtgagagtgtacaactggttcgccaacagaagaaaggaggaggccttcagacacaagctggccatggacacctacagcggccccccccccggccccggccccggccccgccctgcccgcccacagcagccccggcctgcccccccccgccctgagccccagcaaggtgcacggcgtgagatacggccagcccgccaccagcgagaccgccgaggtgcccagcagcagcggcggccccctggtgaccgtgagcacccccctgcaccaggtgagccccaccggcctggagcccagccacagcctgctgagcaccgaggccaagctggtgagcgccgccggcggccccctgccccccgtgagcaccctgaccgccctgcacagcctggagcagaccagccccggcctgaaccagcagccccagaacctgatcatggccagcctgcccggcgtgatgaccatcggccccggcgagcccgccagcctgggccccaccttcaccaacaccggcgccagcaccctgcccctgttcggcgccggcgtggccgagctgaccagacagcagggccccagcagctag

SEQ ID NO: 84662 - DNA, 1071 bp, Artificial Sequence
  Description of Artificial Sequence: Synthetic coding sequence
tgatggctggtgggcttctggggcggcagcggctgcaaggagttcggcctgtgcctgcccgccggcagacagacccagcccaccagatggggcagaagactggcctggtggaccagagccgcctggccctgcggcagcagagccatggtgagcaagctgagccagctgcagaccgagctgctggccgccctgctggagagcggcctgagcaaggaggccctgatccaggccctgggcgagcccggcccctacctgctggccggcgagggccccctggacaagggcgagagctgcggcggcggcagaggcgagctggccgagctgcccaacggcctgggcgagaccagaggcagcgaggacgagaccgacgacgacggcgaggacttcaccccccccatcctgaaggagctggagaacctgagccccgaggaggccgcccaccagaaggccgtggtggagaccctgctgcaggaggacccctggagagtggccaagatggtgaagagctacctgcagcagcacaacatcccccagagagaggtggtggacaccaccggcctgaaccagagccacctgagccagcacctgaacaagggcacccccatgaagacccagaagagagccgccctgtacacctggtacgtgagaaagcagagagaggtggcccagcagttcacccacgccggccagggcggcctgatcgaggagcccaccggcgacgagctgcccaccaagaagggcagaagaaacagattcaagtggggccccgccagccagcagatcctgttccaggcctacgagagacagaagaaccccagcaaggaggagagagagaccctggtggaggagtgcaacagagccgagtgcatccagagaggcgtgagccccagccagccccagcccgccgagtacagaagccaggccggcctgagcagctggggccccccccccccctgccagcaccccgacagcaccgcccagctgggcgccgacatccccagaccccagcccgccgcccccgagccccaccacggcctgaccagctggggccacgaccacagagcctggtag

SEQ ID NO: 84663 - DNA, 2247 bp, Artificial Sequence
  Description of Artificial Sequence: Synthetic coding sequence
atgctgggcaccctgagagccatggagggcgaggacgtggaggacgaccagctgctgcagaagctgagagccagcagaagaagattccagagaagaatgcagagactgatcgagaagtacaaccagcccttcgaggacacccccgtggtgcagatggccaccctgacctacgagaccccccagggcctgagaatctggggcggcagactgatcaaggagagaaacgagggcgagatccaggacagcagcatgaagcccgccgacagaaccgacggcagcgtgcaggccgccgcctggggccccgagctgcccagccacagaaccgtgctgggcgccgacagcaagagcggcgaggtggacgccaccagcgaccaggaggagagcgtggcctgggccctggcccccgccgtgccccagagccccctgaagaacgagctgagaagaaagtacctgacccaggtggacatcctgctgcagggcgccgagtacttcgagtgcgccggcaacagagccggcagagacgtgagagtgacccccctgcccagcctggccagccccgccgtgcccgcccccggctactgcagcagaatcagcagaaagagccccggcgaccccgccaagcccgccagcagccccagagagtgggaccccctgcaccccagcagcaccgacatggccctggtgcccagaaacgacagcctgagcctgcaggagaccagcagcagcagcttcctgagcagccagcccttcgaggacgacgacatctgcaacgtgaccatcagcgacctgtacgccggcatgctgcacagcatgagcagactgctgagcaccaagcccagcagcatcatcagcaccaagaccttcatcatgcagaactggaacagcagaagaagacacagatacaagagcagaatgaacaagacctactgcaagggcgccagaagaagccagagaagcagcaaggagaacttcatcccctgcagcgagcccgtgaagggcaccggcgccctgagagactgcaagaacgtgctggacgtgagctgcagaaagaccggcctgaagctggagaaggccttcctggaggtgaacagaccccagatccacaagctggaccccagctggaaggagagaaaggtgacccccagcaagtacagcagcctgatctacttcgacagcagcgccacctacaacctggacgaggagaacagattcagaaccctgaagtggctgatcagccccgtgaagatcgtgagcagacccaccatcagacagggccacggcgagaacagacagagagagatcgagatcagattcgaccagctgcacagagagtactgcctgagccccagaaaccagcccagaagaatgtgcctgcccgacagctgggccatgaacatgtacagaggcggccccgccagccccggcggcctgcagggcctggagaccagaagactgagcctgcccagcagcaaggccaaggccaagagcctgagcgaggccttcgagaacctgggcaagagaagcctggaggccggcagatgcctgcccaagagcgacagcagcagcagcctgcccaagaccaaccccacccacagcgccaccagaccccagcagaccagcgacctgcacgtgcagggcaacagcagcggcatcttcagaaagagcgtgagccccagcaagaccctgagcgtgcccgacaaggaggtgcccggccacggcagaaacagatacgacgagatcaaggaggagttcgacaagctgcaccagaagtactgcctgaagagccccggccagatgaccgtgcccctgtgcatcggcgtgagcaccgacaaggccagcatggaggtgagataccagaccgagggcttcctgggcaagctgaaccccgacccccacttccagggcttccagaagctgcccagcagccccctgggctgcagaaagagcctgctgggcagcaccgccatcgaggcccccagcagcacctgcgtggccagagccatcaccagagacggcaccagagaccaccagttccccgccaagagacccagactgagcgagccccagggcagcggcagacagggcaacagcctgggcgccagcgacggcgtggacaacaccgtgagacccggcgaccagggcagcagcagccagcccaacagcgaggagagaggcgagaacaccagctacagaatggaggagaagagcgacttcatgctggagaagctggagaccaagagcgtgtag

SEQ ID NO: 84664 - DNA, 2085 bp, Artificial Sequence
  Description of Artificial Sequence: Synthetic coding sequence
atgctgggcaccctgagagccatggagggcgaggacgtggaggacgaccagctgctgcagaagctgagagccagcagaagaagattccagagaagaatgcagagactgatcgagaagtacaaccagcccttcgaggacacccccgtggtgcagatggccaccctgacctacgagaccccccagggcctgagaatctggggcggcagactgatcaaggagagaaacgagggcgagatccagcccgccgtgccccagagccccctgaagaacgagctgagaagaaagtacctgacccaggtggacatcctgctgcagggcgccgagtacttcgagtgcgccggcaacagagccggcagagacgtgagagtgacccccctgcccagcctggccagccccgccgtgcccgcccccggctactgcagcagaatcagcagaaagagccccggcgaccccgccaagcccgccagcagccccagagagtgggaccccctgcaccccagcagcaccgacatggccctggtgcccagaaacgacagcctgagcctgcaggagaccagcagcagcagcttcctgagcagccagcccttcgaggacgacgacatctgcaacgtgaccatcagcgacctgtacgccggcatgctgcacagcatgagcagactgctgagcaccaagcccagcagcatcatcagcaccaagaccttcatcatgcagaactggaacagcagaagaagacacagatacaagagcagaatgaacaagacctactgcaagggcgccagaagaagccagagaagcagcaaggagaacttcatcccctgcagcgagcccgtgaagggcaccggcgccctgagagactgcaagaacgtgctggacgtgagctgcagaaagaccggcctgaagctggagaaggccttcctggaggtgaacagaccccagatccacaagctggaccccagctggaaggagagaaaggtgacccccagcaagtacagcagcctgatctacttcgacagcagcgccacctacaacctggacgaggagaacagattcagaaccctgaagtggctgatcagccccgtgaagatcgtgagcagacccaccatcagacagggccacggcgagaacagacagagagagatcgagatcagattcgaccagctgcacagagagtactgcctgagccccagaaaccagcccagaagaatgtgcctgcccgacagctgggccatgaacatgtacagaggcggccccgccagccccggcggcctgcagggcctggagaccagaagactgagcctgcccagcagcaaggccaaggccaagagcctgagcgaggccttcgagaacctgggcaagagaagcctggaggccggcagatgcctgcccaagagcgacagcagcagcagcctgcccaagaccaaccccacccacagcgccaccagaccccagcagaccagcgacctgcacgtgcagggcaacagcagcggcatcttcagaaagagcgtgagccccagcaagaccctgagcgtgcccgacaaggaggtgcccggccacggcagaaacagatacgacgagatcaaggaggagttcgacaagctgcaccagaagtactgcctgaagagccccggccagatgaccgtgcccctgtgcatcggcgtgagcaccgacaaggccagcatggaggtgagataccagaccgagggcttcctgggcaagctgaaccccgacccccacttccagggcttccagaagctgcccagcagccccctgggctgcagaaagagcctgctgggcagcaccgccatcgaggcccccagcagcacctgcgtggccagagccatcaccagagacggcaccagagaccaccagttccccgccaagagacccagactgagcgagccccagggcagcggcagacagggcaacagcctgggcgccagcgacggcgtggacaacaccgtgagacccggcgaccagggcagcagcagccagcccaacagcgaggagagaggcgagaacaccagctacagaatggaggagaagagcgacttcatgctggagaagctggagaccaagagcgtgtag

SEQ ID NO: 84665 - DNA, 1992 bp, Artificial Sequence
  Description of Artificial Sequence: Synthetic coding sequence
atgctgggcaccctgagagccatggagggcgaggacgtggaggacgaccagctgctgcagaagctgagagccagcagaagaagattccagagaagaatgcagagactgatcgagaagtacaaccagcccttcgaggacacccccgtggtgcagatggccaccctgacctacgagaccccccagggcctgagaatctggggcggcagactgatcaaggagagaaacgagggcgagatccagtgcgccggcaacagagccggcagagacgtgagagtgacccccctgcccagcctggccagccccgccgtgcccgcccccggctactgcagcagaatcagcagaaagagccccggcgaccccgccaagcccgccagcagccccagagagtgggaccccctgcaccccagcagcaccgacatggccctggtgcccagaaacgacagcctgagcctgcaggagaccagcagcagcagcttcctgagcagccagcccttcgaggacgacgacatctgcaacgtgaccatcagcgacctgtacgccggcatgctgcacagcatgagcagactgctgagcaccaagcccagcagcatcatcagcaccaagaccttcatcatgcagaactggaacagcagaagaagacacagatacaagagcagaatgaacaagacctactgcaagggcgccagaagaagccagagaagcagcaaggagaacttcatcccctgcagcgagcccgtgaagggcaccggcgccctgagagactgcaagaacgtgctggacgtgagctgcagaaagaccggcctgaagctggagaaggccttcctggaggtgaacagaccccagatccacaagctggaccccagctggaaggagagaaaggtgacccccagcaagtacagcagcctgatctacttcgacagcagcgccacctacaacctggacgaggagaacagattcagaaccctgaagtggctgatcagccccgtgaagatcgtgagcagacccaccatcagacagggccacggcgagaacagacagagagagatcgagatcagattcgaccagctgcacagagagtactgcctgagccccagaaaccagcccagaagaatgtgcctgcccgacagctgggccatgaacatgtacagaggcggccccgccagccccggcggcctgcagggcctggagaccagaagactgagcctgcccagcagcaaggccaaggccaagagcctgagcgaggccttcgagaacctgggcaagagaagcctggaggccggcagatgcctgcccaagagcgacagcagcagcagcctgcccaagaccaaccccacccacagcgccaccagaccccagcagaccagcgacctgcacgtgcagggcaacagcagcggcatcttcagaaagagcgtgagccccagcaagaccctgagcgtgcccgacaaggaggtgcccggccacggcagaaacagatacgacgagatcaaggaggagttcgacaagctgcaccagaagtactgcctgaagagccccggccagatgaccgtgcccctgtgcatcggcgtgagcaccgacaaggccagcatggaggtgagataccagaccgagggcttcctgggcaagctgaaccccgacccccacttccagggcttccagaagctgcccagcagccccctgggctgcagaaagagcctgctgggcagcaccgccatcgaggcccccagcagcacctgcgtggccagagccatcaccagagacggcaccagagaccaccagttccccgccaagagacccagactgagcgagccccagggcagcggcagacagggcaacagcctgggcgccagcgacggcgtggacaacaccgtgagacccggcgaccagggcagcagcagccagcccaacagcgaggagagaggcgagaacaccagctacagaatggaggagaagagcgacttcatgctggagaagctggagaccaagagcgtgtag

SEQ ID NO: 84666 - DNA, 2181 bp, Artificial Sequence
  Description of Artificial Sequence: Synthetic coding sequence
atggaggacagactgcacatggacaacggcctggtgccccagaagatcgtgagcgtgcacctgcaggacagcaccctgaaggaggtgaaggaccaggtgagcaacaagcaggcccagatcctggagcccaagcccgagcccagcctggagatcaagcccgagcaggacggcatggagcacgtgggcagagacgaccccaaggccctgggcgaggagcccaagcagagaagaggcagcgccagcggcagcgagcccgccggcgacagcgacagaggcggcggccccgtggagcactaccacctgcacctgagcagctgccacgagtgcctggagctggagaacagcaccatcgagagcgtgaagttcgccagcgccgagaacatccccgacctgccctacgactacagcagcagcctggagagcgtggccgacgagaccagccccgagagagagggcagaagagtgaacctgaccggcaaggcccccaacatcctgctgtacgtgggcagcgacagccaggaggccctgggcagattccacgaggtgagaagcgtgctggccgactgcgtggacatcgacagctacatcctgtaccacctgctggaggacagcgccctgagagacccctggaccgacaactgcctgctgctggtgatcgccaccagagagagcatccccgaggacctgtaccagaagttcatggcctacctgagccagggcggcaaggtgctgggcctgagcagcagcttcaccttcggcggcttccaggtgaccagcaagggcgccctgcacaagaccgtgcagaacctggtgttcagcaaggccgaccagagcgaggtgaagctgagcgtgctgagcagcggctgcagataccaggagggccccgtgagactgagccccggcagactgcagggccacctggagaacgaggacaaggacagaatgatcgtgcacgtgcccttcggcaccagaggcggcgaggccgtgctgtgccaggtgcacctggagctgccccccagcagcaacatcgtgcagacccccgaggacttcaacctgctgaagagcagcaacttcagaagatacgaggtgctgagagagatcctgaccaccctgggcctgagctgcgacatgaagcaggtgcccgccctgacccccctgtacctgctgagcgccgccgaggagatcagagaccccctgatgcagtggctgggcaagcacgtggacagcgagggcgagatcaagagcggccagctgagcctgagattcgtgagcagctacgtgagcgaggtggagatcacccccagctgcatccccgtggtgaccaacatggaggccttcagcagcgagcacttcaacctggagatctacagacagaacctgcagaccaagcagctgggcaaggtgatcctgttcgccgaggtgacccccaccaccatgagactgctggacggcctgatgttccagaccccccaggagatgggcctgatcgtgatcgccgccagacagaccgagggcaagggcagaggcggcaacgtgtggctgagccccgtgggctgcgccctgagcaccctgctgatcagcatccccctgagaagccagctgggccagagaatccccttcgtgcagcacctgatgagcgtggccgtggtggaggccgtgagaagcatccccgagtaccaggacatcaacctgagagtgaagtggcccaacgacatctactacagcgacctgatgaagatcggcggcgtgctggtgaacagcaccctgatgggcgagaccttctacatcctgatcggctgcggcttcaacgtgaccaacagcaaccccaccatctgcatcaacgacctgatcaccgagtacaacaagcagcacaaggccgagctgaagcccctgagagccgactacctgatcgccagagtggtgaccgtgctggagaagctgatcaaggagttccaggacaagggccccaacagcgtgctgcccctgtactacagatactgggtgcacagcggccagcaggtgcacctgggcagcgccgagggccccaaggtgagcatcgtgggcctggacgacagcggcttcctgcaggtgcaccaggagggcggcgaggtggtgaccgtgcaccccgacggcaacagcttcgacatgctgagaaacctgatcctgcccaagagaagatag

SEQ ID NO: 84667 - DNA, 2181 bp, Artificial Sequence; identical to SEQ ID NO: 84666
  Description of Artificial Sequence: Synthetic coding sequence

SEQ ID NO: 84668 - DNA, 264 bp, Artificial Sequence
  Description of Artificial Sequence: Synthetic coding sequence
atggaggacagactgcacatggacaacggcctggtgccccagaagatcgtgagcgtgcacctgcaggacagcaccctgaaggaggtgaaggaccaggtgagcaacaagcaggcccagatcctggagcccaagcccgagcccagcctggagatcaagcccgagcaggacggcatggagcacgtgggcagagacgaccccaaggccctgggcgaggagcccaagcagagaagaggcagcgccagcggcagcgagcccgccggctag

SEQ ID NO: 84669 - DNA, 234 bp, Artificial Sequence
  Description of Artificial Sequence: Synthetic coding sequence
atggaggacagactgcacatggacaacggcctggtgccccagaagatcgtgagcgtgcacctgcaggacagcaccctgaaggaggtgaaggaccaggtgagcaacaagcaggcccagatcctggagcccaagcccgagcccagcctggagatcaagcccgagcaggacggcatggagcacgtgggcagagacgaccccaaggccctgggcgaggagcccaagcagagaagatag

SEQ ID NO: 84670 - DNA, 279 bp, Artificial Sequence
  Description of Artificial Sequence: Synthetic coding sequence
atggaggacagactgcacatggacaacggcctggtgccccagaagatcgtgagcgtgcacctgcaggacagcaccctgaaggaggtgaaggaccaggtgagcaacaagcaggcccagatcctggagcccaagcccgagcccagcctggagatcaagcccgagcaggacggcatggagcacgtgggcagagacgaccccaaggccctgggcgaggagcccaagcagagaagaggcagcgccagcggcagcgagcccgccggcgacagcgacagaggctag

SEQ ID NO: 84671 - DNA, 807 bp, Artificial Sequence
  Description of Artificial Sequence: Synthetic coding sequence
atgggcctgagccccagcgcccccgccgtggccgtgcaggccagcaacgccagcgccagcccccccagcggctgccccatgcacgagggcaagatgaagggctgccccgtgaacaccgagcccagcggccccacctgcgagaagaagacctacagcgtgcccgcccaccaggagagagcctacgagtacgtggagtgccccatcagaggcaccgccgccgagaacaaggagaacctggaccccagcaacctgatgcccccccccaaccagacccccgcccccgaccagcccttcgccctgagcaccgtgagagaggagagcagcatccccagagccgacagcgagaagaagtgggtgtaccccagcgagcagatgttctggaacgccatgctgaagaagggctggaagtggaaggacgaggacatcagccagaaggacatgtacaacatcatcagaatccacaaccagaacaacgagcaggcctggaaggagatcctgaagtgggaggccctgcacgccgccgagtgcccctgcggccccagcctgatcagattcggcggcaaggccaaggagtacagccccagagccagaatcagaagctggatgggctacgagctgcccttcgacagacacgactggatcatcaacagatgcggcaccgaggtgagatacgtgatcgactactacgacggcggcgaggtgaacaaggactaccagttcaccatcctggacgtgagacccgccctggacagcctgagcgccgtgtgggacagaatgaaggtggcctggtggagatggaccagctag

SEQ ID NO: 84672 - DNA, 807 bp, Artificial Sequence; identical to SEQ ID NO: 84671
  Description of Artificial Sequence: Synthetic coding sequence

SEQ ID NO: 84673 - DNA, 807 bp, Artificial Sequence; identical to SEQ ID NO: 84671
  Description of Artificial Sequence: Synthetic coding sequence

SEQ ID NO: 84674 - DNA, 1008 bp, Artificial Sequence
  Description of Artificial Sequence: Synthetic coding sequence
atggacaacgccagaatgaacagcttcctggagtaccccatcctgagcagcggcgacagcggcacctgcagcgccagagcctaccccagcgaccacagaatcaccaccttccagagctgcgccgtgagcgccaacagctgcggcggcgacgacagattcctggtgggcagaggcgtgcagatcggcagcccccaccaccaccaccaccaccaccacagacacccccagcccgccacctaccagaccagcggcaacctgggcgtgagctacagccacagcagctgcggccccagctacggcagccagaacttcagcgccccctacagcccctacgccctgaaccaggaggccgacgtgagcggcggctacccccagtgcgcccccgccgtgtacagcggcaacctgagcagccccatggtgcagcaccaccaccaccaccagggctacgccggcggcgccgtgggcagcccccagtacatccaccacagctacggccaggagcaccagagcctggccctggccacctacaacaacagcctgagccccctgcacgccagccaccaggaggcctgcagaagccccgccagcgagaccagcagccccgcccagaccttcgactggatgaaggtgaagagaaacccccccaagaccggcaaggtgggcgagtacggctacctgggccagcccaacgccgtgagaaccaacttcaccaccaagcagctgaccgagctggagaaggagttccacttcaacaagtacctgaccagagccagaagagtggagatcgccgccagcctgcagctgaacgagacccaggtgaagatctggttccagaacagaagaatgaagcagaagaagagagagaaggagggcctgctgcccatcagccccgccaccccccccggcaacgacgagaaggccgaggagagcagcgagaagagcagcagcagcccctgcgtgcccagccccggcagcagcaccagcgacaccctgaccaccagccactag

SEQ ID NO: 84675 - DNA, 414 bp, Artificial Sequence
  Description of Artificial Sequence: Synthetic coding sequence
atggacaacgccagaatgaacagcttcctggagtaccccatcctgagcagcggcgacagcggcacctgcagcgccagagcctaccccagcgaccacagaatcaccaccttccagagctgcgccgtgagcgccaacagctgcggcggcgacgacagattcctggtgggcagaggcgtgcagatcggcagcccccaccaccaccaccaccaccaccacagacacccccagcccgccacctaccagaccagcggcaacctgggcgtgagctacagccacagcagctgcggccccagctacggcagccagaacttcagcgccccctacagcccctacgccctgaaccaggaggccgacccccccagaagcctgagcctgcccagaatcggcgacatcttcagcagcgccgacttctag

SEQ ID NO: 84676 - DNA, 1233 bp, Artificial Sequence
  Description of Artificial Sequence: Synthetic coding sequence
atgagcgccagaaagggctacctgctgcccagccccaactaccccaccaccatgagctgcagcgagagccccgccgccaacagcttcctggtggacagcctgatcagcagcggcagaggcgaggccggcggcggcggcggcggcgccggcggcggcggcggcggcggctactacgcccacggcggcgtgtacctgccccccgccgccgacctgccctacggcctgcagagctgcggcctgttccccaccctgggcggcaagagaaacgaggccgccagccccggcagcggcggcggcggcggcggcctgggccccggcgcccacggctacggccccagccccatcgacctgtggctggacgcccccagaagctgcagaatggagccccccgacggcccccccccccccccccagcagcagccccccccccccccccagcccccccagcccgccccccaggccaccagctgcagcttcgcccagaacatcaaggaggagagcagctactgcctgtacgacagcgccgacaagtgccccaaggtgagcgccaccgccgccgagctggcccccttccccagaggccccccccccgacggctgcgccctgggcaccagcagcggcgtgcccgtgcccggctacttcagactgagccaggcctacggcaccgccaagggctacggcagcggcggcggcggcgcccagcagctgggcgccggccccttccccgcccagccccccggcagaggcttcgacctgccccccgccctggccagcggcagcgccgacgccgccagaaaggagagagccctggacagcccccccccccccaccctggcctgcggcagcggcggcggcagccagggcgacgaggaggcccacgccagcagcagcgccgccgaggagctgagccccgcccccagcgagagcagcaaggccagccccgagaaggacagcctgggcaacagcaagggcgagaacgccgccaactggctgaccgccaagagcggcagaaagaagagatgcccctacaccaagcaccagaccctggagctggagaaggagttcctgttcaacatgtacctgaccagagagagaagactggagatcagcagaagcgtgcacctgaccgacagacaggtgaagatctggttccagaacagaagaatgaagctgaagaagatgaacagagagaacagaatcagagagctgaccgccaacttcaacttcagctag

SEQ ID NO: 84677 - DNA, 609 bp, Artificial Sequence
  Description of Artificial Sequence: Synthetic coding sequence
atgagctgcagcgagagccccgccgccaacagcttcctggtggacagcctgatcagcagcggcagaggcgaggccggcggcggcggcggcggcgccggcggcggcggcggcggcggctactacgcccacggcggcgtgtacctgccccccgccgccgacctgccctacggcctgcagagctgcggcctgttccccaccctgggcggcaagagaaacgaggccgccagccccggcagcggcggcggcggcggcggcctgggccccggcgcccacggctacggccccagccccatcgacctgtggctggacgcccccagaagctgcagaagaagagccgccaccagaggctggcccgtgcccagagccgcccccggcgccagattcagaagccccgccagagccagcctgagactgggcagatgcggccccgagggcgccagccccagattcgccgccgccccccacgccggcctgagacagagaagaggcctggccggcagaagaggcggcgccagagtggtgctgggcagaggcggcgccctgcccggccccttcagagagcagcagagcctggccggcgagggcttccccggccagttccagagatag

SEQ ID NO: 84678 - DNA, 285 bp, Artificial Sequence
  Description of Artificial Sequence: Synthetic coding sequence
atgtgccagggcaacagcaagggcgagaacgccgccaactggctgaccgccaagagcggcagaaagaagagatgcccctacaccaagcaccagaccctggagctggagaaggagttcctgttcaacatgtacctgaccagagagagaagactggagatcagcagaagcgtgcacctgaccgacagacaggtgaagatctggttccagaacagaagaatgaagctgaagaagatgaacagagagaacagaatcagagagctgaccgccaacttcaacttcagctag

SEQ ID NO: 84679 - DNA, 942 bp, Artificial Sequence
  Description of Artificial Sequence: Synthetic coding sequence
atggacttcgacgagagaggcccctgcagcagcaacatgtacctgcccagctgcacctactacgtgagcggccccgacttcagcagcctgcccagcttcctgccccagacccccagcagcagacccatgacctacagctacagcagcaacctgccccaggtgcagcccgtgagagaggtgaccttcagagagtacgccatcgagcccgccaccaagtggcaccccagaggcaacctggcccactgctacagcgccgaggagctggtgcacagagactgcctgcaggcccccagcgccgccggcgtgcccggcgacgtgctggccaagagcagcgccaacgtgtaccaccaccccacccccgccgtgagcagcaacttctacagcaccgtgggcagaaacggcgtgctgccccaggccttcgaccagttcttcgagaccgcctacggcacccccgagaacctggccagcagcgactaccccggcgacaagagcgccgagaagggcccccccgccgccaccgccaccagcgccgccgccgccgccgccgccaccggcgcccccgccaccagcagcagcgacagcggcggcggcggcggctgcagagagaccgccgccgccgccgaggagaaggagagaagaagaagacccgagagcagcagcagccccgagagcagcagcggccacaccgaggacaaggccggcggcagcagcggccagagaaccagaaagaagagatgcccctacaccaagtaccagatcagagagctggagagagagttcttcttcagcgtgtacatcaacaaggagaagagactgcagctgagcagaatgctgaacctgaccgacagacaggtgaagatctggttccagaacagaagaatgaaggagaagaagatcaacagagacagactgcagtactacagcgccaaccccctgctgtag

SEQ ID NO: 84680 - DNA, 918 bp, Artificial Sequence
  Description of Artificial Sequence: Synthetic coding sequence
atggccagagaggacagcgtgaagtgcctgagatgcctgctgtacgccctgaacctgctgttctggctgatgagcatcagcgtgctggccgtgagcgcctggatgagagactacctgaacaacgtgctgaccctgaccgccgagaccagagtggaggaggccgtgatcctgacctacttccccgtggtgcaccccgtgatgatcgccgtgtgctgcttcctgatcatcgtgggcatgctgggctactgcggcaccgtgaagagaaacctgctgctgctggcctggtacttcggcagcctgctggtgatcttctgcgtggagctggcctgcggcgtgtggacctacgagcaggagctgatggtgcccgtgcagtggagcgacatggtgaccctgaaggccagaatgaccaactacggcctgcccagatacagatggctgacccacgcctggaacttcttccagagagagttcaagtgctgcggcgtggtgtacttcaccgactggctggagatgaccgagatggactggccccccgacagctgctgcgtgagagagttccccggctgcagcaagcaggcccaccaggaggacctgagcgacctgtaccaggagggctgcggcaagaagatgtacagcttcctgagaggcaccaagcagctgcaggtgctgagattcctgggcatcagcatcggcgtgacccagatcctggccatgatcctgaccatcaccctgctgtgggccctgtactacgacagaagagagcccggcaccgaccagatgatgagcctgaagaacgacaacagccagcacctgagctgccccagcgtggagctgctgaagcccagcctgagcagaatcttcgagcacaccagcatggccaacagcttcaacacccacttcgagatggaggagctgtag

SEQ ID NO: 84681 - DNA, 489 bp, Artificial Sequence
  Description of Artificial Sequence: Synthetic coding sequence
atgggcctggagaccgagaaggccgacgtgcagctgttcatggacgacgacagctacagccaccacagcggcctggagtacgccgaccccgagaagttcgccgacagcgaccaggacagagacccccacagactgaacagccacctgaagctgggcttcgaggacgtgatcgccgagcccgtgaccacccacagcttcgacaaggtgtggatctgcagccacgccctgttcgagatcagcaagtacgtgatgtacaagttcctgaccgtgttcctggccatccccctggccttcatcgccggcatcctgttcgccaccctgagctgcctgcacatctggatcctgatgcccttcgtgaagacctgcctgatggtgctgcccagcgtgcagaccatctggaagagcgtgaccgacgtgatcatcgcccccctgtgcaccagcgtgggcagatgcttcagcagcgtgagcctgcagctgagccaggactag

SEQ ID NO: 84682 - DNA, 963 bp, Artificial Sequence
  Description of Artificial Sequence: Synthetic coding sequence
atgaccatgagcagcttcctgatcaacagcaactacatcgagcccaagttcccccccttcgaggagtacgcccagcacagcggcagcggcggcgccgacggcggccccggcggcggccccggctaccagcagccccccgccccccccacccagcacctgcccctgcagcagccccagctgccccacgccggcggcggcagagagcccaccgccagctactacgcccccagaaccgccagagagcccgcctaccccgccgccgccctgtaccccgcccacggcgccgccgacaccgcctacccctacggctacagaggcggcgccagccccggcagacccccccagcccgagcagccccccgcccaggccaagggccccgcccacggcctgcacgccagccacgtgctgcagccccagctgcccccccccctgcagcccagagccgtgccccccgccgcccccagaagatgcgaggccgcccccgccacccccggcgtgcccgccggcggcagcgcccccgcctgccccctgctgctggccgacaagagccccctgggcctgaagggcaaggagcccgtggtgtacccctggatgaagaagatccacgtgagcgccgtgaaccccagctacaacggcggcgagcccaagagaagcagaaccgcctacaccagacagcaggtgctggagctggagaaggagttccacttcaacagatacctgaccagaagaagaagaatcgagatcgcccacaccctgtgcctgagcgagagacaggtgaagatctggttccagaacagaagaatgaagtggaagaaggaccacaagctgcccaacaccaagatgagaagcagcaacagcgccagcgccagcgccggcccccccggcaaggcccagacccagagcccccacctgcacccccacccccaccccagcaccagcacccccgtgcccagcagcatctag

SEQ ID NO: 84683 - DNA, 963 bp, Artificial Sequence; identical to SEQ ID NO: 84682
  Description of Artificial Sequence: Synthetic coding sequence

SEQ ID NO: 84684 - DNA, 1140 bp, Artificial Sequence
  Description of Artificial Sequence: Synthetic coding sequence
atgctgaagagatgcggcagaagactgctgctggccctggccggcgccctgctggcctgcctgctggtgctgaccgccgaccccccccccccccccctgcccgccgagagaggcagaagagccctgagaagcctggccggccccgccggcgccgcccccgcccccggcctgggcgccgccgccgccgcccccggcgccctggtgagagacgtgcacagcctgagcgagtacttcagcctgctgaccagagccagaagagacgccggccccccccccggcgccgcccccagacccgccgacggccaccccagacccctggccgagcccctggcccccagagacgtgttcatcgccgtgaagaccaccaagaagttccacagagccagactggacctgctgctggagacctggatcagcagacacaaggagatgaccttcatcttcaccgacggcgaggacgaggccctggccagacacaccggcaacgtggtgatcaccaactgcagcgccgcccacagcagacaggccctgagctgcaagatggccgtggagtacgacagattcatcgagagcggcagaaagtggttctgccacgtggacgacgacaactacgtgaacctgagagccctgctgagactgctggccagctacccccacaccagagacgtgtacgtgggcaagcccagcctggacagacccatccaggccatggagagagtgagcgagaacaaggtgagacccgtgcacttctggttcgccaccggcggcgccggcttctgcatcagcagaggcctggccctgaagatgagcccctgggccagcggcggccacttcatgaacaccgccgagagaatcagactgcccgacgactgcaccatcggctacatcgtggaggccctgctgggcgtgcccctgatcagaagcggcctgttccacagccacctggagaacctgcagcaggtgcccaccagcgagctgcacgagcaggtgaccctgagctacggcatgttcgagaacaagagaaacgccgtgcacgtgaagggccccttcagcgtggaggccgaccccagcagattcagaagcatccactgccacctgtaccccgacaccccctggtgccccagaaccgccatcttctag

SEQ ID NO: 84685 - DNA, 813 bp, Artificial Sequence
  Description of Artificial Sequence: Synthetic coding sequence
atgagcagctacttcgtgaacagcttctgcggcagataccccaacggccccgactaccagctgcacaactacggcgaccacagcagcgtgagcgagcagttcagagacagcgccagcatgcacagcggcagatacggctacggctacaacggcatggacctgagcgtgggcagaagcggcagcggccacttcggcagcggcgagagagccagaagctacgccgccagcgccagcgccgcccccgccgagcccagatacagccagcccgccaccagcacccacagcccccagcccgaccccctgccctgcagcgccgtggcccccagccccggcagcgacagccaccacggcggcaagaacagcctgagcaacagcagcggcgccagcgccgacgccggcagcacccacatcagcagcagagagggcgtgggcaccgccagcggcgccgaggaggacgcccccgccagcagcgagcaggccagcgcccagagcgagcccagccccgccccccccgcccagccccagatctacccctggatgagaaagctgcacatcagccacgacaacatcggcggccccgagggcaagagagccagaaccgcctacaccagataccagaccctggagctggagaaggagttccacttcaacagatacctgaccagaagaagaagaatcgagatcgcccacgccctgtgcctgagcgagagacagatcaagatctggttccagaacagaagaatgaagtggaagaaggacaacaagctgaagagcatgagcatggccgccgccggcggcgccttcagaccctag

SEQ ID NO: 84686 - DNA, 693 bp, Artificial Sequence
  Description of Artificial Sequence: Synthetic coding sequence
atgagcagcagctactacgtgaacgccctgttcagcaagtacaccgccggcgccagcctgttccagaacgccgagcccaccagctgcagcttcgcccccaacagccagagaagcggctacggcgccggcgccggcgccttcgccagcaccgtgcccggcctgtacaacgtgaacagccccctgtaccagagccccttcgccagcggctacggcctgggcgccgacgcctacggcaacctgccctgcgccagctacgaccagaacatccccggcctgtgcagcgacctggccaagggcgcctgcgacaagaccgacgagggcgccctgcacggcgccgccgaggccaacttcagaatctacccctggatgagaagcagcggccccgacagaaagagaggcagacagacctacaccagataccagaccctggagctggagaaggagttccacttcaacagatacctgaccagaagaagaagaatcgagatcgcccacgccctgtgcctgaccgagagacagatcaagatctggttccagaacagaagaatgaagtggaagaaggagcacaaggacgagggccccaccgccgccgccgcccccgagggcgccgtgcccagcgccgccgccaccgccgccgccgacaaggccgacgaggaggacgacgacgaggaggaggaggacgaggaggagtag

SEQ ID NO: 84687 - DNA, 93 bp, Artificial Sequence
  Description of Artificial Sequence: Synthetic coding sequence
atgagcagcagctactacgtgaacgccctgttcagcaagtacaccgccggcgccagcctgttccagaacgccgagcccaccagctgcagctag

SEQ ID NO: 84688 - DNA, 792 bp, Artificial Sequence
  Description of Artificial Sequence: Synthetic coding sequence
caccactggggcggcaactactacgtggacagcttcctgctgggcgccgacgccgccgacgagctgagcgtgggcatgagaagaggcccctggccccccagacaggccgccaccctggccgagcaccccgacttcagcccctgcagcttccagagcaaggccaccgtgttcggcgccagctggaaccccgtgcacagagcccccaccctgtaccccgtgtaccaccaccaccaccaccacccctacgtgcacccccaggcccccgtggccgccgccgcccccgacggcagatacatgagaagctggctggagcccacccccggcgccctgagcttcgccggcctgcccagcagcagaccctacggcatcaagcccgagcccctgagcgccagaagaggcgactgccccaccctggacacccacaccctgagcctgaccgactacgcctgcggcagcccccccgtggacagagagaagcagcccagcgagggcgccttcagcgagaacaacgccgagaacgagagcggcggcgacaagccccccatcgaccccaacaaccccgccgccaactggctgcacgccagaagcaccagaaagaagagatgcccctacaccaagcaccagaccctggagctggagaaggagttcctgttcaacatgtacctgaccagagacagaagatacgaggtggccagactgctgaacctgaccgagagacaggtgaagatctggttccagaacagaagaatgaagatgaagaagatcaacaaggacagagccaaggacgagtag

SEQ ID NO: 84689 - DNA, 819 bp, Artificial Sequence
  Description of Artificial Sequence: Synthetic coding sequence
atggccaccaccggcgccctgggcaactactacgtggacagcttcctgctgggcgccgacgccgccgacgagctgagcgtgggcagatacgcccccggcaccctgggccagccccccagacaggccgccaccctggccgagcaccccgacttcagcccctgcagcttccagagcaaggccaccgtgttcggcgccagctggaaccccgtgcacgccgccggcgccaacgccgtgcccgccgccgtgtaccaccaccaccaccaccacccctacgtgcacccccaggcccccgtggccgccgccgcccccgacggcagatacatgagaagctggctggagcccacccccggcgccctgagcttcgccggcctgcccagcagcagaccctacggcatcaagcccgagcccctgagcgccagaagaggcgactgccccaccctggacacccacaccctgagcctgaccgactacgcctgcggcagcccccccgtggacagagagaagcagcccagcgagggcgccttcagcgagaacaacgccgagaacgagagcggcggcgacaagccccccatcgaccccaacaaccccgccgccaactggctgcacgccagaagcaccagaaagaagagatgcccctacaccaagcaccagaccctggagctggagaaggagttcctgttcaacatgtacctgaccagagacagaagatacgaggtggccagactgctgaacctgaccgagagacaggtgaagatctggttccagaacagaagaatgaagatgaagaagatcaacaaggacagagccaaggacgagtag

SEQ ID NO: 84690 - DNA, 591 bp, Artificial Sequence
  Description of Artificial Sequence: Synthetic coding sequence
atggccggcttcagcccctggagaagaagacagagaagaagaagaagaagaagaagagccagacagagcagagccgcccccgagctggtgggcgacctgggcagcttcctgctgctgggcagcaccttcctgagcaccgccagacactgcttcatcaccagcgtggagatcgtgagcagatacctgtgcgccagaggcagcggcagagccggccaccacggccccggcagagccagacccgccgtggccaccagcgccttccccgcccaggagcccagagtgttcctgagaagcgccctgcccgccggcagactgagccccagcaccacccacctgcacctggtgaccgccgacaaccccgccgccaactggctgcacgccagaagcaccagaaagaagagatgcccctacaccaagcaccagaccctggagctggagaaggagttcctgttcaacatgtacctgaccagagacagaagatacgaggtggccagactgctgaacctgaccgagagacaggtgaagatctggttccagaacagaagaatgaagatgaagaagatcaacaaggacagagccaaggacgagtag

SEQ ID NO: 84691 - DNA, 906 bp, Artificial Sequence
  Description of Artificial Sequence: Synthetic coding sequence
atggactacaacagaatgaacagcttcctggagtaccccctgtgcaacagaggccccagcgcctacagcgcccacagcgcccccaccagcttcccccccagcagcgcccaggccgtggacagctacgccagcgagggcagatacggcggcggcctgagcagccccgccttccagcagaacagcggctaccccgcccagcagccccccagcaccctgggcgtgcccttccccagcagcgcccccagcggctacgcccccgccgcctgcagccccagctacggccccagccagtactaccccctgggccagagcgagggcgacggcggctacttccaccccagcagctacggcgcccagctgggcggcctgagcgacggctacggcgccggcggcgccggccccggcccctaccccccccagcaccccccctacggcaacgagcagaccgccagcttcgcccccgcctacgccgacctgctgagcgaggacaaggagaccccctgccccagcgagcccaacacccccaccgccagaaccttcgactggatgaaggtgaagagaaacccccccaagaccgccaaggtgagcgagcccggcctgggcagccccagcggcctgagaaccaacttcaccaccagacagctgaccgagctggagaaggagttccacttcaacaagtacctgagcagagccagaagagtggagatcgccgccaccctggagctgaacgagacccaggtgaagatctggttccagaacagaagaatgaagcagaagaagagagagagagaggagggcagagtgccccccgccccccccggctgccccaaggaggccgccggcgacgccagcgaccagagcacctgcaccagccccgaggccagccccagcagcgtgaccagctag

SEQ ID NO: 84692 - DNA, 855 bp, Artificial Sequence
  Description of Artificial Sequence: Synthetic coding sequence
atggagcccggcaactacgccaccctggacggcgccaaggacatcgagggcctgctgggcgccggcggcggcagaaacctggtggcccacagccccctgaccagccaccccgccgcccccaccctgatgcccgccgtgaactacgcccccctggacctgcccggcagcgccgagccccccaagcagtgccacccctgccccggcgtgccccagggcaccagccccgcccccgtgccctacggctacttcggcggcggctactacagctgcagagtgagcagaagcagcctgaagccctgcgcccaggccgccaccctggccgcctaccccgccgagacccccaccgccggcgaggagtaccccagcagacccaccgagttcgccttctaccccggctaccccggcacctaccagcccatggccagctacctggacgtgagcgtggtgcagaccctgggcgcccccggcgagcccagacacgacagcctgctgcccgtggacagctaccagagctgggccctggccggcggctggaacagccagatgtgctgccagggcgagcagaacccccccggccccttctggaaggccgccttcgccgacagcagcggccagcacccccccgacgcctgcgccttcagaagaggcagaaagaagagaatcccctacagcaagggccagctgagagagctggagagagagtacgccgccaacaagttcatcaccaaggacaagagaagaaagatcagcgccgccaccagcctgagcgagagacagatcaccatctggttccagaacagaagagtgaaggagaagaaggtgctggccaaggtgaagaacagcgccaccccctag

SEQ ID NO: 84693 - DNA, 531 bp, Artificial Sequence
  Description of Artificial Sequence: Synthetic coding sequence
cccagatgcccccccggccccagagtgcccctggacgagagagaggagatcagacaggagacccagcccatcagacacgtgagcttcagcggcagactgagaagaagcggcggcgtgggcagccccgccgacggcctgggcagaagactggtggccgccggccaggccgcccacggcctgcaccagcacgccgccgccggcaccggcgagttccacttcaacaagtacctgtgcagacccagaagagtggagatcgccgccctgctggacctgaccgagagacaggtgaaggtgtggttccagaacagaagaatgaagcacaagagacagacccagcacagagagccccccgacggcgagcccgcctgccccggcgccctggaggacatctgcgaccccgccgaggagcccgccgccagccccggcggccccctggccggcggcgtgggcagcctgctgagccccgccggcggcggcgccggcggcctgaagagaggcccccccgccttcagcagaagcctgagaggctag

SEQ ID NO: 84694 - DNA, 1071 bp, Artificial Sequence
  Description of Artificial Sequence: Synthetic coding sequence
atgaacttcgagttcgagagagagatcggcttcatcaacagccagcccagcctggccgagtgcctgaccagcttccccgccgtgctggagaccttccagaccagcagcatcaaggagagcaccctgatccccccccccccccccttcgagcagaccttccccagcctgcagcccggcgccagcaccctgcagagacccagaagccagaagagagccgaggacggccccgccctgcccccccccccccccccccccctgcccgccgccccccccgcccccgagttcccctggatgaaggagaagaagagcgccaagaagcccagccagagcgccaccagccccagccccgccgccagcgccgtgcccgccagcggcgtgggcagccccgccgacggcctgggcctgcccgaggccggcggcggcggcgccagaagactgagaaccgcctacaccaacacccagctgctggagctggagaaggagttccacttcaacaagtacctgtgcagacccagaagagtggagatcgccgccctgctggacctgaccgagagacaggtgaaggtgtggttccagaacagaagaatgaagcacaagagacagacccagcacagagagccccccgacggcgagcccgcctgccccggcgccctggaggacatctgcgaccccgccgaggagcccgccgccagccccggcggccccagcgccagcagagccgcctgggaggcctgctgccacccccccgaggtggtgcccggcgccctgagcgccgaccccagacccctggccgtgagactggagggcgccggcgccagcagccccggctgcgccctgagaggcgccggcggcctggagcccggccccctgcccgaggacgtgttcagcggcagacaggacagccccttcctgcccgacctgaacttcttcgccgccgacagctgcctgcagctgagcggcggcctgagccccagcctgcagggcagcctggacagccccgtgcccttcagcgaggaggagctggacttcttcaccagcaccctgtgcgccatcgacctgcagttcccctag

SEQ ID NO: 84695 - DNA, 1296 bp, Artificial Sequence
  Description of Artificial Sequence: Synthetic coding sequence
atgcagaaggccacctactacgacaacgccgccgccgccctgttcggcggctacagcagctaccccggcagcaacggcttcggcttcgacgtgcccccccagccccccttccaggccgccacccacctggagggcgactaccagagaagcgcctgcagcctgcagagcctgggcaacgccgccccccacgccaagagcaaggagctgaacggcagctgcatgagacccggcctggcccccgagcccctgagcgccccccccggcagccccccccccagcgccgcccccaccagcgccaccagcaacagcagcaacggcggcggccccagcaagagcggcccccccaagtgcggccccggcaccaacagcaccctgaccaagcagatcttcccctggatgaaggagagcagacagaccagcaagctgaagaacaacagccccggcaccgccgagggctgcggcggcggcggcggcggcggcggcggcggcggcagcggcggcagcggcggcggcggcggcggcggcggcggcggcgacaagagcccccccggcagcgccgccagcaagagagccagaaccgcctacaccagcgcccagctggtggagctggagaaggagttccacttcaacagatacctgtgcagacccagaagagtggagatggccaacctgctgaacctgagcgagagacagatcaagatctggttccagaacagaagaatgaagtacaagaaggaccagaaggccaagggcctggccagcagcagcggcggccccagccccgccggcagccccccccagcccatgcagagcaccgccggcttcatgaacgccctgcacagcatgacccccagctacgagagccccagcccccccgccttcggcaaggcccaccagaacgcctacgccctgcccagcaactaccagccccccctgaagggctgcggcgccccccagaagtacccccccacccccgcccccgagtacgagccccacgtgctgcaggccaacggcggcgcctacggcacccccaccatgcagggcagccccgtgtacgtgggcggcggcggctacgccgaccccctgcccccccccgccggccccagcctgtacggcctgaaccacctgagccaccaccccagcggcaacctggactacaacggcgccccccccatggcccccagccagcaccacggcccctgcgagccccaccccacctacaccgacctgagcagccaccacgccccccccccccagggcagaatccaggaggcccccaagctgacccacctgtag

SEQ ID NO: 84696 - DNA, 900 bp, Artificial Sequence
  Description of Artificial Sequence: Synthetic coding sequence
atgaaggagagcagacagaccagcaagctgaagaacaacagccccggcaccgccgagggctgcggcggcggcggcggcggcggcggcggcggcggcagcggcggcagcggcggcggcggcggcggcggcggcggcggcgacaagagcccccccggcagcgccgccagcaagagagccagaaccgcctacaccagcgcccagctggtggagctggagaaggagttccacttcaacagatacctgtgcagacccagaagagtggagatggccaacctgctgaacctgagcgagagacagatcaagatctggttccagaacagaagaatgaagtacaagaaggaccagaaggccaagggcctggccagcagcagcggcggccccagccccgccggcagccccccccagcccatgcagagcaccgccggcttcatgaacgccctgcacagcatgacccccagctacgagagccccagcccccccgccttcggcaaggcccaccagaacgcctacgccctgcccagcaactaccagccccccctgaagggctgcggcgccccccagaagtacccccccacccccgcccccgagtacgagccccacgtgctgcaggccaacggcggcgcctacggcacccccaccatgcagggcagccccgtgtacgtgggcggcggcggctacgccgaccccctgcccccccccgccggccccagcctgtacggcctgaaccacctgagccaccaccccagcggcaacctggactacaacggcgccccccccatggcccccagccagcaccacggcccctgcgagccccaccccacctacaccgacctgagcagccaccacgccccccccccccagggcagaatccaggaggcccccaagctgacccacctgtag

SEQ ID NO: 84697 - DNA, 1296 bp, Artificial Sequence; identical to SEQ ID NO: 84695
  Description of Artificial Sequence: Synthetic coding sequence

SEQ ID NO: 84698 - DNA, 1077 bp, Artificial Sequence
  Description of Artificial Sequence: Synthetic coding sequence
atgagacccggcctggcccccgagcccctgagcgccccccccggcagccccccccccagcgccgcccccaccagcgccaccagcaacagcagcaacggcggcggccccagcaagagcggcccccccaagtgcggccccggcaccaacagcaccctgaccaagcagatcttcccctggatgaaggagagcagacagaccagcaagctgaagaacaacagccccggcaccgccgagggctgcggcggcggcggcggcggcggcggcggcggcggcagcggcggcagcggcggcggcggcggcggcggcggcggcggcgacaagagcccccccggcagcgccgccagcaagagagccagaaccgcctacaccagcgcccagctggtggagctggagaaggagttccacttcaacagatacctgtgcagacccagaagagtggagatggccaacctgctgaacctgagcgagagacagatcaagatctggttccagaacagaagaatgaagtacaagaaggaccagaaggccaagggcctggccagcagcagcggcggccccagccccgccggcagccccccccagcccatgcagagcaccgccggcttcatgaacgccctgcacagcatgacccccagctacgagagccccagcccccccgccttcggcaaggcccaccagaacgcctacgccctgcccagcaactaccagccccccctgaagggctgcggcgccccccagaagtacccccccacccccgcccccgagtacgagccccacgtgctgcaggccaacggcggcgcctacggcacccccaccatgcagggcagccccgtgtacgtgggcggcggcggctacgccgaccccctgcccccccccgccggccccagcctgtacggcctgaaccacctgagccaccaccccagcggcaacctggactacaacggcgccccccccatggcccccagccagcaccacggcccctgcgagccccaccccacctacaccgacctgagcagccaccacgccccccccccccagggcagaatccaggaggcccccaagctgacccacctgtag

SEQ ID NO: 84699 - DNA, 1296 bp, Artificial Sequence; identical to SEQ ID NO: 84695
  Description of Artificial Sequence: Synthetic coding sequence

SEQ ID NO: 84700 - DNA, 900 bp, Artificial Sequence; identical to SEQ ID NO: 84696
  Description of Artificial Sequence: Synthetic coding sequence

SEQ ID NO: 84701 - DNA, 1077 bp, Artificial Sequence; identical to SEQ ID NO: 84698
  Description of Artificial Sequence: Synthetic coding sequence

SEQ ID NO: 84702 - DNA, 1296 bp, Artificial Sequence; identical to SEQ ID NO: 84695
  Description of Artificial Sequence: Synthetic coding sequence

SEQ ID NO: 84703 - DNA, 756 bp, Artificial Sequence
  Description of Artificial Sequence: Synthetic coding sequence
atggccatgagcagcttcctgatcaacagcaactacgtggaccccaagttccccccctgcgaggagtacagccagagcgactacctgcccagcgaccacagccccggctactacgccggcggccagagaagagagagcagcttccagcccgaggccggcttcggcagaagagccgcctgcaccgtgcagagatacgccgcctgcagagaccccggccccccccccccccccccccccccccccccccccccccccccccccggcctgagccccagagcccccgcccccccccccgccggcgccctgctgcccgagcccggccagagatgcgaggccgtgagcagcagcccccccccccccccctgcgcccagaaccccctgcaccccagccccagccacagcgcctgcaaggagcccgtggtgtacccctggatgagaaaggtgcacgtgagcaccgtgaaccccaactacgccggcggcgagcccaagagaagcagaaccgcctacaccagacagcaggtgctggagctggagaaggagttccactacaacagatacctgaccagaagaagaagagtggagatcgcccacgccctgtgcctgagcgagagacagatcaagatctggttccagaacagaagaatgaagtggaagaaggaccacaagctgcccaacaccaagatcagaagcggcggcgccgccggcagcgccggcggcccccccggcagacccaacggcggccccagagccctgtag

SEQ ID NO: 84704 - DNA, 810 bp, Artificial Sequence
  Description of Artificial Sequence: Synthetic coding sequence
atgagcagctacttcgtgaacagcttcagcggcagataccccaacggccccgactaccagctgctgaactacggcagcggcagcagcctgagcggcagctacagagaccccgccgccatgcacaccggcagctacggctacaactacaacggcatggacctgagcgtgaacagaagcagcgccagcagcagccacttcggcgccgtgggcgagagcagcagagccttccccgcccccgcccaggagcccagattcagacaggccgccagcagctgcagcctgagcagccccgagagcctgccctgcaccaacggcgacagccacggcgccaagcccagcgccagcagccccagcgaccaggccaccagcgccagcagcagcgccaacttcaccgagatcgacgaggccagcgccagcagcgagcccgaggaggccgccagccagctgagcagccccagcctggccagagcccagcccgagcccatggccaccagcaccgccgcccccgagggccagaccccccagatcttcccctggatgagaaagctgcacatcagccacgacatgaccggccccgacggcaagagagccagaaccgcctacaccagataccagaccctggagctggagaaggagttccacttcaacagatacctgaccagaagaagaagaatcgagatcgcccacgccctgtgcctgagcgagagacagatcaagatctggttccagaacagaagaatgaagtggaagaaggacaacaagctgaagagcatgagcctggccaccgccggcagcgccttccagccctag

SEQ ID NO: 84705 - DNA, 1179 bp, Artificial Sequence
  Description of Artificial Sequence: Synthetic coding sequence
atggccgccctgagacagccccaggtggccgagctgctggccgaggccagaagagccttcagagaggagttcggcgccgagcccgagctggccgtgagcgcccccggcagagtgaacctgatcggcgagcacaccgactacaaccagggcctggtgctgcccatggccctggagctgatgaccgtgctggtgggcagccccagaaaggacggcctggtgagcctgctgaccaccagcgagggcgccgacgagccccagagactgcagttccccctgcccaccgcccagagaagcctggagcccggcacccccagatgggccaactacgtgaagggcgtgatccagtactaccccgccgcccccctgcccggcttcagcgccgtggtggtgagcagcgtgcccctgggcggcggcctgagcagcagcgccagcctggaggtggccacctacaccttcctgcagcagctgtgccccgacagcggcaccatcgccgccagagcccaggtgtgccagcaggccgagcacagcttcgccggcatgccctgcggcatcatggaccagttcatcagcctgatgggccagaagggccacgccctgctgatcgactgcagaagcctggagaccagcctggtgcccctgagcgaccccaagctggccgtgctgatcaccaacagcaacgtgagacacagcctggccagcagcgagtaccccgtgagaagaagacagtgcgaggaggtggccagagccctgggcaaggagagcctgagagaggtgcagctggaggagctggaggccgccagagacctggtgagcaaggagggcttcagaagagccagacacgtggtgggcgagatcagaagaaccgcccaggccgccgccgccctgagaagaggcgactacagagccttcggcagactgatggtggagagccacagaagcctgagagacgactacgaggtgagctgccccgagctggaccagctggtggaggccgccctggccgtgcccggcgtgtacggcagcagaatgaccggcggcggcttcggcggctgcaccgtgaccctgctggaggccagcgccgccccccacgccatgagacacatccaggagcactacggcggcaccgccaccttctacctgagccaggccgccgacggcgccaaggtgctgtgcctgtag

SEQ ID NO: 84706 - DNA, 675 bp, Artificial Sequence
  Description of Artificial Sequence: Synthetic coding sequence
atgagcagctacttcgtgaacagcaccttccccgtgaccctggccagcggccaggagagcttcctgggccagctgcccctgtacagcagcggctacgccgaccccctgagacactaccccgccccctacggccccggccccggccaggacaagggcttcgccaccagcagctactacccccccgccggcggcggctacggcagagccgccccctgcgactacggccccgcccccgccttctacagagagaaggagagcgcctgcgccctgagcggcgccgacgagcagccccccttccaccccgagcccagaaagagcgactgcgcccaggacaagagcgtgttcggcgagaccgaggagcagaagtgcagcacccccgtgtacccctggatgcagagaatgaacagctgcaacagcagcagcttcggccccagcggcagaagaggcagacagacctacaccagataccagaccctggagctggagaaggagttccactacaacagatacctgaccagaagaagaagaatcgagatcgcccacgccctgtgcctgaccgagagacagatcaagatctggttccagaacagaagaatgaagtggaagaaggagagcaagctgctgagcgccagccagctgagcgccgaggaggaggaggagaagcaggccgagtag

SEQ ID NO: 84707 - DNA, 654 bp, Artificial Sequence
  Description of Artificial Sequence: Synthetic coding sequence
atgagcagcctgtactacgccaacaccctgttcagcaagtaccccgccagcagcagcgtgttcgccaccggcgccttccccgagcagaccagctgcgccttcgccagcaacccccagagacccggctacggcgccggcagcggcgccagcttcgccgccagcatgcagggcctgtaccccggcggcggcggcatggccggccagagcgccgccggcgtgtacgccgccggctacggcctggagcccagcagcttcaacatgcactgcgcccccttcgagcagaacctgagcggcgtgtgccccggcgacagcgccaaggccgccggcgccaaggagcagagagacagcgacctggccgccgagagcaacttcagaatctacccctggatgagaagcagcggcaccgacagaaagagaggcagacagacctacaccagataccagaccctggagctggagaaggagttccactacaacagatacctgaccagaagaagaagaatcgagatcgcccacaccctgtgcctgaccgagagacagatcaagatctggttccagaacagaagaatgaagtggaagaaggagaacaagaccgccggccccggcaccaccggccaggacagagccgaggccgaggaggaggaggaggagtag

SEQ ID NO: 84708 - DNA, 87 bp, Artificial Sequence
  Description of Artificial Sequence: Synthetic coding sequence
atgaagtggaagaaggagaacaagaccgccggccccggcaccaccggccaggacagagccgaggccgaggaggaggaggaggagtag

SEQ ID NO: 84709 - DNA, 732 bp, Artificial Sequence
  Description of Artificial Sequence: Synthetic coding sequence
atgagcagctacttcgtgaacagcctgttcagcaagtacaagaccggcgagagcctgagacccaactactacgactgcggcttcgcccaggacctgggcggcagacccaccgtggtgtacggccccagcagcggcggcagcttccagcaccccagccagatccaggagttctaccacggccccagcagcctgagcaccgccccctaccagcagaacccctgcgccgtggcctgccacggcgaccccggcaacttctacggctacgaccccctgcagagacagagcctgttcggcgcccaggaccccgacctggtgcagtacgccgactgcaagctggccgccgccagcggcctgggcgaggaggccgagggcagcgagcagagccccagccccacccagctgttcccctggatgagaccccaggccgccgccggcagaagaagaggcagacagacctacagcagataccagaccctggagctggagaaggagttcctgttcaacccctacctgaccagaaagagaagaatcgaggtgagccacgccctgggcctgaccgagagacaggtgaagatctggttccagaacagaagaatgaagtggaagaaggagaacaacaaggacaagttccccagcagcaagtgcgagcaggaggagctggagaagcagaagctggagagagcccccgaggccgccgacgagggcgacgcccagaagggcgacaagaagtag

SEQ ID NO: 84710 - DNA, 753 bp, Artificial Sequence
  Description of Artificial Sequence: Synthetic coding sequence
atgagcatcagcggcaccctgagcagctactacgtggacagcatcatcagccacgagagcgaggacgccccccccgccaagttccccagcggccagtacgccagcagcagacagcccggccacgccgagcacctggagttccccagctgcagcttccagcccaaggcccccgtgttcggcgccagctgggcccccctgagcccccacgccagcggcagcctgcccagcgtgtaccacccctacatccagccccagggcgtgccccccgccgagagcagatacctgagaacctggctggagcccgcccccagaggcgaggccgcccccggccagggccaggccgccgtgaaggccgagcccctgctgggcgcccccggcgagctgctgaagcagggcacccccgagtacagcctggagaccagcgccggcagagaggccgtgctgagcaaccagagacccggctacggcgacaacaagatctgcgagggcagcgaggacaaggagagacccgaccagaccaaccccagcgccaactggctgcacgccagaagcagcagaaagaagagatgcccctacaccaagtaccagaccctggagctggagaaggagttcctgttcaacatgtacctgaccagagacagaagacacgaggtggccagactgctgaacctgagcgagagacaggtgaagatctggttccagaacagaagaatgaagatgaagaagatgaacaaggagcagggcaaggagtag

SEQ ID NO: 84711 - DNA, 387 bp, Artificial Sequence
  Description of Artificial Sequence: Synthetic coding sequence
atgagcatcagcggcaccctgagcagctactacgtggacagcatcatcagccacgagagcgaggacgccccccccgccaagttccccagcggccagtacgccagcagcagacagcccggccacgccgagcacctggagttccccagctgcagcttccagcccaaggcccccgtgttcggcgccagctgggcccccctgagcccccacgccagcggcagcctgcccagcgtgtaccacccctacatccagccccagggcgtgccccccgccgagagcagatacctgagaacctggctggagcccgcccccagaggcggcgccgcccagaccggccacgccagagtgcagttcggcaacttcggcggccagggcggcagagccgtgtag

SEQ ID NO: 84712 - DNA, 1029 bp, Artificial Sequence
  Description of Artificial Sequence: Synthetic coding sequence
atgacctgccccagaaacgtgacccccaacagctacgccgagcccctggccgcccccggcggcggcgagagatacagcagaagcgccggcatgtacatgcagagcggcagcgacttcaactgcggcgtgatgagaggctgcggcctggcccccagcctgagcaagagagacgagggcagcagccccagcctggccctgaacacctaccccagctacctgagccagctggacagctggggcgaccccaaggccgcctacagactggagcagcccgtgggcagacccctgagcagctgcagctacccccccagcgtgaaggaggagaacgtgtgctgcatgtacagcgccgagaagagagccaagagcggccccgaggccgccctgtacagccaccccctgcccgagagctgcctgggcgagcacgaggtgcccgtgcccagctactacagagccagccccagctacagcgccctggacaagaccccccactgcagcggcgccaacgacttcgaggcccccttcgagcagagagccagcctgaaccccagagccgagcacctggagagcccccagctgggcggcaaggtgagcttccccgagacccccaagagcgacagccagacccccagccccaacgagatcaagaccgagcagagcctggccggccccaagggcagccccagcgagagcgagaaggagagagccaaggccgccgacagcagccccgacaccagcgacaacgaggccaaggaggagatcaaggccgagaacaccaccggcaactggctgaccgccaagagcggcagaaagaagagatgcccctacaccaagcaccagaccctggagctggagaaggagttcctgttcaacatgtacctgaccagagagagaagactggagatcagcaagaccatcaacctgaccgacagacaggtgaagatctggttccagaacagaagaatgaagctgaagaagatgaacagagagaacagaatcagagagctgaccagcaacttcaacttcacctag

SEQ ID NO: 84713 - DNA, 915 bp, Artificial Sequence
  Description of Artificial Sequence: Synthetic coding sequence
atgttcaacagcgtgaacctgggcaacttctgcagccccagcagaaaggagagaggcgccgacttcggcgagagaggcagctgcgccagcaacctgtacctgcccagctgcacctactacatgcccgagttcagcaccgtgagcagcttcctgccccaggcccccagcagacagatcagctacccctacagcgcccaggtgccccccgtgagagaggtgagctacggcctggagcccagcggcaagtggcaccacagaaacagctacagcagctgctacgccgccgccgacgagctgatgcacagagagtgcctgccccccagcaccgtgaccgagatcctgatgaagaacgagggcagctacggcggccaccaccaccccagcgccccccacgccacccccgccggcttctacagcagcgtgaacaagaacagcgtgctgccccaggccttcgacagattcttcgacaacgcctactgcggcggcggcgacccccccgccgagcccccctgcagcggcaagggcgaggccaagggcgagcccgaggccccccccgccagcggcctggccagcagagccgaggccggcgccgaggccgaggccgaggaggagaacaccaaccccagcagcagcggcagcgcccacagcgtggccaaggagcccgccaagggcgccgcccccaacgcccccagaaccagaaagaagagatgcccctacagcaagttccagatcagagagctggagagagagttcttcttcaacgtgtacatcaacaaggagaagagactgcagctgagcagaatgctgaacctgaccgacagacaggtgaagatctggttccagaacagaagaatgaaggagaagaagctgagcagagacagactgcagtacttcagcggcaaccccctgctgtag

SEQ ID NO: 84714 - DNA, 849 bp, Artificial Sequence
  Description of Artificial Sequence: Synthetic coding sequence
atgggcgagcacaacctgctgaaccccggcttcgtgggccccctggtgaacatccacaccggcgacaccttctacttccccaacttcagagccagcggcgcccagctgcccggcctgcccagcctgagctaccccagaagagacaacgtgtgcagcctgagctggcccagcgccgagccctgcaacggctacccccagccctacctgggcagccccgtgagcctgaacccccccttcggcagaacctgcgagctggccagagtggaggacggcaagggctactacagagagccctgcgccgagggcggcggcggcggcctgaagagagaggagagaggcagagaccccggcgccggccccggcgccgccctgctgcccctggagcccagcggcccccccgccctgggcttcaagtacgactacgccgccggcggcggcggcggcgacggcggcggcggcgccggccccccccacgacccccccagctgccagagcctggagagcgacagcagcagcagcctgctgaacgagggcaacaagggcgccggcgccggcgaccccggcagcctggtgagccccctgaaccccggcggcggcctgagcgccagcggcgccccctggtaccccatcaacagcagaagcagaaagaagagaaagccctacagcaagctgcagctggccgagctggagggcgagttcctggtgaacgagttcatcaccagacagagaagaagagagctgagcgacagactgaacctgagcgaccagcaggtgaagatctggttccagaacagaagaatgaagaagaagagactgctgctgagagagcaggccctgagcttcttctag

SEQ ID NO: 84715 - DNA, 993 bp, Artificial Sequence
  Description of Artificial Sequence: Synthetic coding sequence
atgaccaccagcctgctgctgcaccccagatggcccgagagcctgatgtacgtgtacgaggacagcgccgccgagagcggcatcggcggcggcggcggcggcggcggcggcggcaccggcggcgccggcggcggctgcagcggcgccagccccggcaaggcccccagcatggacggcctgggcagcagctgccccgccagccactgcagagacctgctgccccaccccgtgctgggcagaccccccgcccccctgggcgccccccagggcgccgtgtacaccgacatccccgcccccgaggccgccagacagtgcgcccccccccccgccccccccaccagcagcagcgccaccctgggctacggctaccccttcggcggcagctactacggctgcagactgagccacaacgtgaacctgcagcagaagccctgcgcctaccaccccggcgacaagtaccccgagcccagcggcgccctgcccggcgacgacctgagcagcagagccaaggagttcgccttctaccccagcttcgccagcagctaccaggccatgcccggctacctggacgtgagcgtggtgcccggcatcagcggccaccccgagcccagacacgacgccctgatccccgtggagggctaccagcactgggccctgagcaacggctgggacagccaggtgtactgcagcaaggagcagagccagagcgcccacctgtggaagagccccttccccgacgtggtgcccctgcagcccgaggtgagcagctacagaagaggcagaaagaagagagtgccctacaccaaggtgcagctgaaggagctggagaaggagtacgccgccagcaagttcatcaccaaggagaagagaagaagaatcagcgccaccaccaacctgagcgagagacaggtgaccatctggttccagaacagaagagtgaaggagaagaaggtggtgagcaagagcaaggccccccacctgcacagcacctag

SEQ ID NO: 84716 - DNA, 795 bp, Artificial Sequence
  Description of Artificial Sequence: Synthetic coding sequence
atgatcatgagcagctacctgatggacagcaactacatcgaccccaagttccccccctgcgaggagtacagccagaacagctacatccccgagcacagccccgagtactacggcagaaccagagagagcggcttccagcaccaccaccaggagctgtaccccccccccccccccagacccagctaccccgagagacagtacagctgcaccagcctgcagggccccggcaacagcagaggccacggccccgcccaggccggccaccaccaccccgagaagagccagagcctgtgcgagcccgcccccctgagcggcgccagcgccagccccagccccgccccccccgcctgcagccagcccgcccccgaccaccccagcagcgccgccagcaagcagcccatcgtgtacccctggatgaagaagatccacgtgagcaccgtgaaccccaactacaacggcggcgagcccaagagaagcagaaccgcctacaccagacagcaggtgctggagctggagaaggagttccactacaacagatacctgaccagaagaagaagaatcgagatcgcccacagcctgtgcctgagcgagagacagatcaagatctggttccagaacagaagaatgaagtggaagaaggaccacagactgcccaacaccaaggtgagaagcgccccccccgccggcgccgcccccagcaccctgagcgccgccacccccggcaccagcgaggaccacagccagagcgccaccccccccgagcagcagagagccgaggacatcaccagactgtag

SEQ ID NO: 84717 - DNA, 795 bp, Artificial Sequence; identical to SEQ ID NO: 84716
  Description of Artificial Sequence: Synthetic coding sequence

SEQ ID NO: 84718 - DNA, 669 bp, Artificial Sequence
  Description of Artificial Sequence: Synthetic coding sequence
atgagcagctacgtggccaacagcttctacaagcagagccccaacatccccgcctacaacatgcagacctgcggcaactacggcagcgccagcgaggtgcaggccagcagatactgctacggcggcctggacctgagcatcaccttccccccccccgcccccagcaacagcctgcacggcgtggacatggccgccaaccccagagcccaccccgacagacccgcctgcagcgccgccgccgcccccggccacgcccccggcagagacgaggccgcccccctgaaccccggcatgtacagccagaaggccgccagacccgccctggaggagagagccaagagcagcggcgagatcaaggaggagcaggcccagaccggccagcccgccggcctgagccagccccccgcccccccccagatctacccctggatgaccaagctgcacatgagccacgagaccgacggcaagagaagcagaaccagctacaccagataccagaccctggagctggagaaggagttccacttcaacagatacctgaccagaagaagaagaatcgagatcgccaacaacctgtgcctgaacgagagacagatcaagatctggttccagaacagaagaatgaagtggaagaaggacagcaagatgaagagcaaggaggccctgtag

SEQ ID NO: 84719 - DNA, 708 bp, Artificial Sequence
  Description of Artificial Sequence: Synthetic coding sequence
atgaacagctacttcaccaaccccagcctgagctgccacctggccggcggccaggacgtgctgcccaacgtggccctgaacagcaccgcctacgaccccgtgagacacttcagcacctacggcgccgccgtggcccagaacagaatctacagcacccccttctacagcccccaggagaacgtggtgttcagcagcagcagaggcccctacgactacggcagcaacagcttctaccaggagaaggacatgctgagcaactgcagacagaacaccctgggccacaacacccagaccagcatcgcccaggacttcagcagcgagcagggcagaaccgccccccaggaccagaaggccagcatccagatctacccctggatgcagagaatgaacagccacagcggcgtgggctacggcgccgacagaagaagaggcagacagatctacagcagataccagaccctggagctggagaaggagttccacttcaacagatacctgaccagaagaagaagaatcgagatcgccaacgccctgtgcctgaccgagagacagatcaagatctggttccagaacagaagaatgaagtggaagaaggagagcaacctgaccagcaccctgagcggcggcggcggcggcgccaccgccgacagcctgggcggcaaggaggagaagagagaggagaccgaggaggagaagcagaaggagtag

SEQ ID NO: 84720 - DNA, 462 bp, Artificial Sequence
  Description of Artificial Sequence: Synthetic coding sequence
atgctgagcaactgcagacagaacaccctgggccacaacacccagaccagcatcgcccaggacttcagcagcgagcagggcagaaccgccccccaggaccagaaggccagcatccagatctacccctggatgcagagaatgaacagccacagcggcgtgggctacggcgccgacagaagaagaggcagacagatctacagcagataccagaccctggagctggagaaggagttccacttcaacagatacctgaccagaagaagaagaatcgagatcgccaacgccctgtgcctgaccgagagacagatcaagatctggttccagaacagaagaatgaagtggaagaaggagagcaacctgaccagcaccctgagcggcggcggcggcggcgccaccgccgacagcctgggcggcaaggaggagaagagagaggagaccgaggaggagaagcagaaggagtag

SEQ ID NO: 84721 - DNA, 159 bp, Artificial Sequence
  Description of Artificial Sequence: Synthetic coding sequence
atgctgagcaactgcagacagaacaccctgggccacaacacccagaccagcatcgcccaggacttcagcagcgagcagggcagaaccgccccccaggaccagaaggccagcatccagatctacccctggatgcagagaatgaacagccacagcggctag

SEQ ID NO: 84722 - DNA, 216 bp, Artificial Sequence
  Description of Artificial Sequence: Synthetic coding sequence
atgctgagcaactgcagacagaacaccctgggccacaacacccagaccagcatcgcccaggacttcagcagcgagcagggcagaaccgccccccaggaccagaaggccagcatccagatctacccctggatgcagagaatgaacagccacagcgtgtgcttcgtgcccggcagcctgggcgtgggctacggcgccgacagaagaagaggcagatag

SEQ ID NO: 84723 - DNA, 729 bp, Artificial Sequence
  Description of Artificial Sequence: Synthetic coding sequence
atgagcagctacttcgtgaaccccctgttcagcaagtacaaggccggcgagagcctggagcccgcctactacgactgcagattcccccagagcgtgggcagaagccacgccctggtgtacggccccggcggcagcgcccccggcttccagcacgccagccaccacgtgcaggacttcttccaccacggcaccagcggcatcagcaacagcggctaccagcagaacccctgcagcctgagctgccacggcgacgccagcaagttctacggctacgaggccctgcccagacagagcctgtacggcgcccagcaggaggccagcgtggtgcagtaccccgactgcaagagcagcgccaacaccaacagcagcgagggccagggccacctgaaccagaacagcagccccagcctgatgttcccctggatgagaccccacgcccccggcagaagaagcggcagacagacctacagcagataccagaccctggagctggagaaggagttcctgttcaacccctacctgaccagaaagagaagaatcgaggtgagccacgccctgggcctgaccgagagacaggtgaagatctggttccagaacagaagaatgaagtggaagaaggagaacaacaaggacaagctgcccggcgccagagacgaggagaaggtggaggaggagggcaacgaggaggaggagaaggaggaggaggagaaggaggagaacaaggactag

SEQ ID NO: 84724 - DNA, 783 bp, Artificial Sequence
  Description of Artificial Sequence: Synthetic coding sequence
atgagcgccaccggccccatcagcaactactacgtggacagcctgatcagccacgacaacgaggacctgctggccagcagattccccgccaccggcgcccaccccgccgccgccagacccagcggcctggtgcccgactgcagcgacttccccagctgcagcttcgcccccaagcccgccgtgttcagcaccagctgggcccccgtgcccagccagagcagcgtggtgtaccacccctacggcccccagccccacctgggcgccgacaccagatacatgagaacctggctggagcccctgagcggcgccgtgagcttccccagcttccccgccggcggcagacactacgccctgaagcccgacgcctaccccggcagaagagccgactgcggccccggcgagggcagaagctaccccgactacatgtacggcagccccggcgagctgagagacagagccccccagaccctgcccagccccgaggccgacgccctggccggcagcaagcacaaggaggagaaggccgacctggaccccagcaaccccgtggccaactggatccacgccagaagcaccagaaagaagagatgcccctacaccaagtaccagaccctggagctggagaaggagttcctgttcaacatgtacctgaccagagacagaagatacgaggtggccagagtgctgaacctgaccgagagacaggtgaagatctggttccagaacagaagaatgaagatgaagaagatgaacaaggagaagaccgacaaggagcagagctag

SEQ ID NO: 84725 - DNA, 783 bp, Artificial Sequence; identical to SEQ ID NO: 84724
  Description of Artificial Sequence: Synthetic coding sequence

SEQ ID NO: 84726 - DNA, 987 bp, Artificial Sequence
  Description of Artificial Sequence: Synthetic coding sequence
atgagcagctacctggagtacgtgagctgcagcagcagcggcggcgtgggcggcgacgtgctgagcctggcccccaagttctgcagaagcgacgccagacccgtggccctgcagcccgccttccccctgggcaacggcgacggcgccttcgtgagctgcctgcccctggccgccgccagacccagccccagcccccccgccgcccccgccagacccagcgtgcccccccccgccgccccccagtacgcccagtgcaccctggagggcgcctacgagcccggcgccgcccccgccgccgccgccggcggcgccgactacggcttcctgggcagcggccccgcctacgacttccccggcgtgctgggcagagccgccgacgacggcggcagccacgtgcactacgccaccagcgccgtgttcagcggcggcggcagcttcctgctgagcggccaggtggactacgccgccttcggcgagcccggccccttccccgcctgcctgaaggccagcgccgacggccaccccggcgccttccagaccgccagccccgcccccggcacctaccccaagagcgtgagccccgccagcggcctgcccgccgccttcagcaccttcgagtggatgaaggtgaagagaaacgccagcaagaagggcaagctggccgagtacggcgccgccagccccagcagcgccatcagaaccaacttcagcaccaagcagctgaccgagctggagaaggagttccacttcaacaagtacctgaccagagccagaagaatcgagatcgccaactgcctgcacctgaacgacacccaggtgaagatctggttccagaacagaagaatgaagcagaagaagagagagagagagggcctgctggccaccgccatccccgtggcccccctgcagctgcccctgagcggcaccacccccaccaagttcatcaagaaccccggcagccccagccagagccaggagcccagctag

SEQ ID NO: 84727 - DNA, 630 bp, Artificial Sequence
  Description of Artificial Sequence: Synthetic coding sequence
ctggagagagccgccagagtggagagagccggcggcgccgcccagaccgccgccgtgctgctgagcctgtgccccgccccctacagcggccccggcctgagaccccacctggccttcgcccccggcagacccagagccgccgtgagaaccgccagcggcagagcccccgtgagagccgtgcaccccggcggcggcctgagaacctggtgcagaacctgcagaggcagctggggcagaggcctgagactgcccggcgtgagagccggcgtgagactgcccggcagagccggcgccggcggccccttccccgcctgcctgaaggccagcgccgacggccaccccggcgccttccagaccgccagccccgcccccggcacctaccccaagagcgtgagccccgccagcggcctgcccgccgccttcagcaccttcgagtggatgaaggtgaagagaaacgccagcaagaaggacagcggcctgggcttcgtggaggagaccagaagcagagccaacagcatggagagcgccagcagcaccgacagcgagaacgtgcccggcatcgagaagatcagcggcagaagcagcccctggaacttcagctggcagaccagaagagtgtggggcagatag

SEQ ID NO: 84728 - DNA, 1023 bp, Artificial Sequence
  Description of Artificial Sequence: Synthetic coding sequence
atgagcttccccaacagcagccccgccgccaacaccttcctggtggacagcctgatcagcgcctgcagaagcgacagcttctacagcagcagcgccagcatgtacatgcccccccccagcgccgacatgggcacctacggcatgcagacctgcggcctgctgcccagcctggccaagagagaggtgaaccaccagaacatgggcatgaacgtgcacccctacatcccccaggtggacagctggaccgaccccaacagaagctgcagaatcgagcagcccgtgacccagcaggtgcccacctgcagcttcaccaccaacatcaaggaggagagcaactgctgcatgtacagcgacaagagaaacaagctgatcagcgccgaggtgcccagctaccagagactggtgcccgagagctgccccgtggagaaccccgaggtgcccgtgcccggctacttcagactgagccagacctacgccaccggcaagacccaggagtacaacaacagccccgagggcagcagcaccgtgatgctgcagctgaaccccagaggcgccgccaagccccagctgagcgccgcccagctgcagatggagaagaagatgaacgagcccgtgagcggccaggagcccaccaaggtgagccaggtggagagccccgaggccaagggcggcctgcccgaggagagaagctgcctggccgaggtgagcgtgagcagccccgaggtgcaggagaaggagagcaaggaggagatcaagagcgacacccccaccagcaactggctgaccgccaagagcggcagaaagaagagatgcccctacaccaagcaccagaccctggagctggagaaggagttcctgttcaacatgtacctgaccagagagagaagactggagatcagcaagagcgtgaacctgaccgacagacaggtgaagatctggttccagaacagaagaatgaagctgaagaagatgagcagagagaacagaatcagagagctgaccgccaacctgaccttcagctag

SEQ ID NO: 84729 - DNA, 1017 bp, Artificial Sequence
  Description of Artificial Sequence: Synthetic coding sequence
atgaacgacttcgacgagtgcggccagagcgccgccagcatgtacctgcccggctgcgcctactacgtggcccccagcgacttcgccagcaagcccagcttcctgagccagcccagcagctgccagatgaccttcccctacagcagcaacctggccccccacgtgcagcccgtgagagaggtggccttcagagactacggcctggagagagccaagtggccctacagaggcggcggcggcggcggcagcgccggcggcggcagcagcggcggcggccccggcggcggcggcggcggcgccggcggctacgccccctactacgccgccgccgccgccgccgccgccgccgccgccgccgccgaggaggccgccatgcagagagagctgctgccccccgccggcagaagacccgacgtgctgttcaaggcccccgagcccgtgtgcgccgcccccggccccccccacggccccgccggcgccgccagcaacttctacagcgccgtgggcagaaacggcatcctgccccagggcttcgaccagttctacgaggccgcccccggcccccccttcgccggcccccagcccccccccccccccgcccccccccagcccgagggcgccgccgacaagggcgaccccagaaccggcgccggcggcggcggcggcagcccctgcaccaaggccacccccggcagcgagcccaagggcgccgccgagggcagcggcggcgacggcgagggcccccccggcgaggccggcgccgagaagagcagcagcgccgtggccccccagagaagcagaaagaagagatgcccctacaccaagtaccagatcagagagctggagagagagttcttcttcaacgtgtacatcaacaaggagaagagactgcagctgagcagaatgctgaacctgaccgacagacaggtgaagatctggttccagaacagaagaatgaaggagaagaagctgaacagagacagactgcagtacttcaccggcaaccccctgttctag

SEQ ID NO: 84730 - DNA, 480 bp, Artificial Sequence
  Description of Artificial Sequence: Synthetic coding sequence
atgtacctgcccggctgcgcctactacgtggcccccagcgacttcgccagcaagcccagcttcctgagccagcccagcagctgccagatgaccttcccctacagcagcaacctggcccccggcggcggcagcccctgcaccaaggccacccccggcagcgagcccaagggcgccgccgagggcagcggcggcgacggcgagggcccccccggcgaggccggcgccgagaagagcagcagcgccgtggccccccagagaagcagaaagaagagatgcccctacaccaagtaccagatcagagagctggagagagagttcttcttcaacgtgtacatcaacaaggagaagagactgcagctgagcagaatgctgaacctgaccgacagacaggtgaagatctggttccagaacagaagaatgaaggagaagaagctgaacagagacagactgcagtacttcaccggcaaccccctgttctag

SEQ ID NO: 84731 - DNA, 813 bp, Artificial Sequence
  Description of Artificial Sequence: Synthetic coding sequence
atgtgcgagagaagcctgtacagagccggctacgtgggcagcctgctgaacctgcagagccccgacagcttctacttcagcaacctgagacccaacggcggccagctggccgccctgccccccatcagctaccccagaggcgccctgccctgggccgccacccccgccagctgcgcccccgcccagcccgccggcgccaccgccttcggcggcttcagccagccctacctggccggcagcggccccctgggcctgcagccccccaccgccaaggacggccccgaggagcaggccaagttctacgcccccgaggccgccgccggccccgaggagagaggcagaaccagacccagcttcgcccccgagagcagcctggcccccgccgtggccgccctgaaggccgccaagtacgactacgccggcgtgggcagagccacccccggcagcaccaccctgctgcagggcgccccctgcgcccccggcttcaaggacgacaccaagggccccctgaacctgaacatgaccgtgcaggccgccggcgtggccagctgcctgagacccagcctgcccgacggcctgccctggggcgccgcccccggcagagccagaaagaagagaaagccctacaccaagcagcagatcgccgagctggagaacgagttcctggtgaacgagttcatcaacagacagaagagaaaggagctgagcaacagactgaacctgagcgaccagcaggtgaagatctggttccagaacagaagaatgaagaagaagagagtggtgctgagagagcaggccctggccctgtactag

SEQ ID NO: 84732 - DNA, 1299 bp, Artificial Sequence
  Description of Artificial Sequence: Synthetic coding sequence
atgctgttcgagcagggccagcaggccctggagctgcccgagtgcaccatgcagaaggccgcctactacgagaaccccggcctgttcggcggctacggctacagcaagaccaccgacacctacggctacagcaccccccaccagccctaccccccccccgccgccgccagcagcctggacaccgactaccccggcagcgcctgcagcatccagagcagcgcccccctgagagcccccgcccacaagggcgccgagctgaacggcagctgcatgagacccggcaccggcaacagccagggcggcggcggcggcagccagccccccggcctgaacagcgagcagcagcccccccagccccccccccccccccccaccctgccccccagcagccccaccaaccccggcggcggcgtgcccgccaagaagcccaagggcggccccaacgccagcagcagcagcgccaccatcagcaagcagatcttcccctggatgaaggagagcagacagaacagcaagcagaagaacagctgcgccaccgccggcgagagctgcgaggacaagagcccccccggccccgccagcaagagagtgagaaccgcctacaccagcgcccagctggtggagctggagaaggagttccacttcaacagatacctgtgcagacccagaagagtggagatggccaacctgctgaacctgaccgagagacagatcaagatctggttccagaacagaagaatgaagtacaagaaggaccagaaggccaagggcatcctgcacagccccgccagccagagccccgagagaagcccccccctgggcggcgccgccggccacgtggcctacagcggccagctgccccccgtgcccggcctggcctacgacgcccccagcccccccgccttcgccaagagccagcccaacatgtacggcctggccgcctacaccgcccccctgagcagctgcctgccccagcagaagagatacgccgcccccgagttcgagccccaccccatggccagcaacggcggcggcttcgccagcgccaacctgcagggcagccccgtgtacgtgggcggcaacttcgtggagagcatggcccccgccagcggccccgtgttcaacctgggccacctgagccaccccagcagcgccagcgtggactacagctgcgccgcccagatccccggcaaccaccaccacggcccctgcgacccccaccccacctacaccgacctgagcgcccaccacagcagccagggcagactgcccgaggcccccaagctgacccacctgtag

SEQ ID NO: 84733 - DNA, 1299 bp, Artificial Sequence; identical to SEQ ID NO: 84732
  Description of Artificial Sequence: Synthetic coding sequence

SEQ ID NO: 84734 - DNA, 303 bp, Artificial Sequence
  Description of Artificial Sequence: Synthetic coding sequence
atgctgttcgagcagggccagcaggccctggagctgcccgagtgcaccatgcagaaggccgcctactacgagaaccccggcctgttcggcggctacggctacagcaagaccaccgacacctacggctacagcaccccccaccagccctaccccccccccgccgccgccagcagcctggacaccgactaccccggcagcgcctgcagcatccagagcagcgcccccctgagagcccccgcccacaagggcgccgagctgaacggcagctgcatgagacccggcaccggcaacagccagggctag

SEQ ID NO: 84735 - DNA, 1299 bp, Artificial Sequence; identical to SEQ ID NO: 84732
  Description of Artificial Sequence: Synthetic coding sequence

SEQ ID NO: 84736 - DNA, 768 bp, Artificial Sequence
  Description of Artificial Sequence: Synthetic coding sequence
atggtgatgagcagctacatggtgaacagcaagtacgtggaccccaagttccccccctgcgaggagtacctgcagggcggctacctgggcgagcagggcgccgactactacggcggcggcgcccagggcgccgacttccagccccccggcctgtaccccagacccgacttcggcgagcagcccttcggcggcagcggccccggccccggcagcgccctgcccgccagaggccacggccaggagcccggcggccccggcggccactacgccgcccccggcgagccctgccccgccccccccgcccccccccccgcccccctgcccggcgccagagcctacagccagagcgaccccaagcagccccccagcggcaccgccctgaagcagcccgccgtggtgtacccctggatgaagaaggtgcacgtgaacagcgtgaaccccaactacaccggcggcgagcccaagagaagcagaaccgcctacaccagacagcaggtgctggagctggagaaggagttccacttcaacagatacctgaccagaagaagaagaatcgagatcgcccacaccctgtgcctgagcgagagacagatcaagatctggttccagaacagaagaatgaagtggaagaaggaccacaagctgcccaacaccaagggcagaagcagcagcagcagcagcagcagcagctgcagcagcagcgtggcccccagccagcacctgcagcccatggccaaggaccaccacaccgacctgaccaccctgtag

SEQ ID NO: 84737 - DNA, 873 bp, Artificial Sequence
  Description of Artificial Sequence: Synthetic coding sequence
atgagcagctacttcgtgaaccccctgtacagcaagtacaaggccgccgccgccgccgccgccgccgccggcgaggccatcaaccccacctactacgactgccacttcgcccccgaggtgggcggcagacacgccgccgccgccgccgccctgcagctgtacggcaacagcgccgccggcttcccccacgcccccccccaggcccacgcccacccccaccccagccccccccccagcggcaccggctgcggcggcagagagggcagaggccaggagtacttccaccccggcggcggcagccccgccgccgcctaccaggccgccccccccccccccccccacccccccccccccccccccccccccccctgcggcggcatcgcctgccacggcgagcccgccaagttctacggctacgacaacctgcagagacagcccatcttcaccacccagcaggaggccgagctggtgcagtaccccgactgcaagagcagcagcggcaacatcggcgaggaccccgaccacctgaaccagagcagcagccccagccagatgttcccctggatgagaccccaggccgcccccggcagaagaagaggcagacagacctacagcagattccagaccctggagctggagaaggagttcctgttcaacccctacctgaccagaaagagaagaatcgaggtgagccacgccctggccctgaccgagagacaggtgaagatctggttccagaacagaagaatgaagtggaagaaggagaacaacaaggacaagttccccgtgagcagacaggaggtgaaggacggcgagaccaagaaggaggcccaggagctggaggaggacagagccgagggcctgaccaactag

SEQ ID NO: 84738 - DNA, 870 bp, Artificial Sequence
  Description of Artificial Sequence: Synthetic coding sequence
atgagcagctacttcgtgaaccccctgtacagcaagtacaaggccgccgccgccgccgccgccgccgccggcgaggccatcaaccccacctactacgactgccacttcgcccccgaggtgggcggcagacacgccgccgccgccgccgccctgcagctgtacggcaacagcgccgccggcttcccccacgcccccccccaggcccacgcccacccccaccccagccccccccccagcggcaccggctgcggcggcagagagggcagaggccaggagtacttccaccccggcggcggcagccccgccgccgcctaccaggccgccccccccccccccccccacccccccccccccccccccccccccccctgcggcggcatcgcctgccacggcgagcccgccaagttctacggctacgacaacctgcagagacagcccatcttcaccacccagcaggaggccgagctggtgcagtaccccgactgcaagagcagcagcggcaacatcggcgaggaccccgaccacctgaaccagagcagcagccccagccagatgttcccctggatgagaccccaggcccccggcagaagaagaggcagacagacctacagcagattccagaccctggagctggagaaggagttcctgttcaacccctacctgaccagaaagagaagaatcgaggtgagccacgccctggccctgaccgagagacaggtgaagatctggttccagaacagaagaatgaagtggaagaaggagaacaacaaggacaagttccccgtgagcagacaggaggtgaaggacggcgagaccaagaaggaggcccaggagctggaggaggacagagccgagggcctgaccaactag

SEQ ID NO: 84739 - DNA, 870 bp, Artificial Sequence; identical to SEQ ID NO: 84738
  Description of Artificial Sequence: Synthetic coding sequence

SEQ ID NO: 84740 - DNA, 321 bp, Artificial Sequence
  Description of Artificial Sequence: Synthetic coding sequence
atgttcccctggatgagaccccaggccgcccccggcagaagaagaggcagacagacctacagcagattccagaccctggagctggagaaggagttcctgttcaacccctacctgaccagaaagagaagaatcgaggtgagccacgccctggccctgaccgagagacaggtgaagatctggttccagaacagaagaatgaagtggaagaaggagaacaacaaggacaagttccccgtgagcagacaggaggtgaaggacggcgagaccaagaaggaggcccaggagctggaggaggacagagccgagggcctgaccaactag

SEQ ID NO: 84741 - DNA, 1059 bp, Artificial Sequence
  Description of Artificial Sequence: Synthetic coding sequence
atgctgggcggcagcgccggcagactgaagatgagcagcagcggcaccctgagcaactactacgtggacagcctgatcggccacgagggcgacgaggtgttcgccgccagattcggcccccccggccccggcgcccagggcagacccgccggcgtggccgacggccccgccgccaccgccgccgagttcgccagctgcagcttcgcccccagaagcgccgtgttcagcgccagctggagcgccgtgcccagccagccccccgccgccgccgccatgagcggcctgtaccacccctacgtgccccccccccccctggccgccagcgccagcgagcccggcagatacgtgagaagctggatggagcccctgcccggcttccccggcggcgccggcggcggcggcggcggcggcggcggcggccccggcagaggccccagccccggccccagcggccccgccaacggcagacactacggcatcaagcccgagaccagagccgcccccgcccccgccaccgccgccagcaccaccagcagcagcagcaccagcctgagcagcagcagcaagagaaccgagtgcagcgtggccagagagagccagggcagcagcggccccgagttcagctgcaacagcttcctgcaggagaaggccgccgccgccaccggcggcaccggccccggcgccggcatcggcgccgccaccggcaccggcggcagcagcgagcccagcgcctgcagcgaccaccccatccccggctgcagcctgaaggaggaggagaagcagcacagccagccccagcagcagcagctggaccccaacaaccccgccgccaactggatccacgccagaagcaccagaaagaagagatgcccctacaccaagtaccagaccctggagctggagaaggagttcctgttcaacatgtacctgaccagagacagaagatacgaggtggccagaatcctgaacctgaccgagagacaggtgaagatctggttccagaacagaagaatgaagatgaagaagatgagcaaggagaagtgccccaagggcgactag

SEQ ID NO: 84742 - DNA, 2757 bp, Artificial Sequence
  Description of Artificial Sequence: Synthetic coding sequence
ctgcagcccgtgtacgagagcatggccagccacgtgcaggtgttcagcccccacaccctgcagagcagcgccttctgcagcgtgaagaagctgaagatcgagcccagcagcaactgggacatgaccggctacggcagccacagcaaggtgtacagccagagcaagaacatccccctgagccagcccgccaccaccaccgtgagcaccagcctgcccgtgcccaaccccagcctgccctacgagcagaccatcgtgttccccggcagcaccggccacatcgtggtgaccagcgccagcagcaccagcgtgaccggccaggtgctgggcggcccccacaacctgatgagaagaagcaccgtgagcctgctggacacctaccagaagtgcggcctgaagagaaagagcgaggagatcgagaacaccagcagcgtgcagatcatcgaggagcacccccccatgatccagaacaacgccagcggcgccaccgtggccaccgccaccaccagcaccgccaccagcaagaacagcggcagcaacagcgagggcgactaccagctggtgcagcacgaggtgctgtgcagcatgaccaacacctacgaggtgctggagttcctgggcagaggcaccttcggccaggtggtgaagtgctggaagagaggcaccaacgagatcgtggccatcaagatcctgaagaaccaccccagctacgccagacagggccagatcgaggtgagcatcctggccagactgagcaccgagagcgccgacgactacaacttcgtgagagcctacgagtgcttccagcacaagaaccacacctgcctggtgttcgagatgctggagcagaacctgtacgacttcctgaagcagaacaagttcagccccctgcccctgaagtacatcagacccgtgctgcagcaggtggccaccgccctgatgaagctgaagagcctgggcctgatccacgccgacctgaagcccgagaacatcatgctggtggaccccagcagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagacaccgacagcccctaccccctgtggagactgaagacccccgacgaccacgaggccgagaccggcatcaagagcaaggaggccagaaagtacatcttcaactgcctggacgacatggcccaggtgaacatgaccaccgacctggagggcagcgacatgctggtggagaaggccgacagaagagagttcatcgacctgctgaagaagatgctgaccatcgacgccgacaagagaatcacccccatcgagaccctgaaccaccccttcgtgaccatgacccacctgctggacttcccccacagcacccacgtgaagagctgcttccagaacatggagatctgcaagagaagagtgaacatgtacgacaccgtgaaccagagcaagacccccttcatcacccacgtggcccccagcaccagcaccaacctgaccatgaccttcaacaaccagctgaccaccgtgcacaaccaggcccccagcagcaccagcgccaccatcagcctggccaaccccgaggtgagcatcctgaactaccccagcaccctgtaccagcccagcgccgccagcatggccgccgtggcccagagaagcatgcccctgcagaccggcaccgcccagatctgcgccagacccgaccccttccagcaggccctgatcgtgtgcccccccggcttccagggcctgcaggccagccccagcaagcacgccggctacagcgtgagaatggagaacgccgtgcccatcgtgacccaggcccccggcgcccagcccctgcagatccagcccggcctgctggcccagcaggcctggcccagcggcacccagcagatcctgctgccccccgcctggcagcagctgaccggcgtggccacccacaccagcgtgcagcacgccaccgtgatccccgagaccatggccggcacccagcagctggccgactggagaaacacccacgcccacggcagccactacaaccccatcatgcagcagcccgccctgctgaccggccacgtgaccctgcccgccgcccagcccctgaacgtgggcgtggcccacgtgatgagacagcagcccaccagcaccaccagcagcagaaagagcaagcagcaccagagcagccagagaaagaacgtgatcagctgcgtgaccgtgcacgacagcccctacagcgacagcagcagcaacaccagcccctacagcgtgcagcagagagccggccacaacaacgccaacgccttcgacaccaagggcagcctggagaaccactgcaccggcaaccccagaaccatcatcgtgccccccctgaagacccaggccagcgaggtgctggtggagtgcgacagcctggtgcccggcaacctgggccccggccagggcagaaacctgagcctggagagcggcttccccgccttcctgctgctggagatgctgctgtacggcagctag

SEQ ID NO: 84743 - DNA, 3597 bp, Artificial Sequence
  Description of Artificial Sequence: Synthetic coding sequence
atggcccccgtgtacgagggcatggccagccacgtgcaggtgttcagcccccacaccctgcagagcagcgccttctgcagcgtgaagaagctgaagatcgagcccagcagcaactgggacatgaccggctacggcagccacagcaaggtgtacagccagagcaagaacatccccctgagccagcccgccaccaccaccgtgagcaccagcctgcccgtgcccaaccccagcctgccctacgagcagaccatcgtgttccccggcagcaccggccacatcgtggtgaccagcgccagcagcaccagcgtgaccggccaggtgctgggcggcccccacaacctgatgagaagaagcaccgtgagcctgctggacacctaccagaagtgcggcctgaagagaaagagcgaggagatcgagaacaccagcagcgtgcagatcatcgaggagcacccccccatgatccagaacaacgccagcggcgccaccgtggccaccgccaccaccagcaccgccaccagcaagaacagcggcagcaacagcgagggcgactaccagctggtgcagcacgaggtgctgtgcagcatgaccaacacctacgaggtgctggagttcctgggcagaggcaccttcggccaggtggtgaagtgctggaagagaggcaccaacgagatcgtggccatcaagatcctgaagaaccaccccagctacgccagacagggccagatcgaggtgagcatcctggccagactgagcaccgagagcgccgacgactacaacttcgtgagagcctacgagtgcttccagcacaagaaccacacctgcctggtgttcgagatgctggagcagaacctgtacgacttcctgaagcagaacaagttcagccccctgcccctgaagtacatcagacccgtgctgcagcaggtggccaccgccctgatgaagctgaagagcctgggcctgatccacgccgacctgaagcccgagaacatcatgctggtggaccccagcagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagacaccgacagcccctaccccctgtggagactgaagacccccgacgaccacgaggccgagaccggcatcaagagcaaggaggccagaaagtacatcttcaactgcctggacgacatggcccaggtgaacatgaccaccgacctggagggcagcgacatgctggtggagaaggccgacagaagagagttcatcgacctgctgaagaagatgctgaccatcgacgccgacaagagaatcacccccatcgagaccctgaaccaccccttcgtgaccatgacccacctgctggacttcccccacagcacccacgtgaagagctgcttccagaacatggagatctgcaagagaagagtgaacatgtacgacaccgtgaaccagagcaagacccccttcatcacccacgtggcccccagcaccagcaccaacctgaccatgaccttcaacaaccagctgaccaccgtgcacaaccaggcccccagcagcaccagcgccaccatcagcctggccaaccccgaggtgagcatcctgaactaccccagcaccctgtaccagcccagcgccgccagcatggccgccgtggcccagagaagcatgcccctgcagaccggcaccgcccagatctgcgccagacccgaccccttccagcaggccctgatcgtgtgcccccccggcttccagggcctgcaggccagccccagcaagcacgccggctacagcgtgagaatggagaacgccgtgcccatcgtgacccaggcccccggcgcccagcccctgcagatccagcccggcctgctggcccagcaggcctggcccagcggcacccagcagatcctgctgccccccgcctggcagcagctgaccggcgtggccacccacaccagcgtgcagcacgccaccgtgatccccgagaccatggccggcacccagcagctggccgactggagaaacacccacgcccacggcagccactacaaccccatcatgcagcagcccgccctgctgaccggccacgtgaccctgcccgccgcccagcccctgaacgtgggcgtggcccacgtgatgagacagcagcccaccagcaccaccagcagcagaaagagcaagcagcaccagagcagcgtgagaaacgtgagcacctgcgaggtgagcagcagccaggccatcagcagcccccagagaagcaagagagtgaaggagaacaccccccccagatgcgccatggtgcacagcagccccgcctgcagcaccagcgtgacctgcggctggggcgacgtggccagcagcaccaccagagagagacagagacagaccatcgtgatccccgacacccccagccccaccgtgagcgtgatcaccatcagcagcgacaccgacgaggaggaggagcagaagcacgcccccaccagcaccgtgagcaagcagagaaagaacgtgatcagctgcgtgaccgtgcacgacagcccctacagcgacagcagcagcaacaccagcccctacagcgtgcagcagagagccggccacaacaacgccaacgccttcgacaccaagggcagcctggagaaccactgcaccggcaaccccagaaccatcatcgtgccccccctgaagacccaggccagcgaggtgctggtggagtgcgacagcctggtgcccgtgaacaccagccaccacagcagcagctacaagagcaagagcagcagcaacgtgaccagcaccagcggccacagcagcggcagcagcagcggcgccatcacctacagacagcagagacccggcccccacttccagcagcagcagcccctgaacctgagccaggcccagcagcacatcaccaccgacagaaccggcagccacagaagacagcaggcctacatcacccccaccatggcccaggccccctacagcttcccccacaacagccccagccacggcaccgtgcacccccacctggccgccgccgccgccgccgcccacctgcccacccagccccacctgtacacctacaccgcccccgccgccctgggcagcaccggcaccgtggcccacctggtggccagccagggcagcgccagacacaccgtgcagcacaccgcctaccccgccagcatcgtgcaccaggtgcccgtgagcatgggccccagagtgctgcccagccccaccatccaccccagccagtaccccgcccagttcgcccaccagacctacatcagcgccagccccgccagcaccgtgtacaccggctaccccctgagccccgccaaggtgaaccagtacccctacatctag

SEQ ID NO: 84744 - DNA, 3516 bp, Artificial Sequence
  Description of Artificial Sequence: Synthetic coding sequence
atggcccccgtgtacgagggcatggccagccacgtgcaggtgttcagcccccacaccctgcagagcagcgccttctgcagcgtgaagaagctgaagatcgagcccagcagcaactgggacatgaccggctacggcagccacagcaaggtgtacagccagagcaagaacatccccctgagccagcccgccaccaccaccgtgagcaccagcctgcccgtgcccaaccccagcctgccctacgagcagaccatcgtgttccccggcagcaccggccacatcgtggtgaccagcgccagcagcaccagcgtgaccggccaggtgctgggcggcccccacaacctgatgagaagaagcaccgtgagcctgctggacacctaccagaagtgcggcctgaagagaaagagcgaggagatcgagaacaccagcagcgtgcagatcatcgaggagcacccccccatgatccagaacaacgccagcggcgccaccgtggccaccgccaccaccagcaccgccaccagcaagaacagcggcagcaacagcgagggcgactaccagctggtgcagcacgaggtgctgtgcagcatgaccaacacctacgaggtgctggagttcctgggcagaggcaccttcggccaggtggtgaagtgctggaagagaggcaccaacgagatcgtggccatcaagatcctgaagaaccaccccagctacgccagacagggccagatcgaggtgagcatcctggccagactgagcaccgagagcgccgacgactacaacttcgtgagagcctacgagtgcttccagcacaagaaccacacctgcctggtgttcgagatgctggagcagaacctgtacgacttcctgaagcagaacaagttcagccccctgcccctgaagtacatcagacccgtgctgcagcaggtggccaccgccctgatgaagctgaagagcctgggcctgatccacgccgacctgaagcccgagaacatcatgctggtggaccccagcagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagacaccgacagcccctaccccctgtggagactgaagacccccgacgaccacgaggccgagaccggcatcaagagcaaggaggccagaaagtacatcttcaactgcctggacgacatggcccaggtgaacatgaccaccgacctggagggcagcgacatgctggtggagaaggccgacagaagagagttcatcgacctgctgaagaagatgctgaccatcgacgccgacaagagaatcacccccatcgagaccctgaaccaccccttcgtgaccatgacccacctgctggacttcccccacagcacccacgtgaagagctgcttccagaacatggagatctgcaagagaagagtgaacatgtacgacaccgtgaaccagagcaagacccccttcatcacccacgtggcccccagcaccagcaccaacctgaccatgaccttcaacaaccagctgaccaccgtgcacaaccagcccagcgccgccagcatggccgccgtggcccagagaagcatgcccctgcagaccggcaccgcccagatctgcgccagacccgaccccttccagcaggccctgatcgtgtgcccccccggcttccagggcctgcaggccagccccagcaagcacgccggctacagcgtgagaatggagaacgccgtgcccatcgtgacccaggcccccggcgcccagcccctgcagatccagcccggcctgctggcccagcaggcctggcccagcggcacccagcagatcctgctgccccccgcctggcagcagctgaccggcgtggccacccacaccagcgtgcagcacgccaccgtgatccccgagaccatggccggcacccagcagctggccgactggagaaacacccacgcccacggcagccactacaaccccatcatgcagcagcccgccctgctgaccggccacgtgaccctgcccgccgcccagcccctgaacgtgggcgtggcccacgtgatgagacagcagcccaccagcaccaccagcagcagaaagagcaagcagcaccagagcagcgtgagaaacgtgagcacctgcgaggtgagcagcagccaggccatcagcagcccccagagaagcaagagagtgaaggagaacaccccccccagatgcgccatggtgcacagcagccccgcctgcagcaccagcgtgacctgcggctggggcgacgtggccagcagcaccaccagagagagacagagacagaccatcgtgatccccgacacccccagccccaccgtgagcgtgatcaccatcagcagcgacaccgacgaggaggaggagcagaagcacgcccccaccagcaccgtgagcaagcagagaaagaacgtgatcagctgcgtgaccgtgcacgacagcccctacagcgacagcagcagcaacaccagcccctacagcgtgcagcagagagccggccacaacaacgccaacgccttcgacaccaagggcagcctggagaaccactgcaccggcaaccccagaaccatcatcgtgccccccctgaagacccaggccagcgaggtgctggtggagtgcgacagcctggtgcccgtgaacaccagccaccacagcagcagctacaagagcaagagcagcagcaacgtgaccagcaccagcggccacagcagcggcagcagcagcggcgccatcacctacagacagcagagacccggcccccacttccagcagcagcagcccctgaacctgagccaggcccagcagcacatcaccaccgacagaaccggcagccacagaagacagcaggcctacatcacccccaccatggcccaggccccctacagcttcccccacaacagccccagccacggcaccgtgcacccccacctggccgccgccgccgccgccgcccacctgcccacccagccccacctgtacacctacaccgcccccgccgccctgggcagcaccggcaccgtggcccacctggtggccagccagggcagcgccagacacaccgtgcagcacaccgcctaccccgccagcatcgtgcaccaggtgcccgtgagcatgggccccagagtgctgcccagccccaccatccaccccagccagtaccccgcccagttcgcccaccagacctacatcagcgccagccccgccagcaccgtgtacaccggctaccccctgagccccgccaaggtgaaccagtacccctacatctag

SEQ ID NO: 84745 - DNA, 3648 bp, Artificial Sequence
  Description of Artificial Sequence: Synthetic coding sequence
atggccagccaggtgctggtgtaccccccctacgtgtaccagacccagagcagcgccttctgcagcgtgaagaagctgaaggtggagcccagcagctgcgtgttccaggagagaaactaccccagaacctacgtgaacggcagaaacttcggcaacagccacccccccaccaagggcagcgccttccagaccaagatccccttcaacagacccagaggccacaacttcagcctgcagaccagcgccgtggtgctgaagaacaccgccggcgccaccaaggtgatcgccgcccaggcccagcaggcccacgtgcaggccccccagatcggcgcctggagaaacagactgcacttcctggagggcccccagagatgcggcctgaagagaaagagcgaggagctggacaaccacagcagcgccatgcagatcgtggacgagctgagcatcctgcccgccatgctgcagaccaacatgggcaaccccgtgaccgtggtgaccgccaccaccggcagcaagcagaactgcaccaccggcgagggcgactaccagctggtgcagcacgaggtgctgtgcagcatgaagaacacctacgaggtgctggacttcctgggcagaggcaccttcggccaggtggtgaagtgctggaagagaggcaccaacgagatcgtggccatcaagatcctgaagaaccaccccagctacgccagacagggccagatcgaggtgagcatcctggccagactgagcaccgagaacgccgacgagtacaacttcgtgagagcctacgagtgcttccagcacagaaaccacacctgcctggtgttcgagatgctggagcagaacctgtacgacttcctgaagcagaacaagttcagccccctgcccctgaaggtgatcagacccatcctgcagcaggtggccaccgccctgaagaagctgaagagcctgggcctgatccacgccgacctgaagcccgagaacatcatgctggtggaccccgtgagacagccctacagagtgaaggtgatcgacttcggcagcgccagccacgtgagcaagaccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccctggagtacgaccagatcagatacatcagccagacccagggcctgcccggcgagcagctgctgaacgtgggcaccaagagcaccagattcttctgcaaggagaccgacatgagccacagcggctggagactgaagaccctggaggagcacgaggccgagaccggcatgaagagcaaggaggccagaaagtacatcttcaacagcctggacgacgtggcccacgtgaacaccgtgatggacctggagggcagcgacctgctggccgagaaggccgacagaagagagttcgtgagcctgctgaagaagatgctgctgatcgacgccgacctgagaatcacccccgccgagaccctgaaccaccccttcgtgaacatgaagcacctgctggacttcccccacagcaaccacgtgaagagctgcttccacatcatggacatctgcaagagccacctgaacagctgcgacaccaacaaccacaacaagaccagcctgctgagacccgtggccagcagcagcaccgccaccctgaccgccaacttcaccaagatcggcaccctgagaagccaggccctgaccaccagcgcccacagcgtggtgcaccacggcatccccctgcaggccggcaccgcccagttcggctgcggcgacgccttccagcagaccctgatcatctgcccccccgccatccagggcatccccgccacccacggcaagcccaccagctacagcatcagagtggacaacaccgtgcccctggtgacccaggcccccgccgtgcagcccctgcagatcagacccggcgtgctgagccagacctggagcggcagaacccagcagatgctggtgcccgcctggcagcaggtgacccccctggcccccgccaccaccaccctgaccagcgagagcgtggccggcagccacagactgggcgactggggcaagatgatcagctgcagcaaccactacaacagcgtgatgccccagcccctgctgaccaaccagatcaccctgagcgccccccagcccgtgagcgtgggcatcgcccacgtggtgtggccccagcccgccaccaccaagaagaacaagcagtgccagaacagaggcatcctggtgaagctgatggagtgggagcccggcagagaggagatcaacgccttcagctggagcaacagcctgcagaacaccaacatcccccacagcgccttcatcagccccaagatcatcaacggcaaggacgtggaggaggtgagctgcatcgagacccaggacaaccagaacagcgagggcgaggccagaaactgctgcgagaccagcatcagacaggacagcgacagcagcgtgagcgacaagcagagacagaccatcatcatcgccgacagccccagccccgccgtgagcgtgatcaccatcagcagcgacaccgacgaggaggagaccagccagagacacagcctgagagagtgcaagggcagcctggactgcgaggcctgccagagcaccctgaacatcgacagaatgtgcagcctgagcagccccgacagcaccctgagcaccagcagcagcggccagagcagccccagcccctgcaagagacccaacagcatgagcgacgaggagcaggagagcagctgcgacaccgtggacggcagccccaccagcgacagcagcggccacgacagccccttcgccgagagcaccttcgtggaggacacccacgagaacaccgagctggtgagcagcgccgacaccgagaccaagcccgccgtgtgcagcgtggtggtgccccccgtggagctggagaacggcctgaacgccgacgagcacatggccaacaccgacagcatctgccagcccctgatcaagggcagaagcgcccccggcagactgaaccagcccagcgccgtgggcaccagacagcagaagctgaccagcgccttccagcagcagcacctgaacttcagccaggtgcagcacttcggcagcggccaccaggagtggaacggcaacttcggccacagaagacagcaggcctacatccccaccagcgtgaccagcaaccccttcaccctgagccacggcagccccaaccacaccgccgtgcacgcccacctggccggcaacacccacctgggcggccagcccaccctgctgccctaccccagcagcgccaccctgagcagcgccgcccccgtggcccacctgctggccagcccctgcaccagcagacccatgctgcagcaccccacctacaacatcagccaccccagcggcatcgtgcaccaggtgcccgtgggcctgaaccccagactgctgcccagccccaccatccaccagacccagtacaagcccatcttccccccccacagctacatcgccgccagccccgcctacaccggcttccccctgagccccaccaagctgagccagtacccctacatgtag

SEQ ID NO: 84746 - DNA, 3585 bp, Artificial Sequence
  Description of Artificial Sequence: Synthetic coding sequence
atggccagccaggtgctggtgtaccccccctacgtgtaccagacccagagcagcgccttctgcagcgtgaagaagctgaaggtggagcccagcagctgcgtgttccaggagagaaactaccccagaacctacgtgaacggcagaaacttcggcaacagccacccccccaccaagggcagcgccttccagaccaagatccccttcaacagacccagaggccacaacttcagcctgcagaccagcgccgtggtgctgaagaacaccgccggcgccaccaaggtgatcgccgcccaggcccagcaggcccacgtgcaggccccccagatcggcgcctggagaaacagactgcacttcctggagggcccccagagatgcggcctgaagagaaagagcgaggagctggacaaccacagcagcgccatgcagatcgtggacgagctgagcatcctgcccgccatgctgcagaccaacatgggcaaccccgtgaccgtggtgaccgccaccaccggcagcaagcagaactgcaccaccggcgagggcgactaccagctggtgcagcacgaggtgctgtgcagcatgaagaacacctacgaggtgctggacttcctgggcagaggcaccttcggccaggtggtgaagtgctggaagagaggcaccaacgagatcgtggccatcaagatcctgaagaaccaccccagctacgccagacagggccagatcgaggtgagcatcctggccagactgagcaccgagaacgccgacgagtacaacttcgtgagagcctacgagtgcttccagcacagaaaccacacctgcctggtgttcgagatgctggagcagaacctgtacgacttcctgaagcagaacaagttcagccccctgcccctgaaggtgatcagacccatcctgcagcaggtggccaccgccctgaagaagctgaagagcctgggcctgatccacgccgacctgaagcccgagaacatcatgctggtggaccccgtgagacagccctacagagtgaaggtgatcgacttcggcagcgccagccacgtgagcaagaccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccctggagtacgaccagatcagatacatcagccagacccagggcctgcccggcgagcagctgctgaacgtgggcaccaagagcaccagattcttctgcaaggagaccgacatgagccacagcggctggagactgaagaccctggaggagcacgaggccgagaccggcatgaagagcaaggaggccagaaagtacatcttcaacagcctggacgacgtggcccacgtgaacaccgtgatggacctggagggcagcgacctgctggccgagaaggccgacagaagagagttcgtgagcctgctgaagaagatgctgctgatcgacgccgacctgagaatcacccccgccgagaccctgaaccaccccttcgtgaacatgaagcacctgctggacttcccccacagcaaccacgtgaagagctgcttccacatcatggacatctgcaagagccacctgaacagctgcgacaccaacaaccacaacaagaccagcctgctgagacccgtggccagcagcagcaccgccaccctgaccgccaacttcaccaagatcggcaccctgagaagccaggccctgaccaccagcgcccacagcgtggtgcaccacggcatccccctgcaggccggcaccgcccagttcggctgcggcgacgccttccagcagaccctgatcatctgcccccccgccatccagggcatccccgccacccacggcaagcccaccagctacagcatcagagtggacaacaccgtgcccctggtgacccaggcccccgccgtgcagcccctgcagatcagacccggcgtgctgagccagacctggagcggcagaacccagcagatgctggtgcccgcctggcagcaggtgacccccctggcccccgccaccaccaccctgaccagcgagagcgtggccggcagccacagactgggcgactggggcaagatgatcagctgcagcaaccactacaacagcgtgatgccccagcccctgctgaccaaccagatcaccctgagcgccccccagcccgtgagcgtgggcatcgcccacgtggtgtggccccagcccgccaccaccaagaagaacaagcagtgccagaacagaagcaacagcctgcagaacaccaacatcccccacagcgccttcatcagccccaagatcatcaacggcaaggacgtggaggaggtgagctgcatcgagacccaggacaaccagaacagcgagggcgaggccagaaactgctgcgagaccagcatcagacaggacagcgacagcagcgtgagcgacaagcagagacagaccatcatcatcgccgacagccccagccccgccgtgagcgtgatcaccatcagcagcgacaccgacgaggaggagaccagccagagacacagcctgagagagtgcaagggcagcctggactgcgaggcctgccagagcaccctgaacatcgacagaatgtgcagcctgagcagccccgacagcaccctgagcaccagcagcagcggccagagcagccccagcccctgcaagagacccaacagcatgagcgacgaggagcaggagagcagctgcgacaccgtggacggcagccccaccagcgacagcagcggccacgacagccccttcgccgagagcaccttcgtggaggacacccacgagaacaccgagctggtgagcagcgccgacaccgagaccaagcccgccgtgtgcagcgtggtggtgccccccgtggagctggagaacggcctgaacgccgacgagcacatggccaacaccgacagcatctgccagcccctgatcaagggcagaagcgcccccggcagactgaaccagcccagcgccgtgggcaccagacagcagaagctgaccagcgccttccagcagcagcacctgaacttcagccaggtgcagcacttcggcagcggccaccaggagtggaacggcaacttcggccacagaagacagcaggcctacatccccaccagcgtgaccagcaaccccttcaccctgagccacggcagccccaaccacaccgccgtgcacgcccacctggccggcaacacccacctgggcggccagcccaccctgctgccctaccccagcagcgccaccctgagcagcgccgcccccgtggcccacctgctggccagcccctgcaccagcagacccatgctgcagcaccccacctacaacatcagccaccccagcggcatcgtgcaccaggtgcccgtgggcctgaaccccagactgctgcccagccccaccatccaccagacccagtacaagcccatcttccccccccacagctacatcgccgccagccccgcctacaccggcttccccctgagccccaccaagctgagccagtacccctacatgtag

SEQ ID NO: 84747 - DNA, 3585 bp, Artificial Sequence; identical to SEQ ID NO: 84746
  Description of Artificial Sequence: Synthetic coding sequence

SEQ ID NO: 84748 - DNA, 3585 bp, Artificial Sequence; identical to SEQ ID NO: 84746
  Description of Artificial Sequence: Synthetic coding sequence

SEQ ID NO: 84749 - DNA, 231 bp, Artificial Sequence
  Description of Artificial Sequence: Synthetic coding sequence
atggccagccaggtgctggtgtaccccccctacgtgtaccagacccagagcagcgccttctgcagcgtgaagaagctgaaggtggagcccagcagctgcgtgttccaggagagaaactaccccagaacctacgtgaacggcagaaacttcggcaacagccacccccccaccaagggcagcgccttccagaccaagatccccttcaacagacccagaggccacaacttctag

SEQ ID NO: 84750 - DNA, 1851 bp, Artificial Sequence
  Description of Artificial Sequence: Synthetic coding sequence
atgagcaccatccagagcgagaccgactgctacgacatcatcgaggtgctgggcaagggcaccttcggcgaggtggccaagggctggagaagaagcaccggcgagatggtggccatcaagatcctgaagaacgacgcctacagaaacagaatcatcaagaacgagctgaagctgctgcactgcatgagaggcctggaccccgaggaggcccacgtgatcagattcctggagttcttccacgacgccctgaagttctacctggtgttcgagctgctggagcagaacctgttcgagttccagaaggagaacaacttcgcccccctgcccgccagacacatcagaaccgtgaccctgcaggtgctgaccgccctggccagactgaaggagctggccatcatccacgccgacctgaagcccgagaacatcatgctggtggaccagaccagatgccccttcagagtgaaggtgatcgacttcggcagcgccagcatcttcagcgaggtgagatacgtgaaggagccctacatccagagcagattctacagagcccccgagatcctgctgggcctgcccttctgcgagaaggtggacgtgtggagcctgggctgcgtgatggccgagctgcacctgggctggcccctgtaccccggcaacaacgagtacgaccaggtgagatacatctgcgagacccagggcctgcccaagccccacctgctgcacgccgcctgcaaggcccaccacttcttcaagagaaacccccaccccgacgccgccaacccctggcagctgaagagcagcgccgactacctggccgagaccaaggtgagacccctggagagaagaaagtacatgctgaagagcctggaccagatcgagaccgtgaacggcggcagcgtggccagcagactgaccttccccgacagagaggccctggccgagcacgccgacctgaagagcatggtggagctgatcaagagaatgctgacctgggagagccacgagagaatcagccccagcgccgccctgagacaccccttcgtgagcatgcagcagctgagaagcgcccacgagaccacccactactaccagctgagcctgagaagctacagactgagcctgcaggtggagggcaagccccccacccccgtggtggccgccgaggacggcaccccctactactgcctggccgaggagaaggaggccgccggcatgggcagcgtggccggcagcagccccttcttcagagaggagaaggcccccggcatgcagagagccatcgaccagctggacgacctgagcctgcaggaggccggccacggcctgtggggcgagacctgcaccaacgccgtgagcgacatgatggtgcccctgaaggccgccatcaccggccaccacgtgcccgacagcggccccgagcccatcctggccttctacagcagcagactggccggcagacacaaggccagaaagccccccgccggcagcaagagcgacagcaacttcagcaacctgatcagactgagccaggtgagccccgaggacgacagaccctgcagaggcagcagctgggaggagggcgagcacctgggcgccagcgccgagcccctggccatcctgcagagagacgaggacggccccaacatcgacaacatgaccatggaggccgagagacccgaccccgagctgttcgaccccagcagctgccccggcgagtggctgagcgagcccgactgcaccctggagagcgtgagaggccccagagcccagggcctgccccccagaagaagccaccagcacggcccccccagaggcgccaccagcttcctgcagcacgtgaccggccaccactag

SEQ ID NO: 84751 - DNA, 1746 bp, Artificial Sequence
  Description of Artificial Sequence: Synthetic coding sequence
atggtggccatcaagatcctgaagaacgacgcctacagaaacagaatcatcaagaacgagctgaagctgctgcactgcatgagaggcctggaccccgaggaggcccacgtgatcagattcctggagttcttccacgacgccctgaagttctacctggtgttcgagctgctggagcagaacctgttcgagttccagaaggagaacaacttcgcccccctgcccgccagacacatcagaaccgtgaccctgcaggtgctgaccgccctggccagactgaaggagctggccatcatccacgccgacctgaagcccgagaacatcatgctggtggaccagaccagatgccccttcagagtgaaggtgatcgacttcggcagcgccagcatcttcagcgaggtgagatacgtgaaggagccctacatccagagcagattctacagagcccccgagatcctgctgggcctgcccttctgcgagaaggtggacgtgtggagcctgggctgcgtgatggccgagctgcacctgggctggcccctgtaccccggcaacaacgagtacgaccaggtgagatacatctgcgagacccagggcctgcccaagccccacctgctgcacgccgcctgcaaggcccaccacttcttcaagagaaacccccaccccgacgccgccaacccctggcagctgaagagcagcgccgactacctggccgagaccaaggtgagacccctggagagaagaaagtacatgctgaagagcctggaccagatcgagaccgtgaacggcggcagcgtggccagcagactgaccttccccgacagagaggccctggccgagcacgccgacctgaagagcatggtggagctgatcaagagaatgctgacctgggagagccacgagagaatcagccccagcgccgccctgagacaccccttcgtgagcatgcagcagctgagaagcgcccacgagaccacccactactaccagctgagcctgagaagctacagactgagcctgcaggtggagggcaagccccccacccccgtggtggccgccgaggacggcaccccctactactgcctggccgaggagaaggaggccgccggcatgggcagcgtggccggcagcagccccttcttcagagaggagaaggcccccggcatgcagagagccatcgaccagctggacgacctgagcctgcaggaggccggccacggcctgtggggcgagacctgcaccaacgccgtgagcgacatgatggtgcccctgaaggccgccatcaccggccaccacgtgcccgacagcggccccgagcccatcctggccttctacagcagcagactggccggcagacacaaggccagaaagccccccgccggcagcaagagcgacagcaacttcagcaacctgatcagactgagccaggtgagccccgaggacgacagaccctgcagaggcagcagctgggaggagggcgagcacctgggcgccagcgccgagcccctggccatcctgcagagagacgaggacggccccaacatcgacaacatgaccatggaggccgagagacccgaccccgagctgttcgaccccagcagctgccccggcgagtggctgagcgagcccgactgcaccctggagagcgtgagaggccccagagcccagggcctgccccccagaagaagccaccagcacggcccccccagaggcgccaccagcttcctgcagcacgtgaccggccaccactag

SEQ ID NO: 84752 - DNA, 675 bp, Artificial Sequence
  Description of Artificial Sequence: Synthetic coding sequence
atgggcgagcagcccatcttcagcaccagagcccacgtgttccagatcgaccccaacaccaagaagaactgggtgcccaccagcaagcacgccgtgaccgtgagctacttctacgacagcaccagaaacgtgtacagaatcatcagcctggacggcagcaaggccatcatcaacagcaccatcacccccaacatgaccttcaccaagaccagccagaagttcggccagtgggccgacagcagagccaacaccgtgtacggcctgggcttcagcagcgagcaccacctgagcaaggtgaccgagctggagtgcgtgagcagccaggccaacgccgtgcacacccacaagaccgagctgaaccagaccatccaggagctggaggagaccctgaagctgaaggaggaggagatcgagagactgaagcaggagatcgacaacgccagagagctgcaggagcagagagacagcctgacccagaagctgcaggaggtggagatcagaaacaaggacctggagggccagctgagcgacctggagcagagactggagaagagccagaacgagcaggaggccttcagaaacaacctgaagaccctgctggagatcctggacggcaagatcttcgagctgaccgagctgagagacaacctggccaagctgctggagtgcagctag

SEQ ID NO: 84753 - DNA, 1065 bp, Artificial Sequence
  Description of Artificial Sequence: Synthetic coding sequence
atgggcgagcagcccatcttcagcaccagagcccacgtgttccagatcgaccccaacaccaagaagaactgggtgcccaccagcaagcacgccgtgaccgtgagctacttctacgacagcaccagaaacgtgtacagaatcatcagcctggacggcagcaaggccatcatcaacagcaccatcacccccaacatgaccttcaccaagaccagccagaagttcggccagtgggccgacagcagagccaacaccgtgtacggcctgggcttcagcagcgagcaccacctgagcaagttcgccgagaagttccaggagttcaaggaggccgccagactggccaaggagaagagccaggagaagatggagctgaccagcacccccagccaggagagcgccggcggcgacctgcagagccccctgacccccgagagcatcaacggcaccgacgacgagagaacccccgacgtgacccagaacagcgagcccagagccgagcccacccagaacgccctgcccttcagccacagcagcgccatcagcaagcactgggaggccgagctggccaccctgaagggcaacaacgccaagctgaccgccgccctgctggagagcaccgccaacgtgaagcagtggaagcagcagctggccgcctaccaggaggaggccgagagactgcacaagagagtgaccgagctggagtgcgtgagcagccaggccaacgccgtgcacacccacaagaccgagctgaaccagaccatccaggagctggaggagaccctgaagctgaaggaggaggagatcgagagactgaagcaggagatcgacaacgccagagagctgcaggagcagagagacagcctgacccagaagctgcaggaggtggagatcagaaacaaggacctggagggccagctgagcgacctggagcagagactggagaagagccagaacgagcaggaggccttcagaaacaacctgaagaccctgctggagatcctggacggcaagatcttcgagctgaccgagctgagagacaacctggccaagctgctggagtgcagctag

SEQ ID NO: 84754 - DNA, 534 bp, Artificial Sequence
  Description of Artificial Sequence: Synthetic coding sequence
atgggcgagcagcccatcttcagcaccagagcccacgtgttccagatcgaccccaacaccaagaagaactgggtgcccaccagcaagcacgccgtgaccgtgagctacttctacgacagcaccagaaacgtgtacagaatcatcagcctggacggcagcaaggccatcatcaacagcaccatcacccccaacatgaccttcaccaagaccagccagaagttcggccagtgggccgacagcagagccaacaccgtgtacggcctgggcttcagcagcgagcaccacctgagcaagttcgccgagaagttccaggagttcaaggaggccgccagactggccaaggagaagagccaggagaagatggagctgaccagcacccccagccaggagagcgccggcggcgacctgcagagccccctgacccccgagagcatcaacggcaccgacgacgagagaacccccgacgtgacccagaacagcgagcccagagccgagcccacccagaacgccctgcccttcagccacagaaagtag

SEQ ID NO: 84755 - DNA, 543 bp, Artificial Sequence
  Description of Artificial Sequence: Synthetic coding sequence
atgggcagcgccatcagcaagcactgggaggccgagctggccaccctgaagggcaacaacgccaagctgaccgccgccctgctggagagcaccgccaacgtgaagcagtggaagcagcagctggccgcctaccaggaggaggccgagagactgcacaagagagtgaccgagctggagtgcgtgagcagccaggccaacgccgtgcacacccacaagaccgagctgaaccagaccatccaggagctggaggagaccctgaagctgaaggaggaggagatcgagagactgaagcaggagatcgacaacgccagagagctgcaggagcagagagacagcctgacccagaagctgcaggaggtggagatcagaaacaaggacctggagggccagctgagcgacctggagcagagactggagaagagccagaacgagcaggaggccttcagaaacaacctgaagaccctgctggagatcctggacggcaagatcttcgagctgaccgagctgagagacaacctggccaagctgctggagtgcagctag

SEQ ID NO: 84756 - DNA, 1065 bp, Artificial Sequence
  Description of Artificial Sequence: Synthetic coding sequence
atgggcgagcagcccatcttcaccaccagagcccacgtgttccagatcgaccccaacaccaagaagaactggatgcccgccagcaagcaggccgtgaccgtgagctacttctacgacgtgaccagaaacagctacagaatcatcagcgtggacggcgccaaggtgatcatcaacagcaccatcacccccaacatgaccttcaccaagaccagccagaagttcggccagtgggccgacagcagagccaacaccgtgttcggcctgggcttcagcagcgagcagcagctgaccaagttcgccgagaagttccaggaggtgaaggaggccgccaagatcgccaaggacaagacccaggagaagatcgagaccagcagcaaccacagccaggagagcggcagagagacccccagcagcacccaggccagcagcgtgaacggcaccgacgacgagaaggccagccacgccggccccgccaacacccacctgaagagcgagaacgacaagctgaagatcgccctgacccagagcgccgccaacgtgaagaagtgggagatcgagctgcagaccctgagagagagcaacgccagactgaccaccgccctgcaggagagcgccgccagcgtggagcagtggaagagacagttcagcatctgcagagacgagaacgacagactgagaaacaagatcgacgagctggaggagcagtgcagcgagatcaacagagagaaggagaagaacacccagctgaagagaagaatcgaggagctggaggccgagctgagagagaaggagaccgagctgaaggacctgagaaagcagagcgagatcatcccccagctgatgagcgagtgcgagtacgtgagcgagaagctggaggccgccgagagagacaaccagaacctggaggacaaggtgagaagcctgaagaccgacatcgaggagagcaagtacagacagagacacctgaaggtggagctgaagagcttcctggaggtgctggacggcaagatcgacgacctgcacgacttcagaagaggcctgagcaagctgggcaccgacaactag

SEQ ID NO: 84757 - DNA, 867 bp, Artificial Sequence
  Description of Artificial Sequence: Synthetic coding sequence
atgggcgagcagcccatcttcaccaccagagcccacgtgttccagatcgaccccaacaccaagaagaactggatgcccgccagcaagcaggccgtgaccgtgagctacttctacgacgtgaccagaaacagctacagaatcatcagcgtggacggcgccaaggtgatcatcaacagcaccatcacccccaacatgaccttcaccaagaccagccagaagttcggccagtgggccgacagcagagccaacaccgtgttcggcctgggcttcagcagcgagcagcagctgaccaagttcgccgagaagttccaggaggtgaaggaggccgccaagatcgccaaggacaagacccaggagaagatcgagaccagcagcaaccacagccaggccagcagcgtgaacggcaccgacgacgagaaggccagccacgccggccccgccaacacccacctgaagagcgagaacgacaagctgaagatcgccctgacccagagcgccgccaacgtgaagaacgagatcaacagagagaaggagaagaacacccagctgaagagaagaatcgaggagctggaggccgagctgagagagaaggagaccgagctgaaggacctgagaaagcagagcgagatcatcccccagctgatgagcgagtgcgagtacgtgagcgagaagctggaggccgccgagagagacaaccagaacctggaggacaaggtgagaagcctgaagaccgacatcgaggagagcaagtacagacagagacacctgaaggtggagctgaagagcttcctggaggtgctggacggcaagatcgacgacctgcacgacttcagaagaggcctgagcaagctgggcaccgacaactag

SEQ ID NO: 84758 - DNA, 900 bp, Artificial Sequence
  Description of Artificial Sequence: Synthetic coding sequence
atgggcgagcagcccatcttcaccaccagagcccacgtgttccagatcgaccccaacaccaagaagaactggatgcccgccagcaagcaggccgtgaccgtgagctacttctacgacgtgaccagaaacagctacagaatcatcagcgtggacggcgccaaggtgatcatcaacagcaccatcacccccaacatgaccttcaccaagaccagccagaagttcggccagtgggccgacagcagagccaacaccgtgttcggcctgggcttcagcagcgagcagcagctgaccaagttcgccgagaagttccaggaggtgaaggaggccgccaagatcgccaaggacaagacccaggagaagatcgagaccagcagcaaccacagccaggagagcggcagagagacccccagcagcacccaggccagcagcgtgaacggcaccgacgacgagaaggccagccacgccggccccgccaacacccacctgaagagcgagaacgacaagctgaagatcgccctgacccagagcgccgccaacgtgaagaacgagatcaacagagagaaggagaagaacacccagctgaagagaagaatcgaggagctggaggccgagctgagagagaaggagaccgagctgaaggacctgagaaagcagagcgagatcatcccccagctgatgagcgagtgcgagtacgtgagcgagaagctggaggccgccgagagagacaaccagaacctggaggacaaggtgagaagcctgaagaccgacatcgaggagagcaagtacagacagagacacctgaaggtggagctgaagagcttcctggaggtgctggacggcaagatcgacgacctgcacgacttcagaagaggcctgagcaagctgggcaccgacaactag

SEQ ID NO: 84759 - DNA, 1032 bp, Artificial Sequence
  Description of Artificial Sequence: Synthetic coding sequence
atgggcgagcagcccatcttcaccaccagagcccacgtgttccagatcgaccccaacaccaagaagaactggatgcccgccagcaagcaggccgtgaccgtgagctacttctacgacgtgaccagaaacagctacagaatcatcagcgtggacggcgccaaggtgatcatcaacagcaccatcacccccaacatgaccttcaccaagaccagccagaagttcggccagtgggccgacagcagagccaacaccgtgttcggcctgggcttcagcagcgagcagcagctgaccaagttcgccgagaagttccaggaggtgaaggaggccgccaagatcgccaaggacaagacccaggagaagatcgagaccagcagcaaccacagccaggccagcagcgtgaacggcaccgacgacgagaaggccagccacgccggccccgccaacacccacctgaagagcgagaacgacaagctgaagatcgccctgacccagagcgccgccaacgtgaagaagtgggagatcgagctgcagaccctgagagagagcaacgccagactgaccaccgccctgcaggagagcgccgccagcgtggagcagtggaagagacagttcagcatctgcagagacgagaacgacagactgagaaacaagatcgacgagctggaggagcagtgcagcgagatcaacagagagaaggagaagaacacccagctgaagagaagaatcgaggagctggaggccgagctgagagagaaggagaccgagctgaaggacctgagaaagcagagcgagatcatcccccagctgatgagcgagtgcgagtacgtgagcgagaagctggaggccgccgagagagacaaccagaacctggaggacaaggtgagaagcctgaagaccgacatcgaggagagcaagtacagacagagacacctgaaggtggagctgaagagcttcctggaggtgctggacggcaagatcgacgacctgcacgacttcagaagaggcctgagcaagctgggcaccgacaactag

SEQ ID NO: 84760 - DNA, 15 bp, Artificial Sequence
  Description of Artificial Sequence: Synthetic coding sequence
tgaaccgacaactag

SEQ ID NO: 84761 - DNA, 4176 bp, Artificial Sequence
  Description of Artificial Sequence: Synthetic coding sequence
atggccgtggagggcagcaccatcaccagcagaatcaagaacctgctgagaagccccagcatcaagctgagaagaagcaaggccggcaacagaagagaggacctgagcagcaaggtgaccctggagaaggtgctgggcatcaccgtgagcggcggcagaggcctggcctgcgaccccagaagcggcctggtggcctaccccgccggctgcgtggtggtgctgttcaaccccagaaagcacaagcagcaccacatcctgaacagcagcagaaagaccatcaccgccctggccttcagccccgacggcaagtacctggtgaccggcgagagcggccacatgcccgccgtgagagtgtgggacgtggccgagcacagccaggtggccgagctgcaggagcacaagtacggcgtggcctgcgtggccttcagccccagcgccaagtacatcgtgagcgtgggctaccagcacgacatgatcgtgaacgtgtgggcctggaagaagaacatcgtggtggccagcaacaaggtgagcagcagagtgaccgccgtgagcttcagcgaggactgcagctacttcgtgaccgccggcaacagacacatcaagttctggtacctggacgacagcaagaccagcaaggtgaacgccaccgtgcccctgctgggcagaagcggcctgctgggcgagctgagaaacaacctgttcaccgacgtggcctgcggcagaggcaagaaggccgacagcaccttctgcatcaccagcagcggcctgctgtgcgagttcagcgacagaagactgctggacaagtgggtggagctgagagtgtaccccgaggtgaaggacagcaaccaggcctgcctgccccccagcagcttcatcacctgcagcagcgacaacaccatcagactgtggaacaccgagagcagcggcgtgcacggcagcaccctgcacagaaacatcctgagcagcgacctgatcaagatcatctacgtggacggcaacacccaggccctgctggacaccgagctgcccggcggcgacaaggccgacgccagcctgctggaccccagagtgggcatcagaagcgtgtgcgtgagccccaacggccagcacctggccagcggcgacagaatgggcaccctgagagtgcacgagctgcagagcctgagcgagatgctgaaggtggaggcccacgacagcgagatcctgtgcctggagtacagcaagcccgacaccggcctgaagctgctggccagcgccagcagagacagactgatccacgtgctggacgccggcagagagtacagcctgcagcagaccctggacgagcacagcagcagcatcaccgccgtgaagttcgccgccagcgacggccaggtgagaatgatcagctgcggcgccgacaagagcatctacttcagaaccgcccagaagagcggcgacggcgtgcagttcaccagaacccaccacgtggtgagaaagaccaccctgtacgacatggacgtggagcccagctggaagtacaccgccatcggctgccaggacagaaacatcagaatcttcaacatcagcagcggcaagcagaagaagctgttcaagggcagccagggcgaggacggcaccctgatcaaggtgcagaccgaccccagcggcatctacatcgccaccagctgcagcgacaagaacctgagcatcttcgacttcagcagcggcgagtgcgtggccaccatgttcggccacagcgagatcgtgaccggcatgaagttcagcaacgactgcaagcacctgatcagcgtgagcggcgacagctgcatcttcgtgtggagactgagcagcgagatgaccatcagcatgagacagagactggccgagctgagacagagacagagaggcggcaagcagcagggccccagcagcccccagagagccagcggccccaacagacaccaggcccccagcatgctgagccccggccccgccctgagcagcgacagcgacaaggagggcgaggacgagggcaccgaggaggagctgcccgccctgcccgtgctggccaagagcaccaagaaggccctggccagcgtgcccagccccgccctgcccagaagcctgagccactgggagatgagcagagcccaggagagcgtgggcttcctggaccccgcccccgccgccaaccccggccccagaagaagaggcagatgggtgcagcccggcgtggagctgagcgtgagaagcatgctggacctgagacagctggagaccctggcccccagcctgcaggaccccagccaggacagcctggccatcatccccagcggccccagaaagcacggccaggaggccctggagaccagcctgaccagccagaacgagaagccccccagaccccaggccagccagccctgcagctacccccacatcatcagactgctgagccaggaggagggcgtgttcgcccaggacctggagcccgcccccatcgaggacggcatcgtgtaccccgagcccagcgacaaccccaccatggacaccagcgagttccaggtgcaggcccccgccagaggcaccctgggcagagtgtaccccggcagcagaagcagcgagaagcacagccccgacagcgcctgcagcgtggactacagcagcagctgcctgagcagccccgagcaccccaccgaggacagcgagagcaccgagcccctgagcgtggacggcatcagcagcgacctggaggagcccgccgagggcgacgaggaggaggaggaggaggagggcggcatgggcccctacggcctgcaggagggcagcccccagacccccgaccaggagcagttcctgaagcagcacttcgagaccctggccagcggcgccgcccccggcgcccccgtgcaggtgcccgagagaagcgagagcagaagcatcagcagcagattcctgctgcaggtgcagaccagacccctgagagagcccagccccagcagcagcagcctggccctgatgagcagacccgcccaggtgccccaggccagcggcgagcagcccagaggcaacggcgccaacccccccggcgccccccccgaggtggagcccagcagcggcaaccccagcccccagcaggccgccagcgtgctgctgcccagatgcagactgaaccccgacagcagctgggcccccaagagagtggccaccgccagccccttcagcggcctgcagaaggcccagagcgtgcacagcctggtgccccaggagagacacgaggccagcctgcaggcccccagccccggcgccctgctgagcagagagatcgaggcccaggacggcctgggcagcctgccccccgccgacggcagacccagcagaccccacagctaccagaaccccaccaccagcagcatggccaagatcagcagaagcatcagcgtgggcgagaacctgggcctggtggccgagccccaggcccacgcccccatcagagtgagccccctgagcaagctggccctgcccagcagagcccacctggtgctggacatccccaagcccctgcccgacagacccaccctggccgccttcagccccgtgaccaagggcagagcccccggcgaggccgagaagcccggcttccccgtgggcctgggcaaggcccacagcaccaccgagagatgggcctgcctgggcgagggcaccacccccaagcccagaaccgagtgccaggcccaccccggccccagcagcccctgcgcccagcagctgcccgtgagcagcctgttccagggccccgagaacctgcagccccccccccccgagaagacccccaaccccatggagtgcaccaagcccggcgccgccctgagccaggacagcgagcccgccgtgagcctggagcagtgcgagcagctggtggccgagctgagaggcagcgtgagacaggccgtgagactgtaccacagcgtggccggctgcaagatgcccagcgccgagcagagcagaatcgcccagctgctgagagacaccttcagcagcgtgagacaggagctggaggccgtggccggcgccgtgctgagcagccccggcagcagccccggcgccgtgggcgccgagcagacccaggccctgctggagcagtacagcgagctgctgctgagagccgtggagagaagaatggagagaaagctgtag

SEQ ID NO: 84762 - DNA, 1077 bp, Artificial Sequence
  Description of Artificial Sequence: Synthetic coding sequence
atgagcaccgccagagagcagcccatcttcagcaccagagcccacgtgttccagatcgaccccgccaccaagagaaactggatccccgccggcaagcacgccctgaccgtgagctacttctacgacgccaccagaaacgtgtacagaatcatcagcatcggcggcgccaaggccatcatcaacagcaccgtgacccccaacatgaccttcaccaagaccagccagaagttcggccagtgggccgacagcagagccaacaccgtgtacggcctgggcttcgccagcgagcagcacctgacccagttcgccgagaagttccaggaggtgaaggaggccgccagactggccagagagaagagccaggacggcggcgagctgaccagccccgccctgggcctggccagccaccaggtgccccccagccccctggtgagcgccaacggccccggcgaggagaagctgttcagaagccagagcgccgacgcccccggccccaccgagagagagagactgaagaagatgctgagcgagggcagcgtgggcgaggtgcagtgggaggccgagttcttcgccctgcaggacagcaacaacaagctggccggcgccctgagagaggccaacgccgccgccgcccagtggagacagcagctggaggcccagagagccgaggccgagagactgagacagagagtggccgagctggaggcccaggccgccagcgaggtgacccccaccggcgagaaggagggcctgggccagggccagagcctggagcagctggaggccctggtgcagaccaaggaccaggagatccagaccctgaagagccagaccggcggccccagagaggccctggaggccgccgagagagaggagacccagcagaaggtgcagaccagaaacgccgagctggagcaccagctgagagccatggagagaagcctggaggaggccagagccgagagagagagagccagagccgaggtgggcagagccgcccagctgctggacgtgagcctgttcgagctgagcgagctgagagagggcctggccagactggccgaggccgccccctag

SEQ ID NO: 84763 - DNA, 438 bp, Artificial Sequence
  Description of Artificial Sequence: Synthetic coding sequence
atgagcaccgccagagagcagcccatcttcagcaccagagcccacgtgttccagatcgaccccgccaccaagagaaactggatccccgccggcaagcacgccctgaccgtgagctacttctacgacgccaccagaaacgtgtacagaatcatcagcatcggcggcgccaaggccatcatcaacagcaccgtgacccccaacatgaccttcaccaagaccagccagaagttcggccagtgggccgacagcagagccaacaccgtgtacggcctgggcttcgccagcgagcagcacctgacccagttcgccgagaagttccaggaggtgaaggaggccgccagactggccagagagaagagccaggacggctggggcggcccccagagcgccctggtggtgggcagcttcggcgccgtgttcgagctgctgatcgtgtag

SEQ ID NO: 84764 - DNA, 1086 bp, Artificial Sequence
  Description of Artificial Sequence: Synthetic coding sequence
atgagcaccgccagagagcagcccatcttcagcaccagagcccacgtgttccagatcgaccccgccaccaagagaaactggatccccgccggcaagcacgccctgaccgtgagctacttctacgacgccaccagaaacgtgtacagaatcatcagcatcggcggcgccaaggccatcatcaacagcaccgtgacccccaacatgaccttcaccaagaccagccagaagttcggccagtgggccgacagcagagccaacaccgtgtacggcctgggcttcgccagcgagcagcacctgacccagttcgccgagaagttccaggaggtgaaggaggccgccagactggccagagagaagagccaggacggcggcgagctgaccagccccgccctgggcctggccagccaccaggtgccccccagccccctggtgagcgccaacggccccggcgaggagaagctgttcagaagccagagcgccgacgcccccggccccaccgagagagagagactgaagaagatgctgagcgagggcagcgtgggcgaggtgcagtgggaggccgagttcttcgccctgcaggacagcaacaacaagctggccggcgccctgagagaggccaacgccgccgccgcccagtggagacagcagctggaggcccagagagccgaggccgagagactgagacagagagtggccgagctggaggcccaggccgccagcgaggtgacccccaccggcgagaaggagggcctgggccagggccagagcctggagcagctggaggccctggtgcagaccaaggaccaggagatccagaccctgaagagccagaccggcggccccagagaggccctggaggccgccgagagagaggagacccagcagaaggtgcaggacctggagaccagaaacgccgagctggagcaccagctgagagccatggagagaagcctggaggaggccagagccgagagagagagagccagagccgaggtgggcagagccgcccagctgctggacgtgagcctgttcgagctgagcgagctgagagagggcctggccagactggccgaggccgccccctag

SEQ ID NO: 84765 - DNA, 1077 bp, Artificial Sequence; identical to SEQ ID NO: 84762
  Description of Artificial Sequence: Synthetic coding sequence

SEQ ID NO: 84766 - DNA, 1086 bp, Artificial Sequence; identical to SEQ ID NO: 84764
  Description of Artificial Sequence: Synthetic coding sequence

SEQ ID NO: 84767 - DNA, 1086 bp, Artificial Sequence; identical to SEQ ID NO: 84764
  Description of Artificial Sequence: Synthetic coding sequence

SEQ ID NO: 84768 - DNA, 978 bp, Artificial Sequence; identical to SEQ ID NO: 75796
  Description of Artificial Sequence: Synthetic coding sequence

SEQ ID NO: 84769 - DNA, 1176 bp, Artificial Sequence
  Description of Artificial Sequence: Synthetic coding sequence
atggagagcgagaccgagcccgagcccgtgaccctgctggtgaagagccccaaccagagacacagagacctggagctgagcggcgacagaggctggagcgtgggccacctgaaggcccacctgagcagagtgtaccccgagagacccagacccgaggaccagagactgatctacagcggcaagctgctgctggaccaccagtgcctgagagacctgctgcccaagcaggagaagagacacgtgctgcacctggtgtgcaacgtgaagagccccagcaagatgcccgagatcaacgccaaggtggccgagagcaccgaggagcccgccggcagcaacagaggccagtaccccgaggacagcagcagcgacggcctgagacagagagaggtgctgagaaacctgagcagccccggctgggagaacatcagcagacccgaggccgcccagcaggccttccagggcctgggccccggcttcagcggctacaccccctacggctggctgcagctgagctggttccagcagatctacgccagacagtactacatgcagtacctggccgccaccgccgccagcggcgccttcgtgcccccccccagcgcccaggagatccccgtggtgagcgcccccgcccccgcccccatccacaaccagttccccgccgagaaccagcccgccaaccagaacgccgccccccaggtggtggtgaaccccggcgccaaccagaacctgagaatgaacgcccagggcggccccatcgtggaggaggacgacgagatcaacagagactggctggactggacctacagcgccgccaccttcagcgtgttcctgagcatcctgtacttctacagcagcctgagcagattcctgatggtgatgggcgccaccgtggtgatgtacctgcaccacgtgggctggttccccttcagacccagacccgtgcagaacttccccaacgacggccccccccccgacgtggtgaaccaggaccccaacaacaacctgcaggagggcaccgaccccgagaccgaggaccccaaccacctgccccccgacagagacgtgctggacggcgagcagaccagccccagcttcatgagcaccgcctggctggtgttcaagaccttcttcgccagcctgctgcccgagggcccccccgccatcgccaactag

SEQ ID NO: 84770 - DNA, 699 bp, Artificial Sequence
  Description of Artificial Sequence: Synthetic coding sequence
atggagagcgagaccgagcccgagcccgtgaccctgctggtgaagagccccaaccagagacacagagacctggagctgagcggcgacagaggctggagcgtgggccacctgaaggcccacctgagcagagtgtaccccgagagacccagacccgaggaccagagactgatctacagcggcaagctgctgctggaccaccagtgcctgagagacctgctgcccaaggagaagagacacgtgctgcacctggtgtgcaacgtgaagagccccagcaagatgcccgagatcaacgccaaggtggccgagagcaccgaggagcccgccggcagcaacagaggccagtaccccgaggacagcagcagcgacggcctgagacagagagaggtgctgagaaacctgagcagccccggctgggagaacatcagcagacaccacgtgggctggttccccttcagacccagacccgtgcagaacttccccaacgacggccccccccccgacgtggtgaaccaggaccccaacaacaacctgcaggagggcaccgaccccgagaccgaggaccccaaccacctgccccccgacagagacgtgctggacggcgagcagaccagccccagcttcatgagcaccgcctggctggtgttcaagaccttcttcgccagcctgctgcccgagggcccccccgccatcgccaactag

SEQ ID NO: 84771 - DNA, 1101 bp, Artificial Sequence
  Description of Artificial Sequence: Synthetic coding sequence
atggagagcgagaccgagcccgagcccgtgaccctgctggtgaagagccccaaccagagacacagagacctggagctgagcggcgacagaggctggagcgtgggccacctgaaggcccacctgagcagagtgtaccccgagagacccagacccgaggaccagagactgatctacagcggcaagctgctgctggaccaccagtgcctgagagacctgctgcccaaggtggccgagagcaccgaggagcccgccggcagcaacagaggccagtaccccgaggacagcagcagcgacggcctgagacagagagaggtgctgagaaacctgagcagccccggctgggagaacatcagcagacccgaggccgcccagcaggccttccagggcctgggccccggcttcagcggctacaccccctacggctggctgcagctgagctggttccagcagatctacgccagacagtactacatgcagtacctggccgccaccgccgccagcggcgccttcgtgcccccccccagcgcccaggagatccccgtggtgagcgcccccgcccccgcccccatccacaaccagttccccgccgagaaccagcccgccaaccagaacgccgccccccaggtggtggtgaaccccggcgccaaccagaacctgagaatgaacgcccagggcggccccatcgtggaggaggacgacgagatcaacagagactggctggactggacctacagcgccgccaccttcagcgtgttcctgagcatcctgtacttctacagcagcctgagcagattcctgatggtgatgggcgccaccgtggtgatgtacctgcaccacgtgggctggttccccttcagacccagacccgtgcagaacttccccaacgacggccccccccccgacgtggtgaaccaggaccccaacaacaacctgcaggagggcaccgaccccgagaccgaggaccccaaccacctgccccccgacagagacgtgctggacggcgagcagaccagccccagcttcatgagcaccgcctggctggtgttcaagaccttcttcgccagcctgctgcccgagggcccccccgccatcgccaactag

SEQ ID NO: 84772 - DNA, 1173 bp, Artificial Sequence
  Description of Artificial Sequence: Synthetic coding sequence
atggagagcgagaccgagcccgagcccgtgaccctgctggtgaagagccccaaccagagacacagagacctggagctgagcggcgacagaggctggagcgtgggccacctgaaggcccacctgagcagagtgtaccccgagagacccagacccgaggaccagagactgatctacagcggcaagctgctgctggaccaccagtgcctgagagacctgctgcccaaggagaagagacacgtgctgcacctggtgtgcaacgtgaagagccccagcaagatgcccgagatcaacgccaaggtggccgagagcaccgaggagcccgccggcagcaacagaggccagtaccccgaggacagcagcagcgacggcctgagacagagagaggtgctgagaaacctgagcagccccggctgggagaacatcagcagacccgaggccgcccagcaggccttccagggcctgggccccggcttcagcggctacaccccctacggctggctgcagctgagctggttccagcagatctacgccagacagtactacatgcagtacctggccgccaccgccgccagcggcgccttcgtgcccccccccagcgcccaggagatccccgtggtgagcgcccccgcccccgcccccatccacaaccagttccccgccgagaaccagcccgccaaccagaacgccgccccccaggtggtggtgaaccccggcgccaaccagaacctgagaatgaacgcccagggcggccccatcgtggaggaggacgacgagatcaacagagactggctggactggacctacagcgccgccaccttcagcgtgttcctgagcatcctgtacttctacagcagcctgagcagattcctgatggtgatgggcgccaccgtggtgatgtacctgcaccacgtgggctggttccccttcagacccagacccgtgcagaacttccccaacgacggccccccccccgacgtggtgaaccaggaccccaacaacaacctgcaggagggcaccgaccccgagaccgaggaccccaaccacctgccccccgacagagacgtgctggacggcgagcagaccagccccagcttcatgagcaccgcctggctggtgttcaagaccttcttcgccagcctgctgcccgagggcccccccgccatcgccaactag

SEQ ID NO: 84773 - DNA, 1338 bp, Artificial Sequence
  Description of Artificial Sequence: Synthetic coding sequence
atggccgagctgaagtacatcagcggcttcggcaacgagtgcagcagcgaggaccccagatgccccggcagcctgcccgagggccagaacaacccccaggtgtgcccctacaacctgtacgccgagcagctgagcggcagcgccttcacctgccccagaagcaccaacaagagaagctggctgtacagaatcctgcccagcgtgagccacaagcccttcgagagcatcgacgagggccaggtgacccacaactgggacgaggtggaccccgaccccaaccagctgagatggaagcccttcgagatccccaaggccagccagaagaaggtggacttcgtgagcggcctgcacaccctgtgcggcgccggcgacatcaagagcaacaacggcctggccatccacatcttcctgtgcaacaccagcatggagaacagatgcttctacaacagcgacggcgacttcctgatcgtgccccagaagggcaacctgctgatctacaccgagttcggcaagatgctggtgcagcccaacgagatctgcgtgatccagagaggcatgagattcagcatcgacgtgttcgaggagaccagaggctacatcctggaggtgtacggcgtgcacttcgagctgcccgacctgggccccatcggcgccaacggcctggccaaccccagagacttcctgatccccatcgcctggtacgaggacagacaggtgcccggcggctacaccgtgatcaacaagtaccagggcaagctgttcgccgccaagcaggacgtgagccccttcaacgtggtggcctggcacggcaactacaccccctacaagtacaacctgaagaacttcatggtgatcaacagcgtggccttcgaccacgccgaccccagcatcttcaccgtgctgaccgccaagagcgtgagacccggcgtggccatcgccgacttcgtgatcttcccccccagatggggcgtggccgacaagaccttcagacccccctactaccacagaaactgcatgagcgagttcatgggcctgatcagaggccactacgaggccaagcagggcggcttcctgcccggcggcggcagcctgcacagcaccatgaccccccacggccccgacgccgactgcttcgagaaggccagcaaggtgaagctggcccccgagagaatcgccgacggcaccatggccttcatgttcgagagcagcctgagcctggccgtgaccaagtggggcctgaaggccagcagatgcctggacgagaactaccacaagtgctgggagcccctgaagagccacttcacccccaacagcagaaaccccgccgagcccaactag

SEQ ID NO: 84774 - DNA, 2187 bp, Artificial Sequence
  Description of Artificial Sequence: Synthetic coding sequence
atggaggagacccagccccccccccagcccaagctgcccctgtgcgacagcctgatgatctggctgcagaccttcaacaccgccagcccctgccaggacgtgaagcagctgaccagcggcgtggccatggcccaggtgctgcaccagatcgacgccgcctggttcaacgagagctggctgagcagaatcaaggaggacgtgggcgacaactggagaatcaaggccagcaacgtgaagaaggtgctgcagggcatcatgagctactaccacgagttcctgggccagcagatcagcgaggccctgatccccgacctgaaccagatcaccgagtgcagcgaccccgtggagctgggcagactgctgcagctgatcctgggctgcgccatcaactgcgagaagaagcaggagcacatccagaacatcatgaccctggaggagagcgtgcagcacgtggtgatgaccgccatccaggagctgatgagcaaggagatcctgagcagcccccccaacgacgccgtgggcgagctggagcagcagctgaagagagccctggaggagctgcaggaggccctggccgagaaggaggagctgagacagagatgcgaggagctggacatgcaggtgaccaccctgcaggacgagaagaacagcctggtgagcgagaacgagatgatgaacgagaagctggaccagctggacggcagcttcgacgaccccaacaccgtggtggccaagaagtacttccacgcccagctgcagctggagcagctgcaggaggagaacttcagactggaggccgccaaggacgactacagagtgcactgcgaggagctggagaagcagctgatcgagttccagcacagaaacgacgagctgaccagcctggccgaggagaccagagccctgaaggacgagatcgacgtgctgagagccaccagcgacaaggccaacaagctggagagcaccgtggagatctacagacagaagctgcaggacctgaacgacctgagaaagcaggtgaagaccctgcaggagaccaacatgatgtacatgcacaacaccgtgagcctggaggaggagctgaagaaggccaacgccgccagaacccagctggagacctacaagagacaggtgcaggacctgcacgtgaagctgagcagcgagagcaagagagccgacaccctggccttcgagatgaagagactggaggagaagcacgaggccctgctgaaggagaaggagagactgatcgagcagagagacaccctgaaggagaccaacgaggagctgagatgcagccaggtgcagcaggaccacctgaaccagaccgacgccagcgccaccaagagctacgagaacctggccgccgagatcatgcccgtggagtacagagaggtgttcatcagactgcagcacgagaacaagatgctgagactgcagcaggagggcagcgagaacgagagaatcgaggagctgcaggagcagctggagcagaagcacagaaagatgaacgagctggagaccgagcagagactgagcaaggagagaatcagagagctgcagcagcagatcgaggacctgcagaagagcctgcaggagcagggcagcaagagcgagggcgagagcagcagcaagctgaagcagaagctggaggcccacatggagaagctgaccgaggtgcacgaggagctgcagaagaagcaggagctgatcgaggacctgcagcccgacatcaaccagaacgtgcagaagatcaacgagctggaggccgccctgcagaagaaggacgaggacatgaaggccatggaggagagatacaagatgtacctggagaaggccagaaacgtgatcaagaccctggaccccaagctgaaccccgccagcgccgagatcatgctgctgagaaagcagctggccgagaaggagagaagaatcgagatcctggagagcgagtgcaaggtggccaagttcagagactacgaggagaagctgatcgtgagcgcctggtacaacaagagcctggccttccagaagctgggcatggagagcagactggtgagcggcggcggcgcctgcagcgacaccggcgcctgcacccccgccagaagcttcctggcccagcagagacacatcaccaacaccagaagaaacctgagcgtgaaggtgcccgccaccaccagcgactag

SEQ ID NO: 84775 - DNA, 2061 bp, Artificial Sequence
  Description of Artificial Sequence: Synthetic coding sequence
atggcccaggtgctgcaccagatcgacgccgcctggttcaacgagagctggctgagcagaatcaaggaggacgtgggcgacaactggagaatcaaggccagcaacgtgaagaaggtgctgcagggcatcatgagctactaccacgagttcctgggccagcagatcagcgaggccctgatccccgacctgaaccagatcaccgagtgcagcgaccccgtggagctgggcagactgctgcagctgatcctgggctgcgccatcaactgcgagaagaagcaggagcacatccagaacatcatgaccctggaggagagcgtgcagcacgtggtgatgaccgccatccaggagctgatgagcaaggagatcctgagcagcccccccaacgacgccgtgggcgagctggagcagcagctgaagagagccctggaggagctgcaggaggccctggccgagaaggaggagctgagacagagatgcgaggagctggacatgcaggtgaccaccctgcaggacgagaagaacagcctggtgagcgagaacgagatgatgaacgagaagctggaccagctggacggcagcttcgacgaccccaacaccgtggtggccaagaagtacttccacgcccagctgcagctggagcagctgcaggaggagaacttcagactggaggccgccaaggacgactacagagtgcactgcgaggagctggagaagcagctgatcgagttccagcacagaaacgacgagctgaccagcctggccgaggagaccagagccctgaaggacgagatcgacgtgctgagagccaccagcgacaaggccaacaagctggagagcaccgtggagatctacagacagaagctgcaggacctgaacgacctgagaaagcaggtgaagaccctgcaggagaccaacatgatgtacatgcacaacaccgtgagcctggaggaggagctgaagaaggccaacgccgccagaacccagctggagacctacaagagacaggtgcaggacctgcacgtgaagctgagcagcgagagcaagagagccgacaccctggccttcgagatgaagagactggaggagaagcacgaggccctgctgaaggagaaggagagactgatcgagcagagagacaccctgaaggagaccaacgaggagctgagatgcagccaggtgcagcaggaccacctgaaccagaccgacgccagcgccaccaagagctacgagaacctggccgccgagatcatgcccgtggagtacagagaggtgttcatcagactgcagcacgagaacaagatgctgagactgcagcaggagggcagcgagaacgagagaatcgaggagctgcaggagcagctggagcagaagcacagaaagatgaacgagctggagaccgagcagagactgagcaaggagagaatcagagagctgcagcagcagatcgaggacctgcagaagagcctgcaggagcagggcagcaagagcgagggcgagagcagcagcaagctgaagcagaagctggaggcccacatggagaagctgaccgaggtgcacgaggagctgcagaagaagcaggagctgatcgaggacctgcagcccgacatcaaccagaacgtgcagaagatcaacgagctggaggccgccctgcagaagaaggacgaggacatgaaggccatggaggagagatacaagatgtacctggagaaggccagaaacgtgatcaagaccctggaccccaagctgaaccccgccagcgccgagatcatgctgctgagaaagcagctggccgagaaggagagaagaatcgagatcctggagagcgagtgcaaggtggccaagttcagagactacgaggagaagctgatcgtgagcgcctggtacaacaagagcctggccttccagaagctgggcatggagagcagactggtgagcggcggcggcgcctgcagcgacaccggcgcctgcacccccgccagaagcttcctggcccagcagagacacatcaccaacaccagaagaaacctgagcgtgaaggtgcccgccaccaccagcgactag

SEQ ID NO: 84776 - DNA, 414 bp, Artificial Sequence
  Description of Artificial Sequence: Synthetic coding sequence
atggaggagacccagccccccccccagcccaagctgcccctgtgcgacagcctgatgatctggctgcagaccttcaacaccgccagcccctgccaggacgtgaagcagctgaccagcggcgtggccatggcccaggtgctgcaccagatcgacgccgcctggttcaacgagagctggctgagcagaatcaaggaggacgtgggcgacaactggagaatcaaggccagcaacgtgaagaaggtgctgcagggcatcatgagctactaccacgagttcctgggccagcagatcagcgaggccctgatccccgacctgaaccagatcaccgagtgcagcgaccccgtggagctgggcagactgctgcagctgatcctgggctgcgccatcaactgcgagaagaagcaggagcactag

SEQ ID NO: 84777 - DNA, 2154 bp, Artificial Sequence
  Description of Artificial Sequence: Synthetic coding sequence
atgagcgtggacaaggccgagctgtgcggcagcctgctgacctggctgcagaccttccacgtgcccagcccctgcgccagcccccaggacctgagcagcggcctggccgtggcctacgtgctgaaccagatcgaccccagctggttcaacgaggcctggctgcagggcatcagcgaggaccccggccccaactggaagctgaaggtgagcaacctgaagatggtgctgagaagcctggtggagtacagccaggacgtgctggcccaccccgtgagcgaggagcacctgcccgacgtgagcctgatcggcgagttcagcgaccccgccgagctgggcaagctgctgcagctggtgctgggctgcgccatcagctgcgagaagaagcaggaccacatccagagaatcatgaccctggaggagagcgtgcagcacgtggtgatggaggccatccaggagctgatgaccaaggacacccccgacagcctgagccccgagacctacggcaacttcgacagccagagcagaagatactacttcctgagcgaggaggccgaggagggcgacgagctgcagcagagatgcctggacctggagagacagctgatgctgctgagcgaggagaagcagagcctggcccaggagaacgccggcctgagagagagaatgggcagacccgagggcgagggcacccccggcctgaccgccaagaagctgctgctgctgcagagccagctggagcagctgcaggaggagaacttcagactggagagcggcagagaggacgagagactgagatgcgccgagctggagagagaggtggccgagctgcagcacagaaaccaggccctgaccagcctggcccaggaggcccaggccctgaaggacgagatggacgagctgagacagagcagcgagagagccggccagctggaggccaccctgaccagctgcagaagaagactgggcgagctgagagagctgagaagacaggtgagacagctggaggagagaaacgccggccacgccgagagaaccagacagctggaggacgagctgagaagagccggcagcctgagagcccagctggaggcccagagaagacaggtgcaggagctgcagggccagagacaggaggaggccatgaaggccgagaagtggctgttcgagtgcagaaacctggaggagaagtacgagagcgtgaccaaggagaaggagagactgctggccgagagagacagcctgagagaggccaacgaggagctgagatgcgcccagctgcagcccagaggcctgacccaggccgaccccagcctggaccccaccagcacccccgtggacaacctggccgccgagatcctgcccgccgagctgagagagaccctgctgagactgcagctggagaacaagagactgtgcagacaggaggccgccgacagagagagacaggaggagctgcagagacacctggaggacgccaacagagccagacacggcctggagacccagcacagactgaaccagcagcagctgagcgagctgagagcccaggtggaggacctgcagaaggccctgcaggagcagggcggcaagaccgaggacagcatcctgctgaagagaaagctggaggagcacctgcagaagctgcacgaggccgacctggagctgcagagaaagagagagtacatcgaggagctggagccccccaccgacagcagcaccgccagaagaatcgaggagctgcagcacaacctgcagaagaaggacgccgacctgagagccatggaggagagatacagaagatacgtggacaaggccagaatggtgatgcagaccatggagcccaagcagagacccgccgccggcgccccccccgagctgcacagcctgagaacccagctgagagagagagacgtgagaatcagacacctggagatggacttcgagaagagcagaagccagagagagcaggaggagaagctgctgatcagcgcctggtacaacatgggcatggccctgcagcagagagccggcgaggagagagcccccgcccacgcccagagcttcctggcccagcagagactggccaccaacagcagaagaggccccctgggcagactggccagcctgaacctgagacccaccgacaagcactag

SEQ ID NO: 84778 - DNA, 2160 bp, Artificial Sequence
  Description of Artificial Sequence: Synthetic coding sequence
atgagcgtggacaaggccgagctgtgcggcagcctgctgacctggctgcagaccttccacgtgcccagcccctgcgccagcccccaggacctgagcagcggcctggccgtggcctacgtgctgaaccagatcgaccccagctggttcaacgaggcctggctgcagggcatcagcgaggaccccggccccaactggaagctgaaggtgagcaacctgaagatggtgctgagaagcctggtggagtacagccaggacgtgctggcccaccccgtgagcgaggagcacctgcccgacgtgagcctgatcggcgagttcagcgaccccgccgagctgggcaagctgctgcagctggtgctgggctgcgccatcagctgcgagaagaagcaggaccacatccagagaatcatgaccctggaggagagcgtgcagcacgtggtgatggaggccatccaggagctgatgaccaaggacacccccgacagcctgagccccgagacctacggcaacttcgacagccagagcagaagatactacttcctgagcgaggaggccgaggagggcgacgagctgcagcagagatgcctggacctggagagacagctgatgctgctgagcgaggagaagcagagcctggcccaggagaacgccggcctgagagagagaatgggcagacccgagggcgagggcacccccggcctgaccgccaagaagctgctgctgctgcagagccagctggagcagctgcaggaggagaacttcagactggagagcggcagagaggacgagagactgagatgcgccgagctggagagagaggtggccgagctgcagcacagaaaccaggccctgaccagcctggcccaggaggcccaggccctgaaggacgagatggacgagctgagacagagcagcgagagagccggccagctggaggccaccctgaccagctgcagaagaagactgggcgagctgagagagctgagaagacaggtgagacagctggaggagagaaacgccggccacgccgagagaaccagacagctggaggacgagctgagaagagccggcagcctgagagcccagctggaggcccagagaagacaggtgcaggagctgcagggccagagacaggaggaggccatgaaggccgagaagtggctgttcgagtgcagaaacctggaggagaagtacgagagcgtgaccaaggagaaggagagactgctggccgagagagacagcctgagagaggccaacgaggagctgagatgcgcccagctgcagcccagaggcctgacccaggccgaccccagcctggaccccaccagcacccccgtggacaacctggccgccgagatcctgcccgccgagctgagagagaccctgctgagactgcagctggagaacaagagactgtgcagacaggaggccgccgacagagagagacaggaggagctgcagagacacctggaggacgccaacagagccagacacggcctggagacccagcacagactgaaccagcagcagctgagcgagctgagagcccaggtggaggacctgcagaaggccctgcaggagcagggcggcaagaccgaggacgccatcagcatcctgctgaagagaaagctggaggagcacctgcagaagctgcacgaggccgacctggagctgcagagaaagagagagtacatcgaggagctggagccccccaccgacagcagcaccgccagaagaatcgaggagctgcagcacaacctgcagaagaaggacgccgacctgagagccatggaggagagatacagaagatacgtggacaaggccagaatggtgatgcagaccatggagcccaagcagagacccgccgccggcgccccccccgagctgcacagcctgagaacccagctgagagagagagacgtgagaatcagacacctggagatggacttcgagaagagcagaagccagagagagcaggaggagaagctgctgatcagcgcctggtacaacatgggcatggccctgcagcagagagccggcgaggagagagcccccgcccacgcccagagcttcctggcccagcagagactggccaccaacagcagaagaggccccctgggcagactggccagcctgaacctgagacccaccgacaagcactag

SEQ ID NO: 84779 - DNA, 2157 bp, Artificial Sequence
  Description of Artificial Sequence: Synthetic coding sequence
atgttcagcgtggagagcctggagagagccgagctgtgcgagagcctgctgacctggatccagaccttcaacgtggacgccccctgccagaccgtggaggacctgaccaacggcgtggtgatggcccaggtgctgcagaagatcgaccccgcctacttcgacgagaactggctgaacagaatcaagaccgaggtgggcgacaactggagactgaagatcagcaacctgaagaagatcctgaagggcatcctggactacaaccacgagatcctgggccagcagatcaacgacttcaccctgcccgacgtgaacctgatcggcgagcacagcgacgccgccgagctgggcagaatgctgcagctgatcctgggctgcgccgtgaactgcgagcagaagcaggagtacatccaggccatcatgatgatggaggagagcgtgcagcacgtggtgatgaccgccatccaggagctgatgagcaaggagagccccgtgagcgccggcaacgacgcctacgtggacctggacagacagctgaagaagaccaccgaggagctgaacgaggccctgagcgccaaggaggagatcgcccagagatgccacgagctggacatgcaggtggccgccctgcaggaggagaagagcagcctgctggccgagaaccaggtgctgatggagagactgaaccagagcgacagcatcgaggaccccaacagccccgccggcagaagacacctgcagctgcagacccagctggagcagctgcaggaggagaccttcagactggaggccgccaaggacgactacagaatcagatgcgaggagctggagaaggagatcagcgagctgagacagcagaacgacgagctgaccaccctggccgacgaggcccagagcctgaaggacgagatcgacgtgctgagacacagcagcgacaaggtgagcaagctggagggccaggtggagagctacaagaagaagctggaggacctgggcgacctgagaagacaggtgaagctgctggaggagaagaacaccatgtacatgcagaacaccgtgagcctggaggaggagctgagaaaggccaacgccgccagaagccagctggagacctacaagagacaggtggtggagctgcagaacagactgagcgaggagagcaagaaggccgacaagctggacttcgagtacaagagactgaaggagaaggtggacagcctgcagaaggagaaggacagactgagaaccgagagagacagcctgaaggagaccatcgaggagctgagatgcgtgcaggcccaggagggccagctgaccacccagggcctgatgcccctgggcagccaggagagcagcgacagcctggccgccgagatcgtgacccccgagatcagagagaagctgatcagactgcagcacgagaacaagatgctgaagctgaaccaggagggcagcgacaacgagaagatcgccctgctgcagagcctgctggacgacgccaacctgagaaagaacgagctggagaccgagaacagactggtgaaccagagactgctggaggtgcagagccaggtggaggagctgcagaagagcctgcaggaccagggcagcaaggccgaggacagcgtgctgctgaagaagaagctggaggagcacctggagaagctgcacgaggccaacaacgagctgcagaagaagagagccatcatcgaggacctggagcccagattcaacaacagcagcctgaagatcgaggagctgcaggaggccctgagaaagaaggaggaggagatgaagcagatggaggagagatacaagaagtacctggagaaggccaagagcgtgatcagaaccctggaccccaagcagaaccagggcgccgcccccgagatccaggccctgaagaaccagctgcaggagagagacagactgttccacagcctggagaaggagtacgagaagaccaagagccagagagagatggaggagaagtacatcgtgagcgcctggtacaacatgggcatgaccctgcacaagaaggccgccgaggacagactggccagcaccggcagcggccagagcttcctggccagacagagacaggccaccagcagcagaagaagctaccccggccacgtgcagcccgccaccgccagatag

SEQ ID NO: 84780 - DNA, 222 bp, Artificial Sequence
  Description of Artificial Sequence: Synthetic coding sequence
atgagcgccgagaccgccagcggccccaccgaggaccaggtggagatcctggagtacaacttcaacaaggtggacaagcaccccgacagcaccaccctgtgcctgatcgccgccgaggccggcctgagcgaggaggagacccagaagtggttcaagcagagactggccaagtggagaagaagcgagggcctgcccagcgagtgcagaagcgtgaccgactag

SEQ ID NO: 84781 - DNA, 222 bp, Artificial Sequence; identical to SEQ ID NO: 84780
  Description of Artificial Sequence: Synthetic coding sequence

SEQ ID NO: 84782 - DNA, 222 bp, Artificial Sequence; identical to SEQ ID NO: 84780
  Description of Artificial Sequence: Synthetic coding sequence

SEQ ID NO: 84783 - DNA, 285 bp, Artificial Sequence
  Description of Artificial Sequence: Synthetic coding sequence
atgagcgccgagaccgccagcggccccaccgaggaccaggtggagatcctggagtacaacttcaacaaggtggacaagcaccccgacagcaccaccctgtgcctgatcgccgccgaggccggcctgagcgaggaggagacccagggcagcgacctgatcagcagaagcaagatctggcaccccgagagcagcccccagagagagggctacccccacgacagcctgccctgcctggccttcgactacttcagcctgctgcccccccagtgcaaggagatggtgtag

SEQ ID NO: 84784 - DNA, 276 bp, Artificial Sequence
  Description of Artificial Sequence: Synthetic coding sequence
atgctgatcttcctgggctgctacagaagaagactggaggagagagccggcaccatgagcgccgagaccgccagcggccccaccgaggaccaggtggagatcctggagtacaacttcaacaaggtggacaagcaccccgacagcaccaccctgtgcctgatcgccgccgaggccggcctgagcgaggaggagacccagaagtggttcaagcagagactggccaagtggagaagaagcgagggcctgcccagcgagtgcagaagcgtgaccgactag

SEQ ID NO: 84785 - DNA, 222 bp, Artificial Sequence; identical to SEQ ID NO: 84780
  Description of Artificial Sequence: Synthetic coding sequence

SEQ ID NO: 84786 - DNA, 285 bp, Artificial Sequence; identical to SEQ ID NO: 84783
  Description of Artificial Sequence: Synthetic coding sequence

SEQ ID NO: 84787 - DNA, 222 bp, Artificial Sequence; identical to SEQ ID NO: 84780
  Description of Artificial Sequence: Synthetic coding sequence

SEQ ID NO: 84788 - DNA, 276 bp, Artificial Sequence; identical to SEQ ID NO: 84784
  Description of Artificial Sequence: Synthetic coding sequence

SEQ ID NO: 84789 - DNA, 285 bp, Artificial Sequence; identical to SEQ ID NO: 84783
  Description of Artificial Sequence: Synthetic coding sequence

SEQ ID NO: 84790 - DNA, 222 bp, Artificial Sequence; identical to SEQ ID NO: 84780
  Description of Artificial Sequence: Synthetic coding sequence

SEQ ID NO: 84791 - DNA, 222 bp, Artificial Sequence; identical to SEQ ID NO: 84780
  Description of Artificial Sequence: Synthetic coding sequence

SEQ ID NO: 84792 - DNA, 339 bp, Artificial Sequence
  Description of Artificial Sequence: Synthetic coding sequence
atgctgatcttcctgggctgctacagaagaagactggaggagagagccggcaccatgagcgccgagaccgccagcggccccaccgaggaccaggtggagatcctggagtacaacttcaacaaggtggacaagcaccccgacagcaccaccctgtgcctgatcgccgccgaggccggcctgagcgaggaggagacccagggcagcgacctgatcagcagaagcaagatctggcaccccgagagcagcccccagagagagggctacccccacgacagcctgccctgcctggccttcgactacttcagcctgctgcccccccagtgcaaggagatggtgtag

SEQ ID NO: 84793 - DNA, 222 bp, Artificial Sequence; identical to SEQ ID NO: 84780
  Description of Artificial Sequence: Synthetic coding sequence

SEQ ID NO: 84794 - DNA, 222 bp, Artificial Sequence; identical to SEQ ID NO: 84780
  Description of Artificial Sequence: Synthetic coding sequence

SEQ ID NO: 84795 - DNA, 222 bp, Artificial Sequence; identical to SEQ ID NO: 84780
  Description of Artificial Sequence: Synthetic coding sequence

SEQ ID NO: 84796 - DNA, 144 bp, Artificial Sequence
  Description of Artificial Sequence: Synthetic coding sequence
atgagcgccgagaccgccagcggccccaccgaggaccaggtggagatcctggagtacaacttcaacaaggtggacaagcaccccgacagcaccaccctgtgcctgatcgccgccgaggccggcctgagcgaggaggagacctag

SEQ ID NO: 84797 - DNA, 1164 bp, Artificial Sequence
  Description of Artificial Sequence: Synthetic coding sequence
atggccaccgcccagctgcagagaacccccatgagcgccctggtgttccccaacaagatcagcaccgagcaccagagcctggtgctggtgaagagactgctggccgtgagcgtgagctgcatcacctacctgagaggcatcttccccgagtgcgcctacggcaccagatacctggacgacctgtgcgtgaagatcctgagagaggacaagaactgccccggcagcacccagctggtgaagtggatgctgggctgctacgacgccctgcagaagaagtacgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84798 - DNA, 1185 bp, Artificial Sequence
  Description of Artificial Sequence: Synthetic coding sequence
atggccaccgcccagctgcagagaacccccatgagcgccctggtgttccccaacaagatcagcaccgagcaccagagcctggtgctggtgaagagactgctggccgtgagcgtgagctgcatcacctacctgagaggcatcttccccgagtgcgcctacggcaccagatacctggacgacctgtgcgtgaagatcctgagagaggacaagaactgccccggcagcacccagctggtgaagtggatgctgggctgctacgacgccctgcagaagaagtacctgagaatggtggtgctggccgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84799 - DNA, 573 bp, Artificial Sequence
  Description of Artificial Sequence: Synthetic coding sequence
atgagactgtggaacaagatcagcagatggatgctgggctgctacgacgccctgcagaagaagtacctgagaatggtggtgctggccgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggactag

SEQ ID NO: 84800 - DNA, 972 bp, Artificial Sequence
  Description of Artificial Sequence: Synthetic coding sequence
atgagactgtggaacaagatcagcagatggatgctgggctgctacgacgccctgcagaagaagtacctgaagatcatggagctgaccgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84801 - DNA, 1185 bp, Artificial Sequence
  Description of Artificial Sequence: Synthetic coding sequence
atggccaccgcccagctgcagagaacccccatgagcgccctggtgttccccaacaagatcagcaccgagcaccagagcctggtgctggtgaagagactgctggccgtgagcgtgagctgcatcacctacctgagaggcatcttccccgagtgcgcctacggcaccagatacctggacgacctgtgcgtgaagatcctgagagaggacaagaactgccccggcagcacccagctggtgaagtggatgctgggctgctacgacgccctgcagaagaagtacctgaagatcatggagctgaccgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84802 - DNA, 945 bp, Artificial Sequence
  Description of Artificial Sequence: Synthetic coding sequence
atgagactgtggaacaagatcagcagatggatgctgggctgctacgacgccctgcagaagaagtacctgagaatggtggtgctggccaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84803 - DNA, 495 bp, Artificial Sequence
  Description of Artificial Sequence: Synthetic coding sequence
atgagactgtggaacaagatcagcagatggatgctgggctgctacgacgccctgcagaagaagtacgtgtacaccaaccccgaggacccccagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagctag

SEQ ID NO: 84804 - DNA, 945 bp, Artificial Sequence
  Description of Artificial Sequence: Synthetic coding sequence
atgagactgtggaacaagatcagcagatggatgctgggctgctacgacgccctgcagaagaagtacctgagatacttcctgttcaagaccatcagcgagtgctaccagttcaagttcaagtacaccaacaacggccccctgatggacttcatcagcaagaaccagagcaacgagagcagcatgctgagcaccgacaccaagaaggccagcatcctgctgatcagaaagatctacatcctgatgcagaacctgggccccctgcccaacgacgtgtgcctgaccatgaagctgttctactacgacgaggtgaccccccccgactaccagccccccggcttcaaggacggcgactgcgagggcgtgatcttcgagggcgagcccatgtacctgaacgtgggcgaggtgagcacccccttccacatcttcaaggtgaaggtgaccaccgagagagagagaatggagaacatcgacagcaccatcctgagccccaagcagatcaagacccccttccagaagatcctgagagacaaggacgtggaggacgagcaggagcactacaccagcgacgacctggacatcgagaccaagatggaggagcaggagaagaaccccgccagcagcgagctggaggagcccagcctggtgtgcgaggaggacgagatcatgagaagcaaggagagccccgacctgagcatcagccacagccaggtggagcagctggtgaacaagaccagcgagctggacatgagcgagagcaagaccagaagcggcaaggtgttccagaacaagatggccaacggcaaccagcccgtgaagagcagcaaggagaacagaaagagaagccagcacgagagcggcagaatcgtgctgcaccacttcgacagcagcagccaggagagcgtgcccaagagaagaaagttcagcgagcccaaggagcacatctag

SEQ ID NO: 84805 - DNA, 6108 bp, Artificial Sequence
  Description of Artificial Sequence: Synthetic coding sequence
atggccagcgccgtgagccccgccaacctgcccgccgtgctgctgcagcccagatggaagagagtggtgggctggagcggccccgtgcccagacccagacacggccacagagccgtggccatcaaggagctgatcgtggtgttcggcggcggcaacgagggcatcgtggacgagctgcacgtgtacaacaccgccaccaaccagtggttcatccccgccgtgagaggcgacatcccccccggctgcgccgcctacggcttcgtgtgcgacggcaccagactgctggtgttcggcggcatggtggagtacggcaagtacagcaacgacctgtacgagctgcaggccagcagatgggagtggaagagactgaaggccaagacccccaagaacggcccccccccctgccccagactgggccacagcttcagcctggtgggcaacaagtgctacctgttcggcggcctggccaacgacagcgaggaccccaagaacaacatccccagatacctgaacgacctgtacatcctggagctgagacccggcagcggcgtggtggcctgggacatccccatcacctacggcgtgctgcccccccccagagagagccacaccgccgtggtgtacaccgagaaggacaacaagaagagcaagctggtgatctacggcggcatgagcggctgcagactgggcgacctgtggaccctggacatcgacaccctgacctggaacaagcccagcctgagcggcgtggcccccctgcccagaagcctgcacagcgccaccaccatcggcaacaagatgtacgtgttcggcggctgggtgcccctggtgatggacgacgtgaaggtggccacccacgagaaggagtggaagtgcaccaacaccctggcctgcctgaacctggacaccatggcctgggagaccatcctgatggacaccctggaggacaacatccccagagccagagccggccactgcgccgtggccatcaacaccagactgtacatctggagcggcagagacggctacagaaaggcctggaacaaccaggtgtgctgcaaggacctgtggtacctggagaccgagaagccccccccccccgccagagtgcagctggtgagagccaacaccaacagcctggaggtgagctggggcgccgtggccaccgccgacagctacctgctgcagctgcagaagtacgacatccccgccaccgccgccaccgccaccagccccacccccaaccccgtgcccagcgtgcccgccaacccccccaagagccccgcccccgccgccgccgcccccgccgtgcagcccctgacccaggtgggcatcaccctgctgccccaggccgcccccgccccccccaccaccaccaccatccaggtgctgcccaccgtgcccggcagcagcatcagcgtgcccaccgccgccagaacccagggcgtgcccgccgtgctgaaggtgaccggcccccaggccaccaccggcacccccctggtgaccatgagacccgccagccaggccggcaaggcccccgtgaccgtgaccagcctgcccgccggcgtgagaatggtggtgcccacccagagcgcccagggcaccgtgatcggcagcagcccccagatgagcggcatggccgccctggccgccgccgccgccgccacccagaagatcccccccagcagcgcccccaccgtgctgagcgtgcccgccggcaccaccatcgtgaagaccatggccgtgacccccggcaccaccaccctgcccgccaccgtgaaggtggccagcagccccgtgatggtgagcaaccccgccaccagaatgctgaagaccgccgccgcccaggtgggcaccagcgtgagcagcgccaccaacaccagcaccagacccatcatcaccgtgcacaagagcggcaccgtgaccgtggcccagcaggcccaggtggtgaccaccgtggtgggcggcgtgaccaagaccatcaccctggtgaagagccccatcagcgtgcccggcggcagcgccctgatcagcaacctgggcaaggtgatgagcgtggtgcagaccaagcccgtgcagaccagcgccgtgaccggccaggccagcaccggccccgtgacccagatcatccagaccaagggccccctgcccgccggcaccatcctgaagctggtgaccagcgccgacggcaagcccaccaccatcatcaccaccacccaggccagcggcgccggcaccaagcccaccatcctgggcatcagcagcgtgagccccagcaccaccaagcccggcaccaccaccatcatcaagaccatccccatgagcgccatcatcacccaggccggcgccaccggcgtgaccagcagccccggcatcaagagccccatcaccatcatcaccaccaaggtgatgaccagcggcaccggcgcccccgccaagatcatcaccgccgtgcccaagatcgccaccggccacggccagcagggcgtgacccaggtggtgctgaagggcgcccccggccagcccggcaccatcctgagaaccgtgcccatgggcggcgtgagactggtgacccccgtgaccgtgagcgccgtgaagcccgccgtgaccaccctggtggtgaagggcaccaccggcgtgaccaccctgggcaccgtgaccggcaccgtgagcaccagcctggccggcgccggcggccacagcaccagcgccagcctggccacccccatcaccaccctgggcaccatcgccaccctgagcagccaggtgatcaaccccaccgccatcaccgtgagcgccgcccagaccaccctgaccgccgccggcggcctgaccacccccaccatcaccatgcagcccgtgagccagcccacccaggtgaccctgatcaccgcccccagcggcgtggaggcccagcccgtgcacgacctgcccgtgagcatcctggccagccccaccaccgagcagcccaccgccaccgtgaccatcgccgacagcggccagggcgacgtgcagcccggcaccgtgaccctggtgtgcagcaaccccccctgcgagacccacgagaccggcaccaccaacaccgccaccaccaccgtggtggccaacctgggcggccacccccagcccacccaggtgcagttcgtgtgcgacagacaggaggccgccgccagcctggtgaccagcaccgtgggccagcagaacggcagcgtggtgagagtgtgcagcaaccccccctgcgagacccacgagaccggcaccaccaacaccgccaccaccgccaccagcaacatggccggccagcacggctgcagcaaccccccctgcgagacccacgagaccggcaccaccaacaccgccaccaccgccatgagcagcgtgggcgccaaccaccagagagacgccagaagagcctgcgccgccggcacccccgccgtgatcagaatcagcgtggccaccggcgccctggaggccgcccagggcagcaagagccagtgccagaccagacagaccagcgccaccagcaccaccatgaccgtgatggccaccggcgccccctgcagcgccggccccctgctgggccccagcatggccagagagcccggcggcagaagccccgccttcgtgcagctggcccccctgagcagcaaggtgagactgagcagccccagcatcaaggacctgcccgccggcagacacagccacgccgtgagcaccgccgccatgaccagaagcagcgtgggcgccggcgagcccagaatggcccccgtgtgcgagagcctgcagggcggcagccccagcaccaccgtgaccgtgaccgccctggaggccctgctgtgccccagcgccaccgtgacccaggtgtgcagcaaccccccctgcgagacccacgagaccggcaccaccaacaccgccaccaccagcaacgccggcagcgcccagagagtgtgcagcaaccccccctgcgagacccacgagaccggcaccacccacaccgccaccaccgccaccagcaacggcggcaccggccagcccgagggcggccagcagccccccgccggcagaccctgcgagacccaccagaccaccagcaccggcaccaccatgagcgtgagcgtgggcgccctgctgcccgacgccaccagcagccacagaaccgtggagagcggcctggaggtggccgccgcccccagcgtgaccccccaggccggcaccgccctgctggcccccttccccacccagagagtgtgcagcaaccccccctgcgagacccacgagaccggcaccacccacaccgccaccaccgtgaccagcaacatgagcagcaaccaggaccccccccccgccgccagcgaccagggcgaggtggagagcacccagggcgacagcgtgaacatcaccagcagcagcgccatcaccaccaccgtgagcagcaccctgaccagagccgtgaccaccgtgacccagagcacccccgtgcccggccccagcgtgcccccccccgaggagctgcaggtgagccccggccccagacagcagctgccccccagacagctgctgcagagcgccagcaccgccctgatgggcgagagcgccgaggtgctgagcgccagccagacccccgagctgcccgccgccgtggacctgagcagcaccggcgagcccagcagcggccaggagagcgccggcagcgccgtggtggccaccgtggtggtgcagccccccccccccacccagagcgaggtggaccagctgagcctgccccaggagctgatggccgaggcccaggccggcaccaccaccctgatggtgaccggcctgacccccgaggagctggccgtgaccgccgccgccgaggccgccgcccaggccgccgccaccgaggaggcccaggccctggccatccaggccgtgctgcaggccgcccagcaggccgtgatgggcaccggcgagcccatggacaccagcgaggccgccgccaccgtgacccaggccgagctgggccacctgagcgccgagggccaggagggccaggccaccaccatccccatcgtgctgacccagcaggagctggccgccctggtgcagcagcagcagctgcaggaggcccaggcccagcagcagcaccaccacctgcccaccgaggccctggcccccgccgacagcctgaacgaccccgccatcgagagcaactgcctgaacgagctggccggcaccgtgcccagcaccgtggccctgctgcccagcaccgccaccgagagcctggcccccagcaacaccttcgtggccccccagcccgtggtggtggccagccccgccaagctgcaggccgccgccaccctgaccgaggtggccaacggcatcgagagcctgggcgtgaagcccgacctgccccccccccccagcaaggcccccatgaagaaggagaaccagtggttcgacgtgggcgtgatcaagggcaccaacgtgatggtgacccactacttcctgccccccgacgacgccgtgcccagcgacgacgacctgggcaccgtgcccgactacaaccagctgaagaagcaggagctgcagcccggcaccgcctacaagttcagagtggccggcatcaacgcctgcggcagaggccccttcagcgagatcagcgccttcaagacctgcctgcccggcttccccggcgccccctgcgccatcaagatcagcaagagccccgacggcgcccacctgacctgggagccccccagcgtgaccagcggcaagatcatcgagtacagcgtgtacctggccatccagagcagccaggccggcggcgagctgaagagcagcacccccgcccagctggccttcatgagagtgtactgcggccccagccccagctgcctggtgcagagcagcagcctgagcaacgcccacatcgactacaccaccaagcccgccatcatcttcagaatcgccgccagaaacgagaagggctacggccccgccacccaggtgagatggctgcaggagaccagcaaggacagcagcggcaccaagcccgccaacaagagacccatgagcagccccgagatgaagagcgcccccaagaagagcaaggccgacggccagtag

SEQ ID NO: 84806 - DNA, 5901 bp, Artificial Sequence
  Description of Artificial Sequence: Synthetic coding sequence
atggccagcgccgtgagccccgccaacctgcccgccgtgctgctgcagcccagatggaagagagtggtgggctggagcggccccgtgcccagacccagacacggccacagagccgtggccatcaaggagctgatcgtggtgttcggcggcggcaacgagggcatcgtggacgagctgcacgtgtacaacaccgccaccaaccagtggttcatccccgccgtgagaggcgacatcccccccggctgcgccgcctacggcttcgtgtgcgacggcaccagactgctggtgttcggcggcatggtggagtacggcaagtacagcaacgacctgtacgagctgcaggccagcagatgggagtggaagagactgaaggccaagacccccaagaacggcccccccccctgccccagactgggccacagcttcagcctggtgggcaacaagtgctacctgttcggcggcctggccaacgacagcgaggaccccaagaacaacatccccagatacctgaacgacctgtacatcctggagctgagacccggcagcggcgtggtggcctgggacatccccatcacctacggcgtgctgcccccccccagagagagccacaccgccgtggtgtacaccgagaaggacaacaagaagagcaagctggtgatctacggcggcatgagcggctgcagactgggcgacctgtggaccctggacatcgacaccctgacctggaacaagcccagcctgagcggcgtggcccccctgcccagaagcctgcacagcgccaccaccatcggcaacaagatgtacgtgttcggcggctgggtgcccctggtgatggacgacgtgaaggtggccacccacgagaaggagtggaagtgcaccaacaccctggcctgcctgaacctggacaccatggcctgggagaccatcctgatggacaccctggaggacaacatccccagagccagagccggccactgcgccgtggccatcaacaccagactgtacatctggagcggcagagacggctacagaaaggcctggaacaaccaggtgtgctgcaaggacctgtggtacctggagaccgagaagccccccccccccgccagagtgcagctggtgagagccaacaccaacagcctggaggccgcccccgccccccccaccaccaccaccatccaggtgctgcccaccgtgcccggcagcagcatcagcgtgcccaccgccgccagaacccagggcgtgcccgccgtgctgaaggtgaccggcccccaggccaccaccggcacccccctggtgaccatgagacccgccagccaggccggcaaggcccccgtgaccgtgaccagcctgcccgccggcgtgagaatggtggtgcccacccagagcgcccagggcaccgtgatcggcagcagcccccagatgagcggcatggccgccctggccgccgccgccgccgccacccagaagatcccccccagcagcgcccccaccgtgctgagcgtgcccgccggcaccaccatcgtgaagaccatggccgtgacccccggcaccaccaccctgcccgccaccgtgaaggtggccagcagccccgtgatggtgagcaaccccgccaccagaatgctgaagaccgccgccgcccaggtgggcaccagcgtgagcagcgccaccaacaccagcaccagacccatcatcaccgtgcacaagagcggcaccgtgaccgtggcccagcaggcccaggtggtgaccaccgtggtgggcggcgtgaccaagaccatcaccctggtgaagagccccatcagcgtgcccggcggcagcgccctgatcagcaacctgggcaaggtgatgagcgtggtgcagaccaagcccgtgcagaccagcgccgtgaccggccaggccagcaccggccccgtgacccagatcatccagaccaagggccccctgcccgccggcaccatcctgaagctggtgaccagcgccgacggcaagcccaccaccatcatcaccaccacccaggccagcggcgccggcaccaagcccaccatcctgggcatcagcagcgtgagccccagcaccaccaagcccggcaccaccaccatcatcaagaccatccccatgagcgccatcatcacccaggccggcgccaccggcgtgaccagcagccccggcatcaagagccccatcaccatcatcaccaccaaggtgatgaccagcggcaccggcgcccccgccaagatcatcaccgccgtgcccaagatcgccaccggccacggccagcagggcgtgacccaggtggtgctgaagggcgcccccggccagcccggcaccatcctgagaaccgtgcccatgggcggcgtgagactggtgacccccgtgaccgtgagcgccgtgaagcccgccgtgaccaccctggtggtgaagggcaccaccggcgtgaccaccctgggcaccgtgaccggcaccgtgagcaccagcctggccggcgccggcggccacagcaccagcgccagcctggccacccccatcaccaccctgggcaccatcgccaccctgagcagccaggtgatcaaccccaccgccatcaccgtgagcgccgcccagaccaccctgaccgccgccggcggcctgaccacccccaccatcaccatgcagcccgtgagccagcccacccaggtgaccctgatcaccgcccccagcggcgtggaggcccagcccgtgcacgacctgcccgtgagcatcctggccagccccaccaccgagcagcccaccgccaccgtgaccatcgccgacagcggccagggcgacgtgcagcccggcaccgtgaccctggtgtgcagcaaccccccctgcgagacccacgagaccggcaccaccaacaccgccaccaccaccgtggtggccaacctgggcggccacccccagcccacccaggtgcagttcgtgtgcgacagacaggaggccgccgccagcctggtgaccagcaccgtgggccagcagaacggcagcgtggtgagagtgtgcagcaaccccccctgcgagacccacgagaccggcaccaccaacaccgccaccaccgccaccagcaacatggccggccagcacggctgcagcaaccccccctgcgagacccacgagaccggcaccaccaacaccgccaccaccgccatgagcagcgtgggcgccaaccaccagagagacgccagaagagcctgcgccgccggcacccccgccgtgatcagaatcagcgtggccaccggcgccctggaggccgcccagggcagcaagagccagtgccagaccagacagaccagcgccaccagcaccaccatgaccgtgatggccaccggcgccccctgcagcgccggccccctgctgggccccagcatggccagagagcccggcggcagaagccccgccttcgtgcagctggcccccctgagcagcaaggtgagactgagcagccccagcatcaaggacctgcccgccggcagacacagccacgccgtgagcaccgccgccatgaccagaagcagcgtgggcgccggcgagcccagaatggcccccgtgtgcgagagcctgcagggcggcagccccagcaccaccgtgaccgtgaccgccctggaggccctgctgtgccccagcgccaccgtgacccaggtgtgcagcaaccccccctgcgagacccacgagaccggcaccaccaacaccgccaccaccagcaacgccggcagcgcccagagagtgtgcagcaaccccccctgcgagacccacgagaccggcaccacccacaccgccaccaccgccaccagcaacggcggcaccggccagcccgagggcggccagcagccccccgccggcagaccctgcgagacccaccagaccaccagcaccggcaccaccatgagcgtgagcgtgggcgccctgctgcccgacgccaccagcagccacagaaccgtggagagcggcctggaggtggccgccgcccccagcgtgaccccccaggccggcaccgccctgctggcccccttccccacccagagagtgtgcagcaaccccccctgcgagacccacgagaccggcaccacccacaccgccaccaccgtgaccagcaacatgagcagcaaccaggaccccccccccgccgccagcgaccagggcgaggtggagagcacccagggcgacagcgtgaacatcaccagcagcagcgccatcaccaccaccgtgagcagcaccctgaccagagccgtgaccaccgtgacccagagcacccccgtgcccggccccagcgtgcccccccccgaggagctgcaggtgagccccggccccagacagcagctgccccccagacagctgctgcagagcgccagcaccgccctgatgggcgagagcgccgaggtgctgagcgccagccagacccccgagctgcccgccgccgtggacctgagcagcaccggcgagcccagcagcggccaggagagcgccggcagcgccgtggtggccaccgtggtggtgcagccccccccccccacccagagcgaggtggaccagctgagcctgccccaggagctgatggccgaggcccaggccggcaccaccaccctgatggtgaccggcctgacccccgaggagctggccgtgaccgccgccgccgaggccgccgcccaggccgccgccaccgaggaggcccaggccctggccatccaggccgtgctgcaggccgcccagcaggccgtgatgggcaccggcgagcccatggacaccagcgaggccgccgccaccgtgacccaggccgagctgggccacctgagcgccgagggccaggagggccaggccaccaccatccccatcgtgctgacccagcaggagctggccgccctggtgcagcagcagcagctgcaggaggcccaggcccagcagcagcaccaccacctgcccaccgaggccctggcccccgccgacagcctgaacgaccccgccatcgagagcaactgcctgaacgagctggccggcaccgtgcccagcaccgtggccctgctgcccagcaccgccaccgagagcctggcccccagcaacaccttcgtggccccccagcccgtggtggtggccagccccgccaagctgcaggccgccgccaccctgaccgaggtggccaacggcatcgagagcctgggcgtgaagcccgacctgccccccccccccagcaaggcccccatgaagaaggagaaccagtggttcgacgtgggcgtgatcaagggcaccaacgtgatggtgacccactacttcctgccccccgacgacgccgtgcccagcgacgacgacctgggcaccgtgcccgactacaaccagctgaagaagcaggagctgcagcccggcaccgcctacaagttcagagtggccggcatcaacgcctgcggcagaggccccttcagcgagatcagcgccttcaagacctgcctgcccggcttccccggcgccccctgcgccatcaagatcagcaagagccccgacggcgcccacctgacctgggagccccccagcgtgaccagcggcaagatcatcgagtacagcgtgtacctggccatccagagcagccaggccggcggcgagctgaagagcagcacccccgcccagctggccttcatgagagtgtactgcggccccagccccagctgcctggtgcagagcagcagcctgagcaacgcccacatcgactacaccaccaagcccgccatcatcttcagaatcgccgccagaaacgagaagggctacggccccgccacccaggtgagatggctgcaggagaccagcaaggacagcagcggcaccaagcccgccaacaagagacccatgagcagccccgagatgaagagcgcccccaagaagagcaaggccgacggccagtag

SEQ ID NO: 84807 - DNA, 6243 bp, Artificial Sequence
  Description of Artificial Sequence: Synthetic coding sequence
atggccagcgccgtgagccccgccaacctgcccgccgtgctgctgcagcccagatggaagagagtggtgggctggagcggccccgtgcccagacccagacacggccacagagccgtggccatcaaggagctgatcgtggtgttcggcggcggcaacgagggcatcgtggacgagctgcacgtgtacaacaccgccaccaaccagtggttcatccccgccgtgagaggcgacatcccccccggctgcgccgcctacggcttcgtgtgcgacggcaccagactgctggtgttcggcggcatggtggagtacggcaagtacagcaacgacctgtacgagctgcaggccagcagatgggagtggaagagactgaaggccaagacccccaagaacggcccccccccctgccccagactgggccacagcttcagcctggtgggcaacaagtgctacctgttcggcggcctggccaacgacagcgaggaccccaagaacaacatccccagatacctgaacgacctgtacatcctggagctgagacccggcagcggcgtggtggcctgggacatccccatcacctacggcgtgctgcccccccccagagagagccacaccgccgtggtgtacaccgagaaggacaacaagaagagcaagctggtgatctacggcggcatgagcggctgcagactgggcgacctgtggaccctggacatcgacaccctgacctggaacaagcccagcctgagcggcgtggcccccctgcccagaagcctgcacagcgccaccaccatcggcaacaagatgtacgtgttcggcggctgggtgcccctggtgatggacgacgtgaaggtggccacccacgagaaggagtggaagtgcaccaacaccctggcctgcctgaacctggacaccatggcctgggagaccatcctgatggacaccctggaggacaacatccccagagccagagccggccactgcgccgtggccatcaacaccagactgtacatctggagcggcagagacggctacagaaaggcctggaacaaccaggtgtgctgcaaggacctgtggtacctggagaccgagaagccccccccccccgccagagtgcagctggtgagagccaacaccaacagcctggaggtgagctggggcgccgtggccaccgccgacagctacctgctgcagctgcagaagtacgacatccccgccaccgccgccaccgccaccagccccacccccaaccccgtgcccagcgtgcccgccaacccccccaagagccccgcccccgccgccgccgcccccgccgtgcagcccctgacccaggtgggcatcaccctgctgccccaggccgcccccgccccccccaccaccaccaccatccaggtgctgcccaccgtgcccggcagcagcatcagcgtgcccaccgccgccagaacccagggcgtgcccgccgtgctgaaggtgaccggcccccaggccaccaccggcacccccctggtgaccatgagacccgccagccaggccggcaaggcccccgtgaccgtgaccagcctgcccgccggcgtgagaatggtggtgcccacccagagcgcccagggcaccgtgatcggcagcagcccccagatgagcggcatggccgccctggccgccgccgccgccgccacccagaagatcccccccagcagcgcccccaccgtgctgagcgtgcccgccggcaccaccatcgtgaagaccatggccgtgacccccggcaccaccaccctgcccgccaccgtgaaggtggccagcagccccgtgatggtgagcaaccccgccaccagaatgctgaagaccgccgccgcccaggtgggcaccagcgtgagcagcgccaccaacaccagcaccagacccatcatcaccgtgcacaagagcggcaccgtgaccgtggcccagcaggcccaggtggtgaccaccgtggtgggcggcgtgaccaagaccatcaccctggtgaagagccccatcagcgtgcccggcggcagcgccctgatcagcaacctgggcaaggtgatgagcgtggtgcagaccaagcccgtgcagaccagcgccgtgaccggccaggccagcaccggccccgtgacccagatcatccagaccaagggccccctgcccgccggcaccatcctgaagctggtgaccagcgccgacggcaagcccaccaccatcatcaccaccacccaggccagcggcgccggcaccaagcccaccatcctgggcatcagcagcgtgagccccagcaccaccaagcccggcaccaccaccatcatcaagaccatccccatgagcgccatcatcacccaggccggcgccaccggcgtgaccagcagccccggcatcaagagccccatcaccatcatcaccaccaaggtgatgaccagcggcaccggcgcccccgccaagatcatcaccgccgtgcccaagatcgccaccggccacggccagcagggcgtgacccaggtggtgctgaagggcgcccccggccagcccggcaccatcctgagaaccgtgcccatgggcggcgtgagactggtgacccccgtgaccgtgagcgccgtgaagcccgccgtgaccaccctggtggtgaagggcaccaccggcgtgaccaccctgggcaccgtgaccggcaccgtgagcaccagcctggccggcgccggcggccacagcaccagcgccagcctggccacccccatcaccaccctgggcaccatcgccaccctgagcagccaggtgatcaaccccaccgccatcaccgtgagcgccgcccagaccaccctgaccgccgccggcggcctgaccacccccaccatcaccatgcagcccgtgagccagcccacccaggtgaccctgatcaccgcccccagcggcgtggaggcccagcccgtgcacgacctgcccgtgagcatcctggccagccccaccaccgagcagcccaccgccaccgtgaccatcgccgacagcggccagggcgacgtgcagcccggcaccgtgaccctggtgtgcagcaaccccccctgcgagacccacgagaccggcaccaccaacaccgccaccaccaccgtggtggccaacctgggcggccacccccagcccacccaggtgcagttcgtgtgcgacagacaggaggccgccgccagcctggtgaccagcaccgtgggccagcagaacggcagcgtggtgagagtgtgcagcaaccccccctgcgagacccacgagaccggcaccaccaacaccgccaccaccgccaccagcaacatggccggccagcacggctgcagcaaccccccctgcgagacccacgagaccggcaccaccaacaccgccaccaccgccatgagcagcgtgggcgccaaccaccagagagacgccagaagagcctgcgccgccggcacccccgccgtgatcagaatcagcgtggccaccggcgccctggaggccgcccagggcagcaagagccagtgccagaccagacagaccagcgccaccagcaccaccatgaccgtgatggccaccggcgccccctgcagcgccggccccctgctgggccccagcatggccagagagcccggcggcagaagccccgccttcgtgcagctggcccccctgagcagcaaggtgagactgagcagccccagcatcaaggacctgcccgccggcagacacagccacgccgtgagcaccgccgccatgaccagaagcagcgtgggcgccggcgagcccagaatggcccccgtgtgcgagagcctgcagggcggcagccccagcaccaccgtgaccgtgaccgccctggaggccctgctgtgccccagcgccaccgtgacccaggtgtgcagcaaccccccctgcgagacccacgagaccggcaccaccaacaccgccaccaccagcaacgccggcagcgcccagagagtgtgcagcaaccccccctgcgagacccacgagaccggcaccacccacaccgccaccaccgccaccagcaacggcggcaccggccagcccgagggcggccagcagccccccgccggcagaccctgcgagacccaccagaccaccagcaccggcaccaccatgagcgtgagcgtgggcgccctgctgcccgacgccaccagcagccacagaaccgtggagagcggcctggaggtggccgccgcccccagcgtgaccccccaggccggcaccgccctgctggcccccttccccacccagagagtgtgcagcaaccccccctgcgagacccacgagaccggcaccacccacaccgccaccaccgtgaccagcaacatgagcagcaaccaggaccccccccccgccgccagcgaccagggcgaggtggagagcacccagggcgacagcgtgaacatcaccagcagcagcgccatcaccaccaccgtgagcagcaccctgaccagagccgtgaccaccgtgacccagagcacccccgtgcccggccccagcgtgcccaagatcagcagcatgaccgagaccgcccccagagccctgaccaccgaggtgcccatccccgccaagatcaccgtgaccatcgccaacaccgagaccagcgacatgcccttcagcgccgtggacatcctgcagccccccgaggagctgcaggtgagccccggccccagacagcagctgccccccagacagctgctgcagagcgccagcaccgccctgatgggcgagagcgccgaggtgctgagcgccagccagacccccgagctgcccgccgccgtggacctgagcagcaccggcgagcccagcagcggccaggagagcgccggcagcgccgtggtggccaccgtggtggtgcagccccccccccccacccagagcgaggtggaccagctgagcctgccccaggagctgatggccgaggcccaggccggcaccaccaccctgatggtgaccggcctgacccccgaggagctggccgtgaccgccgccgccgaggccgccgcccaggccgccgccaccgaggaggcccaggccctggccatccaggccgtgctgcaggccgcccagcaggccgtgatggccggcaccggcgagcccatggacaccagcgaggccgccgccaccgtgacccaggccgagctgggccacctgagcgccgagggccaggagggccaggccaccaccatccccatcgtgctgacccagcaggagctggccgccctggtgcagcagcagcagctgcaggaggcccaggcccagcagcagcaccaccacctgcccaccgaggccctggcccccgccgacagcctgaacgaccccgccatcgagagcaactgcctgaacgagctggccggcaccgtgcccagcaccgtggccctgctgcccagcaccgccaccgagagcctggcccccagcaacaccttcgtggccccccagcccgtggtggtggccagccccgccaagctgcaggccgccgccaccctgaccgaggtggccaacggcatcgagagcctgggcgtgaagcccgacctgccccccccccccagcaaggcccccatgaagaaggagaaccagtggttcgacgtgggcgtgatcaagggcaccaacgtgatggtgacccactacttcctgccccccgacgacgccgtgcccagcgacgacgacctgggcaccgtgcccgactacaaccagctgaagaagcaggagctgcagcccggcaccgcctacaagttcagagtggccggcatcaacgcctgcggcagaggccccttcagcgagatcagcgccttcaagacctgcctgcccggcttccccggcgccccctgcgccatcaagatcagcaagagccccgacggcgcccacctgacctgggagccccccagcgtgaccagcggcaagatcatcgagtacagcgtgtacctggccatccagagcagccaggccggcggcgagctgaagagcagcacccccgcccagctggccttcatgagagtgtactgcggccccagccccagctgcctggtgcagagcagcagcctgagcaacgcccacatcgactacaccaccaagcccgccatcatcttcagaatcgccgccagaaacgagaagggctacggccccgccacccaggtgagatggctgcaggagaccagcaaggacagcagcggcaccaagcccgccaacaagagacccatgagcagccccgagatgaagagcgcccccaagaagagcaaggccgacggccagtag

SEQ ID NO: 84808 - DNA, 1305 bp, Artificial Sequence
  Description of Artificial Sequence: Synthetic coding sequence
atggacagcgtggagaagggcgccgccaccagcgtgagcaaccccagaggcagacccagcagaggcagaccccccaagctgcagagaaacagcagaggcggccagggcagaggcgtggagaagcccccccacctggccgccctgatcctggccagaggcggcagcaagggcatccccctgaagaacatcaagcacctggccggcgtgcccctgatcggctgggtgctgagagccgccctggacagcggcgccttccagagcgtgtgggtgagcaccgaccacgacgagatcgagaacgtggccaagcagttcggcgcccaggtgcacagaagaagcagcgaggtgagcaaggacagcagcaccagcctggacgccatcatcgagttcctgaactaccacaacgaggtggacatcgtgggcaacatccaggccaccagcccctgcctgcaccccaccgacctgcagaaggtggccgagatgatcagagaggagggctacgacagcgtgttcagcgtggtgagaagacaccagttcagatggagcgagatccagaagggcgtgagagaggtgaccgagcccctgaacctgaaccccgccaagagacccagaagacaggactgggacggcgagctgtacgagaacggcagcttctacttcgccaagagacacctgatcgagatgggctacctgcagggcggcaagatggcctactacgagatgagagccgagcacagcgtggacatcgacgtggacatcgactggcccatcgccgagcagagagtgctgagatacggctacttcggcaaggagaagctgaaggagatcaagctgctggtgtgcaacatcgacggctgcctgaccaacggccacatctacgtgagcggcgaccagaaggagatcatcagctacgacgtgaaggacgccatcggcatcagcctgctgaagaagagcggcatcgaggtgagactgatcagcgagagagcctgcagcaagcagaccctgagcagcctgaagctggactgcaagatggaggtgagcgtgagcgacaagctggccgtggtggacgagtggagaaaggagatgggcctgtgctggaaggaggtggcctacctgggcaacgaggtgagcgacgaggagtgcctgaagagagtgggcctgagcggcgcccccgccgacgcctgcagcaccgcccagaaggccgtgggctacatctgcaagtgcaacggcggcagaggcgccatcagagagttcgccgagcacatctgcctgctgatggagaaggtgaacaacagctgccagaagtag

SEQ ID NO: 84809 - DNA, 507 bp, Artificial Sequence
  Description of Artificial Sequence: Synthetic coding sequence
atggccttcaacgactgcttcagcctgaactaccccggcaacccctgccccggcgacctgatcgaggtgttcagacccggctaccagcactgggccctgtacctgggcgacggctacgtgatcaacatcgcccccgtggacggcatccccgccagcttcaccagcgccaagagcgtgttcagcagcaaggccctggtgaagatgcagctgctgaaggacgtggtgggcaacgacacctacagaatcaacaacaagtacgacgagacctacccccccctgcccgtggaggagatcatcaagagaagcgagttcgtgatcggccaggaggtggcctacaacctgctggtgaacaactgcgagcacttcgtgaccctgctgagatacggcgagggcgtgagcgagcaggccaacagagccatcagcaccgtggagttcgtgaccgccgccgtgggcgtgttcagcttcctgggcctgttccccaagggccagagagccaagtactactag

SEQ ID NO: 84810 - DNA, 489 bp, Artificial Sequence
  Description of Artificial Sequence: Synthetic coding sequence
atggccctggccagacccagacccagactgggcgacctgatcgagatcagcagattcggctacgcccactgggccatctacgtgggcgacggctacgtggtgcacctggcccccgccagcgagatcgccggcgccggcgccgccagcgtgctgagcgccctgaccaacaaggccatcgtgaagaaggagctgctgagcgtggtggccggcggcgacaactacagagtgaacaacaagcacgacgacagatacacccccctgcccagcaacaagatcgtgaagagagccgaggagctggtgggccaggagctgccctacagcctgaccagcgacaactgcgagcacttcgtgaaccacctgagatacggcgtgagcagaagcgaccaggtgaccggcgccgtgaccaccgtgggcgtggccgccggcctgctggccgccgccagcctggtgggcatcctgctggccagaagcaagagagagagacagtag

SEQ ID NO: 84811 - DNA, 1023 bp, Artificial Sequence
  Description of Artificial Sequence: Synthetic coding sequence
atgaaggaggaccaggtggtggccgaggagcccggcttccaggacgaggaggagagcctgttccaggacatcgacctgctgcagaagcacggcatcaacgtggccgacatcaagaagctgaagagcgtgggcatctgcaccatcaagggcatccagatgaccaccagaagagccctgtgcaacgtgaagggcctgagcgaggccaaggtggacaagatcaaggaggccgccaacaagctgatcgagcccggcttcctgaccgccttcgagtacagcgagaagagaaagatggtgttccacatcaccaccggcagccaggagttcgacaagctgctgggcggcggcatcgagagcatggccatcaccgaggccttcggcgagttcagaaccggcaagacccagctgagccacaccctgtgcgtgaccgcccagctgcccggcgccggcggctaccccggcggcaagatcatcttcatcgacaccgagaacaccttcagacccgacagactgagagacatcgccgacagattcaacgtggaccacgacgccgtgctggacaacgtgctgtacgccagagcctacaccagcgagcaccagatggagctgctggactacgtggccgccaagttccacgaggaggccggcatcttcaagctgctgatcatcgacagcatcatggccctgttcagagtggacttcagcggcagaggcgagctggccgagagacagcagaagctggcccagatgctgagcagactgcagaagatcagcgaggagtacaacgtggccgtgttcgtgaccaaccagatgaccgccgaccccggcgccaccatgaccttccaggccgaccccaagaagcccatcggcggccacatcctggcccacgccagcaccaccagaatcagcctgagaaagggcagaggcgagctgagaatcgccaagatctacgacagccccgagatgcccgagaacgaggccaccttcgccatcaccgccggcggcatcggcgacgccaaggagtag

SEQ ID NO: 84812 - DNA, 1080 bp, Artificial Sequence
  Description of Artificial Sequence: Synthetic coding sequence
atgagcgacgagggcagcagaggcagcagactgcccctggccctgccccccgccagccagggctgcagcagcggcggcggcggcggcggcagcagcgccggcggcagcggcaacagcagaccccccagaaacctgcagggcctgctgcagatggccatcaccgccggcagcgaggagcccgaccccccccccgagcccatgagcgaggagagaagacagtggctgcaggaggccatgagcgccgccttcagaggccagagagaggaggtggagcagatgaagagctgcctgagagtgctgagccagcccatgccccccaccgccggcgaggccgagcaggccgccgaccagcaggagagagagggcgccctggagctgctggccgacctgtgcgagaacatggacaacgccgccgacttctgccagctgagcggcatgcacctgctggtgggcagatacctggaggccggcgccgccggcctgagatggagagccgcccagctgatcggcacctgcagccagaacgtggccgccatccaggagcaggtgctgggcctgggcgccctgagaaagctgctgagactgctggacagagacgcctgcgacaccgtgagagtgaaggccctgttcgccatcagctgcctggtgagagagcaggaggccggcctgctgcagttcctgagactggacggcttcagcgtgctgatgagagccatgcagcagcaggtgcagaagctgaaggtgaagagcgccttcctgctgcagaacctgctggtgggccaccccgagcacaagggcaccctgtgcagcatgggcatggtgcagcagctggtggccctggtgagaaccgagcacagccccttccacgagcacgtgctgggcgccctgtgcagcctggtgaccgacttcccccagggcgtgagagagtgcagagagcccgagctgggcctggaggagctgctgagacacagatgccagctgctgcagcagcacgaggagtaccaggaggagctggagttctgcgagaagctgctgcagacctgcttcagcagccccgccgacgacagcatggacagatag

SEQ ID NO: 84813 - DNA, 774 bp, Artificial Sequence
  Description of Artificial Sequence: Synthetic coding sequence
atgagcgacgagggcagcagaggcagcagactgcccctggccctgccccccgccagccagggctgcagcagcggcggcggcggcggcggcagcagcgccggcggcagcggcaacagcagaccccccagaaacctgcagggcctgctgcagatggccatcaccgccggcagcgaggagcccgaccccccccccgagcccatgagcgaggagagaagacagtggctgcaggaggccatgagcgccgccttcagaggccagagagaggaggtggagcagatgaagagctgcctgagagtgctgagccagcccatgccccccaccgccggcgaggccgagcaggccgccgaccagcaggagagagagggcgccctggagctgctggccgacctgtgcgagaacatggacaacgccgccgacttctgccagctgagcggcatgcacctgctggtgggcagatacctggaggccggcgccgccggcctgagatggagagccgcccagctgatcggcacctgcagccagaacgtggccgccatccaggagcaggtgctgggcctgggcgccctgagaaagctgctgagactgctggacagagacgcctgcgacaccggcgtgagagagtgcagagagcccgagctgggcctggaggagctgctgagacacagatgccagctgctgcagcagcacgaggagtaccaggaggagctggagttctgcgagaagctgctgcagacctgcttcagcagccccgccgacgacagcatggacagatag

SEQ ID NO: 84814 - DNA, 1080 bp, Artificial Sequence; identical to SEQ ID NO: 84812
  Description of Artificial Sequence: Synthetic coding sequence

SEQ ID NO: 84815 - DNA, 1443 bp, Artificial Sequence
  Description of Artificial Sequence: Synthetic coding sequence
atgcagatccccagagccgccctgctgcccctgctgctgctgctgctggccgcccccgccagcgcccagctgagcagagccggcagaagcgcccccctggccgccggctgccccgacagatgcgagcccgccagatgccccccccagcccgagcactgcgagggcggcagagccagagacgcctgcggctgctgcgaggtgtgcggcgcccccgagggcgccgcctgcggcctgcaggagggcccctgcggcgagggcctgcagtgcgtggtgcccttcggcgtgcccgccagcgccaccgtgagaagaagagcccaggccggcctgtgcgtgtgcgccagcagcgagcccgtgtgcggcagcgacgccaacacctacgccaacctgtgccagctgagagccgccagcagaagaagcgagagactgcacagaccccccgtgatcgtgctgcagagaggcgcctgcggccagggccaggaggaccccaacagcctgagacacaagtacaacttcatcgccgacgtggtggagaagatcgcccccgccgtggtgcacatcgagctgttcagaaagctgcccttcagcaagagagaggtgcccgtggccagcggcagcggcttcatcgtgagcgaggacggcctgatcgtgaccaacgcccacgtggtgaccaacaagcacagagtgaaggtggagctgaagaacggcgccacctacgaggccaagatcaaggacgtggacgagaaggccgacatcgccctgatcaagatcgaccaccagggcaagctgcccgtgctgctgctgggcagaagcagcgagctgagacccggcgagttcgtggtggccatcggcagccccttcagcctgcagaacaccgtgaccaccggcatcgtgagcaccacccagagaggcggcaaggagctgggcctgagaaacagcgacatggactacatccagaccgacgccatcatcaactacggcaacagcggcggccccctggtgaacctggacggcgaggtgatcggcatcaacaccctgaaggtgaccgccggcatcagcttcgccatccccagcgacaagatcaagaagttcctgaccgagagccacgacagacaggccaagggcaaggccatcaccaagaagaagtacatcggcatcagaatgatgagcctgaccagcagcaaggccaaggagctgaaggacagacacagagacttccccgacgtgatcagcggcgcctacatcatcgaggtgatccccgacacccccgccgaggccggcggcctgaaggagaacgacgtgatcatcagcatcaacggccagagcgtggtgagcgccaacgacgtgagcgacgtgatcaagagagagagcaccctgaacatggtggtgagaagaggcaacgaggacatcatgatcaccgtgatccccgaggagatcgacccctag

SEQ ID NO: 84816 - DNA, 666 bp, Artificial Sequence
  Description of Artificial Sequence: Synthetic coding sequence
ggcaagctgcccgtgctgctgctgggcagaagcagcgagctgagacccggcgagttcgtggtggccatcggcagccccttcagcctgcagaacaccgtgaccaccggcatcgtgagcaccacccagagaggcggcaaggagctgggcctgagaaacagcgacatggactacatccagaccgacgccatcatcaactacggcaacagcggcggccccctggtgaacctggacggcgaggtgatcggcatcaacaccctgaaggtgaccgccggcatcagcttcgccatccccagcgacaagatcaagaagttcctgaccgagagccacgacagacaggccaagggcaaggccatcaccaagaagaagtacatcggcatcagaatgatgagcctgaccagcagcaaggccaaggagctgaaggacagacacagagacttccccgacgtgatcagcggcgcctacatcatcgaggtgatccccgacacccccgccgaggccggcggcctgaaggagaacgacgtgatcatcagcatcaacggccagagcgtggtgagcgccaacgacgtgagcgacgtgatcaagagagagagcaccctgaacatggtggtgagaagaggcaacgaggacatcatgatcaccgtgatccccgaggagatcgacccctag

SEQ ID NO: 84817 - DNA, 1344 bp, Artificial Sequence
  Description of Artificial Sequence: Synthetic coding sequence
atgggctgggccgccagacccagagccctggcccccgccgcccccgaggccctgctgcacagccccagaagaagaagccccgccctggccctgagcgccgccaccgccgccgccgccagaggccccggcagagtgagactgctgagaggcgtgagaagagccagaggcagaagagtgagacccgccggcggccccgtgagaagaggcgccgccgtgagaggcgccctgagaggcgccagcctgggccacggcgccgccgccagagccggcagacccctgtgcgtgagacagcagctgagagccgccagcagaagaagcgagagactgcacagaccccccgtgatcgtgctgcagagaggcgcctgcggccagggccaggaggaccccaacagcctgagacacaagtacaacttcatcgccgacgtggtggagaagatcgcccccgccgtggtgcacatcgagctgttcagaaagctgcccttcagcaagagagaggtgcccgtggccagcggcagcggcttcatcgtgagcgaggacggcctgatcgtgaccaacgcccacgtggtgaccaacaagcacagagtgaaggtggagctgaagaacggcgccacctacgaggccaagatcaaggacgtggacgagaaggccgacatcgccctgatcaagatcgaccaccagggcaagctgcccgtgctgctgctgggcagaagcagcgagctgagacccggcgagttcgtggtggccatcggcagccccttcagcctgcagaacaccgtgaccaccggcatcgtgagcaccacccagagaggcggcaaggagctgggcctgagaaacagcgacatggactacatccagaccgacgccatcatcaactacggcaacagcggcggccccctggtgaacctggacggcgaggtgatcggcatcaacaccctgaaggtgaccgccggcatcagcttcgccatccccagcgacaagatcaagaagttcctgaccgagagccacgacagacaggccaagggcaaggccatcaccaagaagaagtacatcggcatcagaatgatgagcctgaccagcagcaaggccaaggagctgaaggacagacacagagacttccccgacgtgatcagcggcgcctacatcatcgaggtgatccccgacacccccgccgaggccggcggcctgaaggagaacgacgtgatcatcagcatcaacggccagagcgtggtgagcgccaacgacgtgagcgacgtgatcaagagagagagcaccctgaacatggtggtgagaagaggcaacgaggacatcatgatcaccgtgatccccgaggagatcgacccctag

SEQ ID NO: 84818 - DNA, 1377 bp, Artificial Sequence
  Description of Artificial Sequence: Synthetic coding sequence
atggccgcccccagagccggcagaggcgccggctggagcctgagagcctggagagccctgggcggcatcagatggggcagaagacccagactgacccccgacctgagagccctgctgaccagcggcaccagcgaccccagagccagagtgacctacggcacccccagcctgtgggccagactgagcgtgggcgtgaccgagcccagagcctgcctgaccagcggcacccccggccccagagcccagctgaccgccgtgacccccgacaccagaaccagagaggccagcgagaacagcggcaccagaagcagagcctggctggccgtggccctgggcgccggcggcgccgtgctgctgctgctgtggggcggcggcagaggcccccccgccgtgctggccgccgtgcccagccccccccccgccagccccagaagccagtacaacttcatcgccgacgtggtggagaagaccgcccccgccgtggtgtacatcgagatcctggacagacaccccttcctgggcagagaggtgcccatcagcaacggcagcggcttcgtggtggccgccgacggcctgatcgtgaccaacgcccacgtggtggccgacagaagaagagtgagagtgagactgctgagcggcgacacctacgaggccgtggtgaccgccgtggaccccgtggccgacatcgccaccctgagaatccagaccaaggagcccctgcccaccctgcccctgggcagaagcgccgacgtgagacagggcgagttcgtggtggccatgggcagccccttcgccctgcagaacaccatcaccagcggcatcgtgagcagcgcccagagacccgccagagacctgggcctgccccagaccaacgtggagtacatccagaccgacgccgccatcgacttcggcaacagcggcggccccctggtgaacctggacggcgaggtgatcggcgtgaacaccatgaaggtgaccgccggcatcagcttcgccatccccagcgacagactgagagagttcctgcacagaggcgagaagaagaacagcagcagcggcatcagcggcagccagagaagatacatcggcgtgatgatgctgaccctgagccccagcatcctggccgagctgcagctgagagagcccagcttccccgacgtgcagcacggcgtgctgatccacaaggtgatcctgggcagccccgcccacagagccggcctgagacccggcgacgtgatcctggccatcggcgagcagatggtgcagaacgccgaggacgtgtacgaggccgtgagaacccagagccagctggccgtgcagatcagaagaggcagagagaccctgaccctgtacgtgacccccgaggtgaccgagtag

SEQ ID NO: 84819 - DNA, 1086 bp, Artificial Sequence
  Description of Artificial Sequence: Synthetic coding sequence
atggccgcccccagagccggcagaggcgccggctggagcctgagagcctggagagccctgggcggcatcagatggggcagaagacccagactgacccccgacctgagagccctgctgaccagcggcaccagcgaccccagagccagagtgacctacggcacccccagcctgtgggccagactgagcgtgggcgtgaccgagcccagagcctgcctgaccagcggcacccccggccccagagcccagctgaccgccgtgacccccgacaccagaaccagagaggccagcgagaacagcggcaccagaagcagagcctggctggccgtggccctgggcgccggcggcgccgtgctgctgctgctgtggggcggcggcagaggcccccccgccgtgctggccgccgtgcccagccccccccccgccagccccagaagccagtacaacttcatcgccgacgtggtggagaagaccgcccccgccgtggtgtacatcgagatcctggacagacaccccttcctgggcagagaggtgcccatcagcaacggcagcggcttcgtggtggccgccgacggcctgatcgtgaccaacgcccacgtggtggccgacagaagaagagtgagagtgagactgctgagcggcgacacctacgaggccgtggtgaccgccgtggaccccgtggccgacatcgccaccctgagaatccagaccaagttcggcaacagcggcggccccctggtgaacctggacggcgaggtgatcggcgtgaacaccatgaaggtgaccgccggcatcagcttcgccatccccagcgacagactgagagagttcctgcacagaggcgagaagaagaacagcagcagcggcatcagcggcagccagagaagatacatcggcgtgatgatgctgaccctgagccccagagccggcctgagacccggcgacgtgatcctggccatcggcgagcagatggtgcagaacgccgaggacgtgtacgaggccgtgagaacccagagccagctggccgtgcagatcagaagaggcagagagaccctgaccctgtacgtgacccccgaggtgaccgagtag

SEQ ID NO: 84820 - DNA, 1362 bp, Artificial Sequence
  Description of Artificial Sequence: Synthetic coding sequence
atgcaggccagagccctgctgctggccgccctggccgccctggccctggccagagagccccccgccgccccctgccccgccagatgcgacgtgagcagatgccccagccccagatgccccggcggctacgtgcccgacctgtgcaactgctgcctggtgtgcgccgccagcgagggcgagccctgcggcggccccctggacagcccctgcggcgagagcctggagtgcgtgagaggcctgtgcagatgcagatggagccacgccgtgtgcggcaccgacggccacacctacgccaacgtgtgcgccctgcaggccgccagcagaagagccctgcagctgagcggcacccccgtgagacagctgcagaagggcgcctgccccctgggcctgcaccagctgagcagccccagatacaagttcaacttcatcgccgacgtggtggagaagatcgcccccgccgtggtgcacatcgagctgttcctgagacaccccctgttcggcagaaacgtgcccctgagcagcggcagcggcttcatcatgagcgaggccggcctgatcatcaccaacgcccacgtggtgagcagcaacagcgccgcccccggcagacagcagctgaaggtgcagctgcagaacggcgacagctacgaggccaccatcaaggacatcgacaagaagagcgacatcgccaccatcaagatccaccccaagaagaagctgcccgtgctgctgctgggccacagcgccgacctgagacccggcgagttcgtggtggccatcggcagccccttcgccctgcagaacaccgtgaccaccggcatcgtgagcaccgcccagagagagggcagagagctgggcctgagagacagcgacatggactacatccagaccgacgccatcatcaactacggcaacagcggcggccccctggtgaacctggacggcgaggtgatcggcatcaacaccctgaaggtgaccgccggcatcagcttcgccatccccagcgacagaatcaccagattcctgaccgagttccaggacaagcagatcaaggactggaagaagagattcatcggcatcagaatgagaaccatcacccccagcctggtggacgagctgaaggccagcaaccccgacttccccgaggtgagcagcggcatctacgtgcaggaggtggcccccaacagccccagccagagaggcggcatccaggacggcgacatcatcgtgaaggtgaacggcagacccctggtggacagcagcgagctgcaggaggccgtgctgaccgagagccccctgctgctggaggtgagaagaggcaacgacgacctgctgttcagcatcgcccccgaggtggtgatgtag

SEQ ID NO: 84821 - DNA, 1431 bp, Artificial Sequence
  Description of Artificial Sequence: Synthetic coding sequence
atgatcagaccccagctgagaaccgccggcctgggcagatgcctgctgcccggcctgctgctgctgctggtgcccgtgctgtgggccggcgccgagaagctgcacacccagcccagctgccccgccgtgtgccagcccaccagatgccccgccctgcccacctgcgccctgggcaccacccccgtgttcgacctgtgcagatgctgcagagtgtgccccgccgccgagagagaggtgtgcggcggcgcccagggccagccctgcgcccccggcctgcagtgcctgcagcccctgagacccggcttccccagcacctgcggctgccccaccctgggcggcgccgtgtgcggcagcgacagaagaacctaccccagcatgtgcgccctgagagccgagaacagagccgccagaagactgggcaaggtgcccgccgtgcccgtgcagtggggcaactgcggcgacaccggcaccagaagcgccggccccctgagaagaaactacaacttcatcgccgccgtggtggagaaggtggcccccagcgtggtgcacgtgcagctgtggggcagactgctgcacggcagcagactggtgcccgtgtacagcggcagcggcttcatcgtgagcgaggacggcctgatcatcaccaacgcccacgtggtgagaaaccagcagtggatcgaggtggtgctgcagaacggcgccagatacgaggccgtggtgaaggacatcgacctgaagctggacctggccgtgatcaagatcgagagcaacgccgagctgcccgtgctgatgctgggcagaagcagcgacctgagagccggcgagttcgtggtggccctgggcagccccttcagcctgcagaacaccgccaccgccggcatcgtgagcaccaagcagagaggcggcaaggagctgggcatgaaggacagcgacatggactacgtgcagatcgacgccaccatcaactacggcaacagcggcggccccctggtgaacctggacggcgacgtgatcggcgtgaacagcctgagagtgaccgacggcatcagcttcgccatccccagcgacagagtgagacagttcctggccgagtaccacgagcaccagatgaagggcaaggccttcagcaacaagaagtacctgggcctgcagatgctgagcctgaccgtgcccctgagcgaggagctgaagatgcactaccccgacttccccgacgtgagcagcggcgtgtacgtgtgcaaggtggtggagggcaccgccgcccagagcagcggcctgagagaccacgacgtgatcgtgaacatcaacggcaagcccatcaccaccaccaccgacgtggtgaaggccctggacagcgacagcctgagcatggccgtgctgagaggcaaggacaacctgctgctgaccgtgatccccgagaccatcaactag

SEQ ID NO: 84822 - DNA, 8157 bp, Artificial Sequence
  Description of Artificial Sequence: Synthetic coding sequence
atgcccagaaccaagcagatccaccccagaaacctgagagacaagatcgaggaggcccagaaggagctgaacggcgccgaggtgagcaagaaggagatcctgcaggccggcgtgaagggcaccagcgagagcctgaagggcgtgaagagaaagaagatcgtggccgagaaccacctgaagaagatccccaagagccccctgagaaaccccctgcaggccaagcacaagcagaacaccgaggagagcagcttcgccgtgctgcacagcgccagcgagagccacaagaagcagaactacatccccgtgaagaacggcaagcagttcaccaagcagaacggcgagacccccggcatcatcgccgaggccagcaagagcgaggagagcgtgagccccaagaagcccctgttcctgcagcagcccagcgagctgagaagatggagaagcgagggcgccgaccccgccaagttcagcgacctggacgagcagtgcgacagcagcagcctgagcagcaagaccagaaccgacaacagcgagtgcatcagcagccactgcggcaccaccagccccagctacaccaacaccgccttcgacgtgctgctgaaggccatggagcccgagctgagcaccctgagccagaagggcagcccctgcgccatcaagaccgagaagctgagacccaacaagaccgccagaagcccccccaagctgaagaacagcagcatggacgcccccaaccagaccagccaggagctggtggccgagagccagagcagctgcaccagctacaccgtgcacatgagcgccgcccagaagaacgagcagggcgccatgcagagcgccagccacctgtaccaccagcacgagcacttcgtgcccaagagcaaccagcacaaccagcagctgcccggctgcagcggcttcaccggcagcctgaccaacctgcagaaccaggagaacgccaagctggagcaggtgtacaacatcgccgtgaccagcagcgtgggcctgaccagccccagcagcagaagccaggtgaccccccagaaccagcagatggacagcgccagccccctgagcatcagccccgccaacagcacccagagcccccccatgcccatctacaacagcacccacgtggccagcgtggtgaaccagagcgtggagcagatgtgcaacctgctgctgaaggaccagaagcccaagaagcagggcaagtacatctgcgagtactgcaacagagcctgcgccaagcccagcgtgctgctgaagcacatcagaagccacaccggcgagagaccctacccctgcgtgacctgcggcttcagcttcaagaccaagagcaacctgtacaagcacaagaagagccacgcccacaccatcaagctgggcctggtgctgcagcccgacgccggcggcctgttcctgagccacgagagccccaaggccctgagcatccacagcgacgtggaggacagcggcgagagcgaggaggagggcgccaccgacgagagacagcacgacctgggcgccatggagctgcagcccgtgcacatcatcaagagaatgagcaacgccgagaccctgctgaagagcagcttcacccccagcagccccgagaacgtgatcggcgacttcctgctgcaggacagaagcgccgagagccaggccgtgaccgagctgcccaaggtggtggtgcaccacgtgaccgtgagccccctgagaaccgacagccccaaggccatggaccccaagcccgagctgagcagcgcccagaagcagaaggacctgcaggtgaccaacgtgcagcccctgagcgccaacatgagccagggcggcgtgagcagactggagaccaacgagaacagccaccagaagggcgacatgaaccccctggagggcaagcaggacagccacgtgggcaccgtgcacgcccagctgcagagacagcaggccaccgactacagccaggagcagcagggcaagctgctgagccccagaagcctgggcagcaccgacagcggctacttcagcagaagcgagagcgccgaccagaccgtgagcccccccacccccttcgccagaagactgcccagcaccgagcaggacagcggcagaagcaacggccccagcgccgccctggtgaccaccagcacccccagcgccctgcccaccggcgagaaggccctgctgctgcccggccagatgagaccccccctggccaccaagaccctggaggagagaatcagcaagctgatcagcgacaacgaggccctggtggacgacaagcagctggacagcgtgaagcccagaagaaccagcctgagcagaagaggcagcatcgacagccccaagagctacatcttcaaggacagcttccagttcgacctgaagcccgtgggcagaagaaccagcagcagcagcgacatccccaagagccccttcacccccaccgagaagagcaagcaggtgttcctgctgagcgtgcccagcctggactgcctgcccatcaccagaagcaacagcatgcccaccaccggctacagcgccgtgcccgccaacatcatcccccccccccaccccctgagaggcagccagagcttcgacgacaagatcggcaccttctacgacgacgtgttcgtgagcggccccaacgcccccgtgccccagagcggccaccccagaaccctggtgagacaggccgccatcgaggacagcagcgccaacgagagccacgtgctgggcaccggccagagcctggacgagagccaccagggctgccacgccgccggcgaggccatgagcgtgagaagcaaggccctggcccagggcccccacatcgagaagaagaagagccaccagggcagaggcaccatgttcgagtgcgagacctgcagaaacagatacagaaagctggagaacttcgagaaccacaagaagttctactgcagcgagctgcacggccccaagaccaaggtggccatgagagagcccgagcacagccccgtgcccggcggcctgcagccccagatcctgcactacagagtggccggcagcagcggcatctgggagcagaccccccagatcagaaagagaagaaagatgaagagcgtgggcgacgacgaggagctgcagcagaacgagagcggcaccagccccaagagcagcgagggcctgcagttccagaacgccctgggctgcaaccccagcctgcccaagcacaacgtgaccatcagaagcgaccagcagcacaagaacatccagctgcagaacagccacatccacctggtggccagaggccccgagcagaccatggaccccaagctgagcaccatcatggagcagcagatcagcagcgccgcccaggacaagatcgagctgcagagacacggcaccggcatcagcgtgatccagcacaccaacagcctgagcagacccaacagcttcgacaagcccgagcccttcgagagagccagccccgtgagcttccaggagctgaacagaaccggcaagagcggcagcctgaaggtgatcggcatcagccaggaggagagccaccccagcagagacggcagccacccccaccagctggccctgagcgacgccctgagaggcgagctgcaggagagcagcagaaagagccccagcgagagacacgtgctgggccagcccagcagactggtgagacagcacaacatccaggtgcccgagatcctggtgaccgaggagcccgacagagacctggaggcccagtgccacgaccaggagaagagcgagaagttcagctggccccagagaagcgagaccctgagcaagctgcccaccgagaagctgccccccaagaagaagagactgagactggccgagatcgagcacagcagcaccgagagcagcttcgacagcaccctgagcagaagcctgagcagagagagcagcctgagccacaccagcagcttcagcgccagcctggacatcgaggacgtgagcaagaccgaggccagccccaagatcgacttcctgaacaaggccgagttcctgatgatccccgccggcctgaacaccctgaacgtgcccggctgccacagagagatgagaagaaccgccagcgagcagatcaactgcacccagaccagcatggaggtgagcgacctgagaagcaagagcttcgactgcggcagcatcacccccccccagaccacccccctgaccgagctgcagccccccagcagccccagcagagtgggcgtgaccggccacgtgcccctgctggagagaagaagaggccccctggtgagacagatcagcctgaacatcgcccccgacagccacctgagccccgtgcaccccaccagcttccagaacaccgccctgcccagcgtgaacgccgtgccctaccagggcccccagctgaccagcaccagcctggccgagttcagcgccaacaccctgcacagccagacccaggtgaaggacctgcaggccgagaccagcaacagcagcagcaccaacgtgttccccgtgcagcagctgtgcgacatcaacctgctgaaccagatccacgccccccccagccaccagagcacccagctgagcctgcaggtgagcacccagggcagcaagcccgacaagaacagcgtgctgagcggcagcagcaagagcgaggactgcttcgcccccaagtaccagctgcactgccaggtgttcaccagcggccccagctgcagcagcaaccccgtgcacagcctgcccaaccaggtgatcagcgaccccgtgggcaccgaccactgcgtgaccagcgccaccctgcccaccaagctgatcgacagcatgagcaacagccaccccctgctgccccccgagctgagacccctgggcagccaggtgcagaaggtgcccagcagcttcatgctgcccatcagactgcagagcagcgtgcccgcctactgcttcgccaccctgaccagcctgccccagatcctggtgacccaggacctgcccaaccagcccatctgccagaccaaccacagcgtggtgcccatcagcgaggagcagaacagcgtgcccaccctgcagaagggccaccagaacgccctgcccaaccccgagaaggagttcctgtgcgagaacgtgttcagcgagatgagccagaacagcagcctgagcgagagcctgcccatcacccagaagatcagcgtgggcagactgagcccccagcaggagagcagcgccagcagcaagagaatgctgagccccgccaacagcctggacatcgccatggagaagcaccagaagagagccaaggacgagaacggcgccgtgtgcgccaccgacgtgagacccctggaggccctgagcagcagagtgaacgaggccagcaagcagaagaagcccatcctggtgagacaggtgtgcaccaccgagcccctggacggcgtgatgctggagaaggacgtgttcagccagcccgagatcagcaacgaggccgtgaacctgaccaacgtgctgcccgccgacaacagcagcaccggctgcagcaagttcgtggtgatcgagcccatcagcgagctgcaggagttcgagaacatcaagagcagcaccagcctgaccctgaccgtgagaagcagccccgcccccagcgagaacacccacatcagccccctgaagtgcaccgacaacaaccaggagagaaagagccccggcgtgaagaaccagggcgacaaggtgaacatccaggagcagagccagcagcccgtgaccagcctgagcctgttcaacatcaaggacacccagcagctggccttccccagcctgaagaccaccaccaacttcacctggtgctacctgctgagacagaagagcctgcacctgccccagaaggaccagaagaccagcgcctacaccgactggaccgtgagcgccagcaaccccaaccccctgggcctgcccaccaaggtggccctggccctgctgaacagcaagcagaacaccggcaagagcctgtactgccaggccatcaccacccacagcaagagcgacctgctggtgtacagcagcaagtggaagagcagcctgagcaagagagccctgggcaaccagaagagcaccgtggtggagttcagcaacaaggacgccagcgagatcaacagcgagcaggacaaggagaacagcctgatcaagagcgagcccagaagaatcaagatcttcgacggcggctacaagagcaacgaggagtacgtgtacgtgagaggcagaggcagaggcaagtacatctgcgaggagtgcggcatcagatgcaagaagcccagcatgctgaagaagcacatcagaacccacaccgacgtgagaccctaccactgcacctactgcaacttcagcttcaagaccaagggcaacctgaccaagcacatgaagagcaaggcccacagcaagaagtgcgtggacctgggcgtgagcgtgggcctgatcgacgagcaggacaccgaggagagcgacgagaagcagagattcagctacgagagaagcggctacgacctggaggagagcgacggccccgacgaggacgacaacgagaacgaggacgacgacgaggacagccaggccgagagcgtgctgagcgccacccccagcgtgaccgccagcccccagcacctgcccagcagaagcagcctgcaggaccccgtgagcaccgacgaggacgtgagaatcaccgactgcttcagcggcgtgcacaccgaccccatggacgtgctgcccagagccctgctgaccagaatgaccgtgctgagcaccgcccagagcgactacaacagaaagaccctgagccccggcaaggccagacagagagccgccagagacgagaacgacaccatccccagcgtggacaccagcagaagcccctgccaccagatgagcgtggactaccccgagagcgaggagatcctgagaagcagcatggccggcaaggccgtggccatcacccagagccccagcagcgtgagactgccccccgccgccgccgagcacagcccccagaccgccgccggcatgcccagcgtggccagcccccaccccgacccccaggagcagaagcagcagatcaccctgcagcccacccccggcctgcccagcccccacacccacctgttcagccacctgcccctgcacagccagcagcagagcagaaccccctacaacatggtgcccgtgggcggcatccacgtggtgcccgccggcctgacctacagcaccttcgtgcccctgcaggccggccccgtgcagctgaccatccccgccgtgagcgtggtgcacagaaccctgggcacccacagaaacaccgtgaccgaggtgagcggcaccaccaaccccgccggcgtggccgagctgagcagcgtggtgccctgcatccccatcggccagatcagagtgcccggcctgcagaacctgagcacccccggcctgcagagcctgcccagcctgagcatggagaccgtgaacatcgtgggcctggccaacaccaacatggccccccaggtgcacccccccggcctggccctgaacgccgtgggcctgcaggtgctgaccgccaaccccagcagccagagcagccccgccccccaggcccacatccccggcctgcagatcctgaacatcgccctgcccaccctgatccccagcgtgagccaggtggccgtggacgcccagggcgcccccgagatgcccgccagccagagcaaggcctgcgagacccagcccaagcagaccagcgtggccagcgccaaccaggtgagcagaaccgagagcccccagggcctgcccaccgtgcagagagagaacgccaagaaggtgctgaacccccccgcccccgccggcgaccacgccagactggacggcctgagcaagatggacaccgagaaggccgccagcgccaaccacgtgaagcccaagcccgagctgaccagcatccagggccagcccgccagcaccagccagcccctgctgaaggcccacagcgaggtgttcaccaagcccagcggccagcagaccctgagccccgacagacaggtgcccagacccaccgccctgcccagaagacagcccaccgtgcacttcagcgacgtgagcagcgacgacgacgaggacagactggtgatcgccacctag

SEQ ID NO: 84823 - DNA, 387 bp, Artificial Sequence
  Description of Artificial Sequence: Synthetic coding sequence
atgcccagaaccaagcagatccaccccagaaacctgagagacaagatcgaggaggcccagaaggagctgaacggcgccgaggtgagcaagaaggagatcctgcaggccggcgtgaagggcaccagcgagagcctgaagggcgtgaagagaaagaagatcgtggccgagaaccacctgaagaagatccccaagagccccctgagaaaccccctgcaggccaagcacaagcagaacaccgaggagagcagcttcgccgtgctgcacagcgccagcgagagccacaagaagcagaactacatccccgtgaagaacggcaagcagttcaccaagcagaacggcgagacccccggcatcatcgccgaggccagcaagagcgaggagagctag

SEQ ID NO: 84824 - DNA, 429 bp, Artificial Sequence
  Description of Artificial Sequence: Synthetic coding sequence
atgcccagaaccaagcagatccaccccagaaacctgagagacaagatcgaggaggcccagaaggagctgaacggcgccgaggtgagcaagaaggagatcctgcaggccggcgtgaagggcaccagcgagagcctgaagggcgtgaagagaaagaagatcgtggccgagaaccacctgaagaagatccccaagagccccctgagaaaccccctgcaggccaagcacaagcagaacaccgaggagagcagcttcgccgtgctgcacagcgccagcgagagccacaagaagcagaactacatccccgtgaagaacggcaagcagttcaccaagcagaacggcgagacccccggcatcatcgccgaggccagcaagagcgaggagagcgtgagccccaagaagcccctgttcctgcagcagcccagcgagtag

SEQ ID NO: 84825 - DNA, 363 bp, Artificial Sequence
  Description of Artificial Sequence: Synthetic coding sequence
atgcccagaaccaagcagatccaccccagaaacctgagagacaagatcgaggaggcccagaaggagctgaacggcgccgaggtgagcaagaaggagatcctgcaggccggcgtgaagggcaccagcgagagcctgaagggcgtgaagagaaagaagatcgtggccgagaaccacctgaagaagatccccaagagccccctgagaaaccccctgcaggccaagcacaagcagaacaccgaggagagcagcttcgccgtgctgcacagcgccagcgagagccacaagaagcagaactacatccccgtgaagaacggcaagcagttcaccaagcagaacggcgagacccccggcatcatcgcctag

SEQ ID NO: 84826 - DNA, 1752 bp, Artificial Sequence
  Description of Artificial Sequence: Synthetic coding sequence
atgctgaagaagcacatcagaacccacaccgacgtgagaccctaccactgcacctactgcaacttcagcttcaagaccaaggacgagaagcagagattcagctacgagagaagcggctacgacctggaggagagcgacggccccgacgaggacgacaacgagaacgaggacgacgacgaggacagccaggccgagagcgtgctgagcgccacccccagcgtgaccgccagcccccagcacctgcccagcagaagcagcctgcaggaccccgtgagcaccgacgaggacgtgagaatcaccgactgcttcagcggcgtgcacaccgaccccatggacgtgctgcccagagccctgctgaccagaatgaccgtgctgagcaccgcccagagcgactacaacagaaagaccctgagccccggcaaggccagacagagagccgccagagacgagaacgacaccatccccagcgtggacaccagcagaagcccctgccaccagatgagcgtggactaccccgagagcgaggagatcctgagaagcagcatggccggcaaggccgtggccatcacccagagccccagcagcgtgagactgccccccgccgccgccgagcacagcccccagaccgccgccggcatgcccagcgtggccagcccccaccccgacccccaggagcagaagcagcagatcaccctgcagcccacccccggcctgcccagcccccacacccacctgttcagccacctgcccctgcacagccagcagcagagcagaaccccctacaacatggtgcccgtgggcggcatccacgtggtgcccgccggcctgacctacagcaccttcgtgcccctgcaggccggccccgtgcagctgaccatccccgccgtgagcgtggtgcacagaaccctgggcacccacagaaacaccgtgaccgaggtgagcggcaccaccaaccccgccggcgtggccgagctgagcagcgtggtgccctgcatccccatcggccagatcagagtgcccggcctgcagaacctgagcacccccggcctgcagagcctgcccagcctgagcatggagaccgtgaacatcgtgggcctggccaacaccaacatggccccccaggtgcacccccccggcctggccctgaacgccgtgggcctgcaggtgctgaccgccaaccccagcagccagagcagccccgccccccaggcccacatccccggcctgcagatcctgaacatcgccctgcccaccctgatccccagcgtgagccaggtggccgtggacgcccagggcgcccccgagatgcccgccagccagagcaaggcctgcgagacccagcccaagcagaccagcgtggccagcgccaaccaggtgagcagaaccgagagcccccagggcctgcccaccgtgcagagagagaacgccaagaaggtgctgaacccccccgcccccgccggcgaccacgccagactggacggcctgagcaagatggacaccgagaaggccgccagcgccaaccacgtgaagcccaagcccgagctgaccagcatccagggccagcccgccagcaccagccagcccctgctgaaggcccacagcgaggtgttcaccaagcccagcggccagcagaccctgagccccgacagacaggtgcccagacccaccgccctgcccagaagacagcccaccgtgcacttcagcgacgtgagcagcgacgacgacgaggacagactggtgatcgccacctag

SEQ ID NO: 84827 - DNA, 2103 bp, Artificial Sequence
  Description of Artificial Sequence: Synthetic coding sequence
ggcgacaagttcagcttccagagagccctgggcaaccagaagagcaccgtggtggagttcagcaacaaggacgccagcgagatcaacagcgagcaggacaaggagaacagcctgatcaagagcgagcccagaagaatcaagatcttcgacggcggctacaagagcaacgaggagtacgtgtacgtgagaggcagaggcagaggcaagtacatctgcgaggagtgcggcatcagatgcaagaagcccagcatgctgaagaagcacatcagaacccacaccgacgtgagaccctaccactgcacctactgcaacttcagcttcaagaccaagggcaacctgaccaagcacatgaagagcaaggcccacagcaagaagtgcgtggacctgggcgtgagcgtgggcctgatcgacgagcaggacaccgaggagagcgacgagaagcagagattcagctacgagagaagcggctacgacctggaggagagcgacggccccgacgaggacgacaacgagaacgaggacgacgacgaggacagccaggccgagagcgtgctgagcgccacccccagcgtgaccgccagcccccagcacctgcccagcagaagcagcctgcaggaccccgtgagcaccgacgaggacgtgagaatcaccgactgcttcagcggcgtgcacaccgaccccatggacgtgctgcccagagccctgctgaccagaatgaccgtgctgagcaccgcccagagcgactacaacagaaagaccctgagccccggcaaggccagacagagagccgccagagacgagaacgacaccatccccagcgtggacaccagcagaagcccctgccaccagatgagcgtggactaccccgagagcgaggagatcctgagaagcagcatggccggcaaggccgtggccatcacccagagccccagcagcgtgagactgccccccgccgccgccgagcacagcccccagaccgccgccggcatgcccagcgtggccagcccccaccccgacccccaggagcagaagcagcagatcaccctgcagcccacccccggcctgcccagcccccacacccacctgttcagccacctgcccctgcacagccagcagcagagcagaaccccctacaacatggtgcccgtgggcggcatccacgtggtgcccgccggcctgacctacagcaccttcgtgcccctgcaggccggccccgtgcagctgaccatccccgccgtgagcgtggtgcacagaaccctgggcacccacagaaacaccgtgaccgaggtgagcggcaccaccaaccccgccggcgtggccgagctgagcagcgtggtgccctgcatccccatcggccagatcagagtgcccggcctgcagaacctgagcacccccggcctgcagagcctgcccagcctgagcatggagaccgtgaacatcgtgggcctggccaacaccaacatggccccccaggtgcacccccccggcctggccctgaacgccgtgggcctgcaggtgctgaccgccaaccccagcagccagagcagccccgccccccaggcccacatccccggcctgcagatcctgaacatcgccctgcccaccctgatccccagcgtgagccaggtggccgtggacgcccagggcgcccccgagatgcccgccagccagagcaaggcctgcgagacccagcccaagcagaccagcgtggccagcgccaaccaggtgagcagaaccgagagcccccagggcctgcccaccgtgcagagagagaacgccaagaaggtgctgaacccccccgcccccgccggcgaccacgccagactggacggcctgagcaagatggacaccgagaaggccgccagcgccaaccacgtgaagcccaagcccgagctgaccagcatccagggccagcccgccagcaccagccagcccctgctgaaggcccacagcgaggtgttcaccaagcccagcggccagcagaccctgagccccgacagacaggtgcccagacccaccgccctgcccagaagacagcccaccgtgcacttcagcgacgtgagcagcgacgacgacgaggacagactggtgatcgccacctag

SEQ ID NO: 84828 - DNA, 7341 bp, Artificial Sequence
  Description of Artificial Sequence: Synthetic coding sequence
atggacaccggcgacaccgccctgggccagaaggccaccagcagaagcggcgagaccgacaaggccagcggcagatggagacaggagcagagcgccgtgatcaagatgagcaccttcggcagccacgagggccagagacagccccagatcgagcccgagcagatcggcaacaccgccagcgcccagctgttcggcagcggcaagctggccagccccagcgaggtggtgcagcaggtggccgagaagcagtaccccccccacagacccagcccctacagctgccagcacagcctgagcttcccccagcacagcctgccccagggcgtgatgcacagcaccaagccccaccagagcctggagggccccccctggctgttccccggccccctgcccagcgtggccagcgaggacctgttccccttccccatccacggccacagcggcggctaccccagaaagaagatcagcagcctgaaccccgcctacagccagtacagccagaagagcatcgagcaggccgaggaggcccacaagaaggagcacaagcccaagaagcccggcaagtacatctgcccctactgcagcagagcctgcgccaagcccagcgtgctgaagaagcacatcagaagccacaccggcgagagaccctacccctgcatcccctgcggcttcagcttcaagaccaagagcaacctgtacaagcacagaaagagccacgcccacgccatcaaggccggcctggtgcccttcaccgagagcgccgtgagcaagctggacctggaggccggcttcatcgacgtggaggccgagatccacagcgacggcgagcagagcaccgacaccgacgaggagagcagcctgttcgccgaggccagcgacaagatgagccccggcccccccatccccctggacatcgccagcagaggcggctaccacggcagcctggaggagagcctgggcggccccatgaaggtgcccatcctgatcatccccaagagcggcatccccctgcccaacgagagcagccagtacatcggccccgacatgctgcccaaccccagcctgaacaccaaggccgacgacagccacaccgtgaagcagaagctggccctgagactgagcgagaagaagggccaggacagcgagcccagcctgaacctgctgagcccccacagcaagggcagcaccgacagcggctacttcagcagaagcgagagcgccgagcagcagatcagcccccccaacaccaacgccaagagctacgaggagatcatcttcggcaagtactgcagactgagccccagaaacgccctgagcgtgaccaccaccagccaggagagagccgccatgggcagaaagggcatcatggagcccctgccccacgtgaacaccagactggacgtgaagatgttcgaggaccccgtgagccagctgatccccagcaagggcgacgtggaccccagccagaccagcatgctgaagagcaccaagttcaacagcgagagcagacagccccagatcatccccagcagcatcagaaacgagggcaagctgtaccccgccaacttccagggcagcaaccccgtgctgctggaggcccccgtggacagcagccccctgatcagaagcaacagcgtgcccaccagcagcgccaccaacctgaccatcccccccagcctgagaggcagccacagcttcgacgagagaatgaccggcagcgacgacgtgttctaccccggcaccgtgggcatccccccccagagaatgctgagaagacaggccgccttcgagctgcccagcgtgcaggagggccacgtggaggtggagcaccacggcagaatgctgaagggcatcagcagcagcagcctgaaggagaagaagctgagccccggcgacagagtgggctacgactacgacgtgtgcagaaagccctacaagaagtgggaggacagcgagacccccaagcagaactacagagacatcagctgcctgagcagcctgaagcacggcggcgagtacttcatggaccccgtggtgcccctgcagggcgtgcccagcatgttcggcaccacctgcgagaacagaaagagaagaaaggagaagagcgtgggcgacgaggaggacacccccatgatctgcagcagcatcgtgagcacccccgtgggcatcatggccagcgactacgaccccaagctgcagatgcaggagggcgtgagaagcggcttcgccatggccggccacgagaacctgagccacggccacaccgagagattcgacccctgcagaccccagctgcagcccggcagccccagcctggtgagcgaggagagccccagcgccatcgacagcgacaagatgagcgacctgggcggcagaaagccccccggcaacgtgatcagcgtgatccagcacaccaacagcctgagcagacccaacagcttcgagagaagcgagagcgccgagctggtggcctgcacccaggacaaggcccccagccccagcgagacctgcgacagcgagatcagcgaggcccccgtgagccccgagtgggccccccccggcgacggcgccgagagcggcggcaagcccagccccagccagcaggtgcagcagcagagctaccacacccagcccagactggtgagacagcacaacatccaggtgcccgagatcagagtgaccgaggagcccgacaagcccgagaaggagaaggaggcccagagcaaggagcccgagaagcccgtggaggagttccagtggccccagagaagcgagaccctgagccagctgcccgccgagaagctgccccccaagaagaagagactgagactggccgacatggagcacagcagcggcgagagcagcttcgagagcaccggcaccggcctgagcagaagccccagccaggagagcaacctgagccacagcagcagcttcagcatgagcttcgagagagaggagaccagcaagctgagcgccctgcccaagcaggacgagttcggcaagcacagcgagttcctgaccgtgcccgccggcagctacagcctgagcgtgcccggccaccaccaccagaaggagatgagaagatgcagcagcgagcagatgccctgcccccaccccgccgaggtgcccgaggtgagaagcaagagcttcgactacggcaacctgagccacgcccccgtgagcggcgccgccgccagcaccgtgagccccagcagagagagaaagaagtgcttcctggtgagacaggccagcttcagcggcagccccgagatcagccagggcgaggtgggcatggaccagagcgtgaagcaggagcagctggagcacctgcacgccggcctgagaagcggctggcaccacggcccccccgccgtgctgccccccctgcagcaggaggaccccggcaagcaggtggccggcccctgcccccccctgagcagcggccccctgcacctggcccagccccagatcatgcacatggacagccaggagagcctgagaaaccccctgatccagcccaccagctacatgaccagcaagcacctgcccgagcagccccacctgttcccccaccaggagaccatccccttcagccccatccagaacgccctgttccagttccagtaccccaccgtgtgcatggtgcacctgcccgcccagcagcccccctggtggcaggcccacttcccccaccccttcgcccagcacccccagaagagctacggcaagcccagcttccagaccgagatccacagcagctaccccctggagcacgtggccgagcacaccggcaagaagcccgccgagtacgcccacaccaaggagcagacctacccctgctacagcggcgccagcggcctgcaccccaagaacctgctgcccaagttccccagcgaccagagcagcaagagcaccgagacccccagcgagcaggtgctgcaggaggacttcgccagcgccaacgccggcagcctgcagagcctgcccggcaccgtggtgcccgtgagaatccagacccacgtgcccagctacggcagcgtgatgtacaccagcatcagccagatcctgggccagaacagccccgccatcgtgatctgcaaggtggacgagaacatgacccagagaaccctggtgaccaacgccgccatgcagggcatcggcttcaacatcgcccaggtgctgggccagcacgccggcctggagaagtaccccatctggaaggccccccagaccctgcccctgggcctggagagcagcatccccctgtgcctgcccagcaccagcgacagcgtggccaccctgggcggcagcaagagaatgctgagccccgccagcagcctggagctgttcatggagaccaagcagcagaagagagtgaaggaggagaagatgtacggccagatcgtggaggagctgagcgccgtggagctgaccaacagcgacatcaagaaggacctgagcagaccccagaagccccagctggtgagacagggctgcgccagcgagcccaaggacggcctgcagagcggcagcagcagcttcagcagcctgagccccagcagcagccaggactaccccagcgtgagccccagcagcagagagcccttcctgcccagcaaggagatgctgagcggcagcagagcccccctgcccggccagaagagcagcggccccagcgagagcaaggagagcagcgacgagctggacatcgacgagaccgccagcgacatgagcatgagcccccagagcagcagcctgcccgccggcgacggccagctggaggaggagggcaagggccacaagagacccgtgggcatgctggtgagaatggccagcgcccccagcggcaacgtggccgacagcaccctgctgctgaccgacatggccgacttccagcagatcctgcagttccccagcctgagaaccaccaccaccgtgagctggtgcttcctgaactacaccaagcccaactacgtgcagcaggccaccttcaagagcagcgtgtacgccagctggtgcatcagcagctgcaaccccaaccccagcggcctgaacaccaagaccaccctggccctgctgagaagcaagcagaagatcaccgccgagatctacaccctggccgccatgcacagacccggcaccggcaagctgaccagcagcagcgcctggaagcagttcacccagatgaagcccgacgccagcttcctgttcggcagcaagctggagagaaagctggtgggcaacatcctgaaggagagaggcaagggcgacatccacggcgacaaggacatcggcagcaagcagaccgagcccatcagaatcaagatcttcgagggcggctacaagagcaacgaggactacgtgtacgtgagaggcagaggcagaggcaagtacatctgcgaggagtgcggcatcagatgcaagaagcccagcatgctgaagaagcacatcagaacccacaccgacgtgagaccctacgtgtgcaagctgtgcaacttcgccttcaagaccaagggcaacctgaccaagcacatgaagagcaaggcccacatgaagaagtgcctggagctgggcgtgagcatgaccagcgtggacgacaccgagaccgaggaggccgagaacctggaggacctgcacaaggccgccgagaagcacagcatgagcagcatcagcaccgaccaccagttcagcgacgccgaggagagcgacggcgaggacggcgacgacaacgacgacgacgacgaggacgaggacgacttcgacgaccagggcgacctgacccccaagaccagaagcagaagcaccagcccccagccccccagattcagcagcctgcccgtgaacgtgggcgccgtgccccacggcgtgcccagcgacagcagcctgggccacagcagcctgatcagctacctggtgaccctgcccagcatcagagtgacccagctgatgacccccagcgacagctgcgaggacacccagatgaccgagtaccagagactgttccagagcaagagcaccgacagcgagcccgacaaggacagactggacatccccagctgcatggacgaggagtgcatgctgcccagcgagcccagcagcagccccagagacttcagccccagcagccaccacagcagccccggctacgacagcagcccctgcagagacaacagccccaagagatacctgatccccaagggcgacctgagccccagaagacacctgagccccagaagagacctgagccccatgagacacctgagccccagaaaggaggccgccctgagaagagagatgagccagagagacgtgagccccagaagacacctgagccccagaagacccgtgagccccggcaaggacatcaccgccagaagagacctgagccccagaagagagagaagatacatgaccaccatcagagcccccagccccagaagagccctgtaccacaacccccccctgagcatgggccagtacctgcaggccgagcccatcgtgctgggcccccccaacctgagaagaggcctgccccaggtgccctacttcagcctgtacggcgaccaggagggcgcctacgagcaccccggcagcagcctgttccccgagggccccaacgactacgtgttcagccacctgcccctgcacagccagcagcaggtgagagcccccatccccatggtgcccgtgggcggcatccagatggtgcacagcatgccccccgccctgagcagcctgcaccccagccccaccctgcccctgcccatggagggcttcgaggagaagaagggcgccagcggcgagagcttcagcaaggacccctacgtgctgagcaagcagcacgagaagagaggcccccacgccctgcagagcagcggcccccccagcacccccagcagccccagactgctgatgaagcagagcaccagcgaggacagcctgaacgccaccgagagagagcaggaggagaacatccagacctgcaccaaggccatcgccagcctgagaatcgccaccgaggaggccgccctgctgggccccgaccagcccgccagagtgcaggagccccaccagaaccccctgggcagcgcccacgtgagcatcagacacttcagcagacccgagcccggccagccctgcaccagcgccacccaccccgacctgcacgacggcgagaaggacaacttcggcaccagccagacccccctggcccacagcaccttctacagcaagagctgcgtggacgacaagcagctggacttccacagcagcaaggagctgagcagcagcaccgaggagagcaaggaccccagcagcgagaagagccagctgcactag

SEQ ID NO: 84829 - DNA, 7341 bp, Artificial Sequence; identical to SEQ ID NO: 84828
  Description of Artificial Sequence: Synthetic coding sequence

SEQ ID NO: 84830 - DNA, 7341 bp, Artificial Sequence; identical to SEQ ID NO: 84828
  Description of Artificial Sequence: Synthetic coding sequence

SEQ ID NO: 84831 - DNA, 7221 bp, Artificial Sequence
  Description of Artificial Sequence: Synthetic coding sequence
atggaccccgagcagagcgtgaagggcaccaagaaggccgagggcagccccagaaagagactgaccaagggcgaggccatccagaccagcgtgagcagcagcgtgccctaccccggcagcggcaccgccgccacccaggagagccccgcccaggagctgctggccccccagcccttccccggccccagcagcgtgctgagagagggcagccaggagaagaccggccagcagcagaagccccccaagagaccccccatcgaggccagcgtgcacatcagccagctgccccagcaccccctgacccccgccttcatgagccccggcaagcccgagcacctgctggagggcagcacctggcagctggtggaccccatgagacccggccccagcggcagcttcgtggcccccggcctgcacccccagagccagctgctgcccagccacgccagcatcatcccccccgaggacctgcccggcgtgcccaaggtgttcgtgcccagacccagccaggtgagcctgaagcccaccgaggaggcccacaagaaggagagaaagccccagaagcccggcaagtacatctgccagtactgcagcagaccctgcgccaagcccagcgtgctgcagaagcacatcagaagccacaccggcgagagaccctacccctgcggcccctgcggcttcagcttcaagaccaagagcaacctgtacaagcacagaaagagccacgcccacagaatcaaggccggcctggccagcggcatgggcggcgagatgtacccccacggcctggagatggagagaatccccggcgaggagttcgaggagcccaccgagggcgagagcaccgacagcgaggaggagaccagcgccaccagcggccaccccgccgagctgagccccagacccaagcagcccctgctgagcagcggcctgtacagcagcggcagccacagcagcagccacgagagatgcagcctgagccagagcagcaccgcccagagcctggaggaccccccccccttcgtggagcccagcagcgagcaccccctgagccacaagcccgaggacacccacaccatcaagcagaagctggccctgagactgagcgagagaaagaaggtgatcgacgagcaggccttcctgagccccggcagcaagggcagcaccgagagcggctacttcagcagaagcgagagcgccgagcagcaggtgagcccccccaacaccaacgccaagagctacgccgagatcatcttcggcaagtgcggcagaatcggccagagaaccgccatgctgaccgccaccagcacccagcccctgctgcccctgagcaccgaggacaagcccagcctggtgcccctgagcgtgcccagaacccaggtgatcgagcacatcaccaagctgatcaccatcaacgaggccgtggtggacaccagcgagatcgacagcgtgaagcccagaagaagcagcctgagcagaagaagcagcatggagagccccaagagcagcctgtacagagagcccctgagcagccacagcgagaagaccaagcccgagcagagcctgctgagcctgcagcacccccccagcaccgccccccccgtgcccctgctgagaagccacagcatgcccagcgccgcctgcaccatcagcaccccccaccaccccttcagaggcagctacagcttcgacgaccacatcaccgacagcgaggccctgagccacagcagccacgtgttcaccagccaccccagaatgctgaagagacagcccgccatcgagctgcccctgggcggcgagtacagcagcgaggagcccggccccagcagcaaggacaccgccagcaagcccagcgacgaggtggagcccaaggagagcgagctgaccaagaagaccaagaagggcctgaagaccaagggcgtgatctacgagtgcaacatctgcggcgccagatacaagaagagagacaactacgaggcccacaagaagtactactgcagcgagctgcagatcgccaagcccatcagcgccggcacccacaccagccccgaggccgagaagagccagatcgagcacgagccctggagccagatgatgcactacaagctgggcaccaccctggagctgacccccctgagaaagagaagaaaggagaagagcctgggcgacgaggaggagccccccgccttcgagagcaccaagagccagttcggcagccccggccccagcgacgccgccagaaacctgcccctggagagcaccaagagccccgccgagcccagcaagagcgtgcccagcctggagggccccaccggcttccagcccagaacccccaagcccggcagcggcagcgagagcggcaaggagagaagaaccaccagcaaggagatcagcgtgatccagcacaccagcagcttcgagaagagcgacagcctggagcagcccagcggcctggagggcgaggacaagcccctggcccagttccccagccccccccccgccccccacggcagaagcgcccacagcctgcagcccaagctggtgagacagcccaacatccaggtgcccgagatcctggtgaccgaggagcccgacagacccgacaccgagcccgagcccccccccaaggagcccgagaagaccgaggagttccagtggccccagagaagccagaccctggcccagctgcccgccgagaagctgccccccaagaagaagagactgagactggccgagatggcccagagcagcggcgagagcagcttcgagagcagcgtgcccctgagcagaagccccagccaggagagcaacgtgagcctgagcggcagcagcagaagcgccagcttcgagagagacgaccacggcaaggccgaggcccccagccccagcagcgacatgagacccaagcccctgggcacccacatgctgaccgtgcccagccaccacccccacgccagagagatgagaagaagcgccagcgagcagagccccaacgtgagccacagcgcccacatgaccgagaccagaagcaagagcttcgactacggcagcctgagcctgaccggccccagcgcccccgcccccgtggccccccccgccagagtggccccccccgagagaagaaagtgcttcctggtgagacaggccagcctgagcagaccccccgagagcgagctggaggtggcccccaagggcagacaggagagcgaggagccccagcccagcagcagcaagcccagcgccaagagcagcctgagccagatcagcagcgccgccaccagccacggcggcccccccggcggcaagggccccggccaggacagaccccccctgggccccaccgtgccctacaccgaggccctgcaggtgttccaccaccccgtggcccagacccccctgcacgagaagccctacctgcccccccccgtgagcctgttcagcttccagcacctggtgcagcacgagcccggccagagccccgagttcttcagcacccaggccatgagcagcctgctgagcagcccctacagcatgccccccctgccccccagcctgttccaggccccccccctgcccctgcagcccaccgtgctgcaccccggccagctgcacctgccccagctgatgccccaccccgccaacatccccttcagacagccccccagcttcctgcccatgccctaccccaccagcagcgccctgagcagcggcttcttcctgcccctgcagagccagttcgccctgcagctgcccggcgacgtggagagccacctgccccagatcaagaccagcctggcccccctggccaccggcagcgccggcctgagccccagcaccgagtacagcagcgacatcagactgccccccgtggccccccccgccagcagcagcgcccccaccagcgccccccccctggccctgcccgcctgccccgacaccatggtgagcctggtggtgcccgtgagagtgcagaccaacatgcccagctacggcagcgccatgtacaccaccctgagccagatcctggtgacccagagccagggcagcagcgccaccgtggccctgcccaagttcgaggagccccccagcaagggcaccaccgtgtgcggcgccgacgtgcacgaggtgggccccggccccagcggcctgagcgaggagcagagcagagccttccccaccccctacctgagagtgcccgtgaccctgcccgagagaaagggcaccagcctgagcagcgagagcatcctgagcctggagggcagcagcagcaccgccggcggcagcaagagagtgctgagccccgccggcagcctggagctgaccatggagacccagcagcagaagagagtgaaggaggaggaggccagcaaggccgacgagaagctggagctggtgaagccctgcagcgtggtgctgaccagcaccgaggacggcaagagacccgagaagagccacctgggcaaccagggccagggcagaagagagctggagatgctgagcagcctgagcagcgaccccagcgacaccaaggagatcccccccctgccccaccccgccctgagccacggcaccgcccccggcagcgaggccctgaaggagtacccccagcccagcggcaagccccacagaagaggcctgacccccctgagcgtgaagaaggaggacagcaaggagcagcccgacctgcccagcctggccccccccagcagcctgcccctgagcgagaccagcagcagacccgccaagagccaggagggcaccgacagcaagaaggtgctgcagttccccagcctgcacaccaccaccaacgtgagctggtgctacctgaactacatcaagcccaaccacatccagcacgccgacagaagaagcagcgtgtacgccggctggtgcatcagcctgtacaaccccaacctgcccggcgtgagcaccaaggccgccctgagcctgctgagaagcaagcagaaggtgagcaaggagacctacaccatggccaccgccccccaccccgaggccggcagactggtgcccagcagcagcagaaagcccagaatgaccgaggtgcacctgcccagcctggtgagccccgagggccagaaggacctggccagagtggagaaggaggaggagagaagaggcgagcccgaggaggacgcccccgccagccagagaggcgagcccgccagaatcaagatcttcgagggcggctacaagagcaacgaggagtacgtgtacgtgagaggcagaggcagaggcaagtacgtgtgcgaggagtgcggcatcagatgcaagaagcccagcatgctgaagaagcacatcagaacccacaccgacgtgagaccctacgtgtgcaagcactgccacttcgccttcaagaccaagggcaacctgaccaagcacatgaagagcaaggcccacagcaagaagtgccaggagaccggcgtgctggaggagctggaggccgaggagggcaccagcgacgacctgttccaggacagcgagggcagagagggcagcgaggccgtggaggagcaccagttcagcgacctggaggacagcgacagcgacagcgacctggacgaggacgaggacgaggacgaggaggagagccaggacgagctgagcagacccagcagcgaggcccccccccccggccccccccacgccctgagagccgacagcagccccatcctgggcccccagccccccgacgcccccgccagcggcaccgaggccaccagaggcagcagcgtgagcgaggccgagagactgaccgccagcagctgcagcatgagcagccagagcatgcccggcctgccctggctgggccccgcccccctgggcagcgtggagaaggacaccggcagcgccctgagctacaagcccgtgagccccagaagaccctggagccccagcaaggaggccggcagcagaccccccctggccagaaagcacagcctgaccaagaacgacagcagcccccagagatgcagccccgccagagagccccaggccagcgcccccagcccccccggcctgcacgtggaccccggcagaggcatgggcgccctgccctgcggcagccccagactgcagctgagccccctgaccctgtgccccctgggcagagagctggcccccagagcccacgtgctgagcaagctggagggcaccaccgaccccggcctgcccagatacagccccaccagaagatggagccccggccaggccgagagcccccccagaagcgccccccccggcaagtgggccctggccggccccggcagccccagcgccggcgagcacggccccggcctgggcctggaccccagagtgctgttcccccccgcccccctgccccacaagctgctgagcagaagccccgagacctgcgccagcccctggcagaaggccgagagcagaagccccagctgcagccccggccccgcccaccccctgagcagcagacccttcagcgccctgcacgacttccacggccacatcctggccagaaccgaggagaacatcttcagccacctgcccctgcacagccagcacctgaccagagccccctgccccctgatccccatcggcggcatccagatggtgcaggccagacccggcgcccaccccaccctgctgcccggccccaccgccgcctgggtgagcggcttcagcggcggcggcagcgacctgaccggcgccagagaggcccaggagagaggcagatggagccccaccgagagcagcagcgccagcgtgagccccgtggccaaggtgagcaagttcaccctgagcagcgagctggagggcggcgactaccccaaggagagagagagaaccggcggcggccccggcagaccccccgactggaccccccacggcaccggcgcccccgccgagcccacccccacccacagcccctgcaccccccccgacaccctgcccagacccccccagggcagaagagccgcccagagctggagccccagactggagagccccagagcccccaccaaccccgagcccagcgccaccccccccctggacagaagcagcagcgtgggctgcctggccgaggccagcgccagattccccgccagaaccagaaacctgagcggcgagcccagaaccagacaggacagccccaagcccagcggcagcggcgagcccagagcccacccccaccagcccgaggacagagtgccccccaacgcctag

SEQ ID NO: 84832 - DNA, 7221 bp, Artificial Sequence; identical to SEQ ID NO: 84831
  Description of Artificial Sequence: Synthetic coding sequence

SEQ ID NO: 84833 - DNA, 7218 bp, Artificial Sequence
  Description of Artificial Sequence: Synthetic coding sequence
atggaccccgagcagagcgtgaagggcaccaagaaggccgagggcagccccagaaagagactgaccaagggcgaggccatccagaccagcgtgagcagcagcgtgccctaccccggcagcggcaccgccgccacccaggagagccccgcccaggagctgctggccccccagcccttccccggccccagcagcgtgctgagagagggcagccaggagaagaccggccagcagcagaagccccccaagagaccccccatcgaggccagcgtgcacatcagccagctgccccagcaccccctgacccccgccttcatgagccccggcaagcccgagcacctgctggagggcagcacctggcagctggtggaccccatgagacccggccccagcggcagcttcgtggcccccggcctgcacccccagagccagctgctgcccagccacgccagcatcatcccccccgaggacctgcccggcgtgcccaaggtgttcgtgcccagacccagccaggtgagcctgaagcccaccgaggaggcccacaagaaggagagaaagccccagaagcccggcaagtacatctgccagtactgcagcagaccctgcgccaagcccagcgtgctgcagaagcacatcagaagccacaccggcgagagaccctacccctgcggcccctgcggcttcagcttcaagaccaagagcaacctgtacaagcacagaaagagccacgcccacagaatcaaggccggcctggccagcggcatgggcggcgagatgtacccccacggcctggagatggagagaatccccggcgaggagttcgaggagcccaccgagggcgagagcaccgacagcgaggaggagaccagcgccaccagcggccaccccgccgagctgagccccagacccaagcagcccctgctgagcagcggcctgtacagcagcggcagccacagcagcagccacgagagatgcagcctgagccagagcagcaccgcccagagcctggaggaccccccccccttcgtggagcccagcagcgagcaccccctgagccacaagcccgaggacacccacaccatcaagcagaagctggccctgagactgagcgagagaaagaaggtgatcgacgagcaggccttcctgagccccggcagcaagggcagcaccgagagcggctacttcagcagaagcgagagcgccgagcagcaggtgagcccccccaacaccaacgccaagagctacgccgagatcatcttcggcaagtgcggcagaatcggccagagaaccgccatgctgaccgccaccagcacccagcccctgctgcccctgagcaccgaggacaagcccagcctggtgcccctgagcgtgcccagaacccaggtgatcgagcacatcaccaagctgatcaccatcaacgaggccgtggtggacaccagcgagatcgacagcgtgaagcccagaagaagcagcctgagcagaagaagcagcatggagagccccaagagcagcctgtacagagagcccctgagcagccacagcgagaagaccaagcccgagcagagcctgctgagcctgcagcacccccccagcaccgccccccccgtgcccctgctgagaagccacagcatgcccagcgccgcctgcaccatcagcaccccccaccaccccttcagaggcagctacagcttcgacgaccacatcaccgacagcgaggccctgagccacagcagccacgtgttcaccagccaccccagaatgctgaagagacagcccgccatcgagctgcccctgggcggcgagtacagcagcgaggagcccggccccagcagcaaggacaccgccagcaagcccagcgacgaggtggagcccaaggagagcgagctgaccaagaagaccaagaagggcctgaagaccaagggcgtgatctacgagtgcaacatctgcggcgccagatacaagaagagagacaactacgaggcccacaagaagtactactgcagcgagctgcagatcgccaagcccatcagcgccggcacccacaccagccccgaggccgagaagagccagatcgagcacgagccctggagccagatgatgcactacaagctgggcaccaccctggagctgacccccctgagaaagagaagaaaggagaagagcctgggcgacgaggaggagccccccgccttcgagagcaccaagagccagttcggcagccccggccccagcgacgccgccagaaacctgcccctggagagcaccaagagccccgccgagcccagcaagagcgtgcccagcctggagggccccaccggcttccagcccagaacccccaagcccggcagcggcagcgagagcggcaaggagagaagaaccaccagcaaggagatcagcgtgatccagcacaccagcagcttcgagaagagcgacagcctggagcagcccagcggcctggagggcgaggacaagcccctggcccagttccccagccccccccccgccccccacggcagaagcgcccacagcctgcagcccaagctggtgagacagcccaacatccaggtgcccgagatcctggtgaccgaggagcccgacagacccgacaccgagcccgagcccccccccaaggagcccgagaagaccgaggagttccagtggccccagagaagccagaccctggcccagctgcccgccgagaagctgccccccaagaagaagagactgagactggccgagatggcccagagcagcggcgagagcagcttcgagagcagcgtgcccctgagcagaagccccagccaggagagcaacgtgagcctgagcggcagcagcagaagcgccagcttcgagagagacgaccacggcaaggccgaggcccccagccccagcagcgacatgagacccaagcccctgggcacccacatgctgaccgtgcccagccaccacccccacgccagagagatgagaagaagcgccagcgagcagagccccaacgtgagccacagcgcccacatgaccgagaccagaagcaagagcttcgactacggcagcctgagcctgaccggccccagcgcccccgcccccgtggccccccccgccagagtggccccccccgagagaagaaagtgcttcctggtgagacaggccagcctgagcagaccccccgagagcgagctggaggtggcccccaagggcagacaggagagcgaggagccccagcccagcagcagcaagcccagcgccaagagcagcctgagccagatcagcagcgccgccaccagccacggcggcccccccggcggcaagggccccggccaggacagaccccccctgggccccaccgtgccctacaccgaggccctgcaggtgttccaccaccccgtggcccagacccccctgcacgagaagccctacctgcccccccccgtgagcctgttcagcttccagcacctggtgcagcacgagcccggccagagccccgagttcttcagcacccaggccatgagcagcctgctgagcagcccctacagcatgccccccctgccccccagcctgttccaggccccccccctgcccctgcagcccaccgtgctgcaccccggccagctgcacctgccccagctgatgccccaccccgccaacatccccttcagacagccccccagcttcctgcccatgccctaccccaccagcagcgccctgagcagcggcttcttcctgcccctgcagagccagttcgccctgcagctgcccggcgacgtggagagccacctgccccagatcaagaccagcctggcccccctggccaccggcagcgccggcctgagccccagcaccgagtacagcagcgacatcagactgccccccgtggccccccccgccagcagcagcgcccccaccagcgccccccccctggccctgcccgcctgccccgacaccatggtgagcctggtggtgcccgtgagagtgcagaccaacatgcccagctacggcagcgccatgtacaccaccctgagccagatcctggtgacccagagccagggcagcagcgccaccgtggccctgcccaagttcgaggagccccccagcaagggcaccaccgtgtgcggcgccgacgtgcacgaggtgggccccggccccagcggcctgagcgaggagcagagcagagccttccccaccccctacctgagagtgcccgtgaccctgcccgagagaaagggcaccagcctgagcagcgagagcatcctgagcctggagggcagcagcagcaccgccggcggcagcaagagagtgctgagccccgccggcagcctggagctgaccatggagacccagcagcagaagagagtgaaggaggaggaggccagcaaggccgacgagaagctggagctggtgaagccctgcagcgtggtgctgaccagcaccgaggacggcaagagacccgagaagagccacctgggcaaccagggccagggcagaagagagctggagatgctgagcagcctgagcagcgaccccagcgacaccaaggagatcccccccctgccccaccccgccctgagccacggcaccgcccccggcagcgaggccctgaaggagtacccccagcccagcggcaagccccacagaagaggcctgacccccctgagcgtgaagaaggaggacagcaaggagcagcccgacctgcccagcctggccccccccagcagcctgcccctgagcgagaccagcagcagacccgccaagagccaggagggcaccgacagcaagaaggtgctgcagttccccagcctgcacaccaccaccaacgtgagctggtgctacctgaactacatcaagcccaaccacatccagcacgccgacagaagaagcagcgtgtacgccggctggtgcatcagcctgtacaaccccaacctgcccggcgtgagcaccaaggccgccctgagcctgctgagaagcaagcagaaggtgagcaaggagacctacaccatggccaccgccccccaccccgaggccggcagactggtgcccagcagcagcagaaagcccagaatgaccgaggtgcacctgcccagcctggtgagccccgagggccagaaggacctggccagagtggagaaggaggaggagagaagaggcgagcccgaggaggacgcccccgccagccagagaggcgagcccgccagaatcaagatcttcgagggcggctacaagagcaacgaggagtacgtgtacgtgagaggcagaggcagaggcaagtacgtgtgcgaggagtgcggcatcagatgcaagaagcccagcatgctgaagaagcacatcagaacccacaccgacgtgagaccctacgtgtgcaagcactgccacttcgccttcaagaccaagggcaacctgaccaagcacatgaagagcaaggcccacagcaagaagtgccaggagaccggcgtgctggaggagctggaggccgaggagggcaccagcgacgacctgttccaggacagcgagggcagagagggcagcgaggccgtggaggagcaccagttcagcgacctggaggacagcgacagcgacagcgacctggacgaggacgaggacgaggacgaggaggagagccaggacgagctgagcagacccagcagcgaggcccccccccccggccccccccacgccctgagagccgacagcagccccatcctgggcccccagccccccgacgcccccgccagcggcaccgaggccaccagaggcagcagcgtgagcgaggccgagagactgaccgccagcagctgcagcatgagcagccagagcatgcccggcctgccctggctgggccccgcccccctgggcagcgtggagaaggacaccggcagcgccctgagctacaagcccgtgagccccagaagaccctggagccccagcaaggaggccggcagcagaccccccctggccagaaagcacagcctgaccaagaacgacagcagcccccagagatgcagccccgccagagagccccaggccagcgcccccagcccccccggcctgcacgtggaccccggcagaggcatgggcgccctgccctgcggcagccccagactgcagctgagccccctgaccctgtgccccctgggcagagagctggcccccagagcccacgtgctgagcaagctggagggcaccaccgaccccggcctgcccagatacagccccaccagaagatggagccccggccaggccgagagcccccccagaagcgccccccccggcaagtgggccctggccggccccggcagccccagcgccggcgagcacggccccggcctgggcctggaccccagagtgctgttcccccccgcccccctgccccacaagctgctgagcagaagccccgagacctgcgccagcccctggaaggccgagagcagaagccccagctgcagccccggccccgcccaccccctgagcagcagacccttcagcgccctgcacgacttccacggccacatcctggccagaaccgaggagaacatcttcagccacctgcccctgcacagccagcacctgaccagagccccctgccccctgatccccatcggcggcatccagatggtgcaggccagacccggcgcccaccccaccctgctgcccggccccaccgccgcctgggtgagcggcttcagcggcggcggcagcgacctgaccggcgccagagaggcccaggagagaggcagatggagccccaccgagagcagcagcgccagcgtgagccccgtggccaaggtgagcaagttcaccctgagcagcgagctggagggcggcgactaccccaaggagagagagagaaccggcggcggccccggcagaccccccgactggaccccccacggcaccggcgcccccgccgagcccacccccacccacagcccctgcaccccccccgacaccctgcccagacccccccagggcagaagagccgcccagagctggagccccagactggagagccccagagcccccaccaaccccgagcccagcgccaccccccccctggacagaagcagcagcgtgggctgcctggccgaggccagcgccagattccccgccagaaccagaaacctgagcggcgagcccagaaccagacaggacagccccaagcccagcggcagcggcgagcccagagcccacccccaccagcccgaggacagagtgccccccaacgcctag

SEQ ID NO: 84834 - DNA, 7218 bp, Artificial Sequence; identical to SEQ ID NO: 84833
  Description of Artificial Sequence: Synthetic coding sequence

SEQ ID NO: 84835 - DNA, 9429 bp, Artificial Sequence
  Description of Artificial Sequence: Synthetic coding sequence
atggccaccctggagaagctgatgaaggccttcgagagcctgaagagcttccagcagcagcagcagcagcagcagcagcagcagcagcagcagcagcagcagcagcagcagcagccccccccccccccccccccccccccccccccccagctgccccagccccccccccaggcccagcccctgctgccccagccccagccccccccccccccccccccccccccccccggccccgccgtggccgaggagcccctgcacagacccaagaaggagctgagcgccaccaagaaggacagagtgaaccactgcctgaccatctgcgagaacatcgtggcccagagcgtgagaaacagccccgagttccagaagctgctgggcatcgccatggagctgttcctgctgtgcagcgacgacgccgagagcgacgtgagaatggtggccgacgagtgcctgaacaaggtgatcaaggccctgatggacagcaacctgcccagactgcagctggagctgtacaaggagatcaagaagaacggcgcccccagaagcctgagagccgccctgtggagattcgccgagctggcccacctggtgagaccccagaagtgcagaccctacctggtgaacctgctgccctgcctgaccagaaccagcaagagacccgaggagagcgtgcaggagaccctggccgccgccgtgcccaagatcatggccagcttcggcaacttcgccaacgacaacgagatcaaggtgctgctgaaggccttcatcgccaacctgaagagcagcagccccaccatcagaagaaccgccgccggcagcgccgtgagcatctgccagcacagcagaagaacccagtacttctacagctggctgctgaacgtgctgctgggcctgctggtgcccgtggaggacgagcacagcaccctgctgatcctgggcgtgctgctgaccctgagatacctggtgcccctgctgcagcagcaggtgaaggacaccagcctgaagggcagcttcggcgtgaccagaaaggagatggaggtgagccccagcgccgagcagctggtgcaggtgtacgagctgaccctgcaccacacccagcaccaggaccacaacgtggtgaccggcgccctggagctgctgcagcagctgttcagaacccccccccccgagctgctgcagaccctgaccgccgtgggcggcatcggccagctgaccgccgccaaggaggagagcggcggcagaagcagaagcggcagcatcgtggagctgatcgccggcggcggcagcagctgcagccccgtgctgagcagaaagcagaagggcaaggtgctgctgggcgaggaggaggccctggaggacgacagcgagagcagaagcgacgtgagcagcagcgccctgaccgccagcgtgaaggacgagatcagcggcgagctggccgccagcagcggcgtgagcacccccggcagcgccggccacgacatcatcaccgagcagcccagaagccagcacaccctgcaggccgacagcgtggacctggccagctgcgacctgaccagcagcgccaccgacggcgacgaggaggacatcctgagccacagcagcagccaggtgagcgccgtgcccagcgaccccgccatggacctgaacgacggcacccaggccagcagccccatcagcgacagcagccagaccaccaccgagggccccgacagcgccgtgacccccagcgacagcagcgagatcgtgctggacggcaccgacaaccagtacctgggcctgcagatcggccagccccaggacgaggacgaggaggccaccggcatcctgcccgacgaggccagcgaggccttcagaaacagcagcatggccctgcagcaggcccacctgctgaagaacatgagccactgcagacagcccagcgacagcagcgtggacaagttcgtgctgagagacgaggccaccgagcccggcgaccaggagaacaagccctgcagaatcaagggcgacatcggccagagcaccgacgacgacagcgcccccctggtgcactgcgtgagactgctgagcgccagcttcctgctgaccggcggcaagaacgtgctggtgcccgacagagacgtgagagtgagcgtgaaggccctggccctgagctgcgtgggcgccgccgtggccctgcaccccgagagcttcttcagcaagctgtacaaggtgcccctggacaccaccgagtaccccgaggagcagtacgtgagcgacatcctgaactacatcgaccacggcgacccccaggtgagaggcgccaccgccatcctgtgcggcaccctgatctgcagcatcctgagcagaagcagattccacgtgggcgactggatgggcaccatcagaaccctgaccggcaacaccttcagcctggccgactgcatccccctgctgagaaagaccctgaaggacgagagcagcgtgacctgcaagctggcctgcaccgccgtgagaaactgcgtgatgagcctgtgcagcagcagctacagcgagctgggcctgcagctgatcatcgacgtgctgaccctgagaaacagcagctactggctggtgagaaccgagctgctggagaccctggccgagatcgacttcagactggtgagcttcctggaggccaaggccgagaacctgcacagaggcgcccaccactacaccggcctgctgaagctgcaggagagagtgctgaacaacgtggtgatccacctgctgggcgacgaggaccccagagtgagacacgtggccgccgccagcctgatcagactggtgcccaagctgttctacaagtgcgaccagggccaggccgaccccgtggtggccgtggccagagaccagagcagcgtgtacctgaagctgctgatgcacgagacccagccccccagccacttcagcgtgagcaccatcaccagaatctacagaggctacaacctgctgcccagcatcaccgacgtgaccatggagaacaacctgagcagagtgatcgccgccgtgagccacgagctgatcaccagcaccaccagagccctgaccttcggctgctgcgaggccctgtgcctgctgagcaccgccttccccgtgtgcatctggagcctgggctggcactgcggcgtgccccccctgagcgccagcgacgagagcagaaagagctgcaccgtgggcatggccaccatgatcctgaccctgctgagcagcgcctggttccccctggacctgagcgcccaccaggacgccctgatcctggccggcaacctgctggccgccagcgcccccaagagcctgagaagcagctgggccagcgaggaggaggccaaccccgccgccaccaagcaggaggaggtgtggcccgccctgggcgacagagccctggtgcccatggtggagcagctgttcagccacctgctgaaggtgatcaacatctgcgcccacgtgctggacgacgtggcccccggccccgccatcaaggccgccctgcccagcctgaccaacccccccagcctgagccccatcagaagaaagggcaaggagaaggagcccggcgagcaggccagcgtgcccctgagccccaagaagggcagcgaggccagcgccgccagcagacagagcgacaccagcggccccgtgaccaccagcaagagcagcagcctgggcagcttctaccacctgcccagctacctgaagctgcacgacgtgctgaaggccacccacgccaactacaaggtgaccctggacctgcagaacagcaccgagaagttcggcggcttcctgagaagcgccctggacgtgctgagccagatcctggagctggccaccctgcaggacatcggcaagtgcgtggaggagatcctgggctacctgaagagctgcttcagcagagagcccatgatggccaccgtgtgcgtgcagcagctgctgaagaccctgttcggcaccaacctggccagccagttcgacggcctgagcagcaaccccagcaagagccagggcagagcccagagactgggcagcagcagcgtgagacccggcctgtaccactactgcttcatggccccctacacccacttcacccaggccctggccgacgccagcctgagaaacatggtgcaggccgagcaggagaacgacaccagcggctggttcgacgtgctgcagaaggtgagcacccagctgaagaccaacctgaccagcgtgaccaagaacagagccgacaagaacgccatccacaaccacatcagactgttcgagcccctggtgatcaaggccctgaagcagtacaccaccaccacctgcgtgcagctgcagaagcaggtgctggacctgctggcccagctggtgcagctgagagtgaactactgcctgctggacagcgaccaggtgttcatcggcttcgtgctgaagcagttcgagtacatcgaggtgggccagttcagagagagcgaggccatcatccccaacatcttcttcttcctggtgctgctgagctacgagagataccacagcaagcagatcatcggcatccccaagatcatccagctgtgcgacggcatcatggccagcggcagaaaggccgtgacccacgccatccccgccctgcagcccatcgtgcacgacctgttcgtgctgagaggcaccaacaaggccgacgccggcaaggagctggagacccagaaggaggtggtggtgagcatgctgctgagactgatccagtaccaccaggtgctggagatgttcatcctggtgctgcagcagtgccacaaggagaacgaggacaagtggaagagactgagcagacagatcgccgacatcatcctgcccatgctggccaagcagcagatgcacatcgacagccacgaggccctgggcgtgctgaacaccctgttcgagatcctggcccccagcagcctgagacccgtggacatgctgctgagaagcatgttcgtgacccccaacaccatggccagcgtgagcaccgtgcagctgtggatcagcggcatcctggccatcctgagagtgctgatcagccagagcaccgaggacatcgtgctgagcagaatccaggagctgagcttcagcccctacctgatcagctgcaccgtgatcaacagactgagagacggcgacagcaccagcaccctggaggagcacagcgagggcaagcagatcaagaacctgcccgaggagaccttcagcagattcctgctgcagctggtgggcatcctgctggaggacatcgtgaccaagcagctgaaggtggagatgagcgagcagcagcacaccttctactgccaggagctgggcaccctgctgatgtgcctgatccacatcttcaagagcggcatgttcagaagaatcaccgccgccgccaccagactgttcagaagcgacggctgcggcggcagcttctacaccctggacagcctgaacctgagagccagaagcatgatcaccacccaccccgccctggtgctgctgtggtgccagatcctgctgctggtgaaccacaccgactacagatggtgggccgaggtgcagcagacccccaagagacacagcctgagcagcaccaagctgctgagcccccagatgagcggcgaggaggaggacagcgacctggccgccaagctgggcatgtgcaacagagagatcgtgagaagaggcgccctgatcctgttctgcgactacgtgtgccagaacctgcacgacagcgagcacctgacctggctgatcgtgaaccacatccaggacctgatcagcctgagccacgagccccccgtgcaggacttcatcagcgccgtgcacagaaacagcgccgccagcggcctgttcatccaggccatccagagcagatgcgagaacctgagcacccccaccatgctgaagaagaccctgcagtgcctggagggcatccacctgagccagagcggcgccgtgctgaccctgtacgtggacagactgctgtgcacccccttcagagtgctggccagaatggtggacatcctggcctgcagaagagtggagatgctgctggccgccaacctgcagagcagcatggcccagctgcccatggaggagctgaacagaatccaggagtacctgcagagcagcggcctggcccagagacaccagagactgtacagcctgctggacagattcagactgagcaccatgcaggacagcctgagccccagcccccccgtgagcagccaccccctggacggcgacggccacgtgagcctggagaccgtgagccccgacaaggactggtacgtgcacctggtgaagagccagtgctggaccagaagcgacagcgccctgctggagggcgccgagctggtgaacagaatccccgccgaggacatgaacgccttcatgatgaacagcgagttcaacctgagcctgctggccccctgcctgagcctgggcatgagcgagatcagcggcggccagaagagcgccctgttcgaggccgccagagaggtgaccctggccagagtgagcggcaccgtgcagcagctgcccgccgtgcaccacgtgttccagcccgagctgcccgccgagcccgccgcctactggagcaagctgaacgacctgttcggcgacgccgccctgtaccagagcctgcccaccctggccagagccctggcccagtacctggtggtggtgagcaagctgcccagccacctgcacctgccccccgagaaggagaaggacatcgtgaagttcgtggtggccaccctggaggccctgagctggcacctgatccacgagcagatccccctgagcctggacctgcaggccggcctggactgctgctgcctggccctgcagctgcccggcctgtggagcgtggtgagcagcaccgagttcgtgacccacgcctgcagcctgatctactgcgtgcacttcatcctggaggccgtggccgtgcagcccggcgagcagctgctgagccccgagagaagaaccaacacccccaaggccatcagcgaggaggaggaggaggtggaccccaacacccagaaccccaagtacatcaccgccgcctgcgagatggtggccgagatggtggagagcctgcagagcgtgctggccctgggccacaagagaaacagcggcgtgcccgccttcctgacccccctgctgagaaacatcatcatcagcctggccagactgcccctggtgaacagctacaccagagtgccccccctggtgtggaagctgggctggagccccaagcccggcggcgacttcggcaccgccttccccgagatccccgtggagttcctgcaggagaaggaggtgttcaaggagttcatctacagaatcaacaccctgggctggaccagcagaacccagttcgaggagacctgggccaccctgctgggcgtgctggtgacccagcccctggtgatggagcaggaggagagcccccccgaggaggacaccgagagaacccagatcaacgtgctggccgtgcaggccatcaccagcctggtgctgagcgccatgaccgtgcccgtggccggcaaccccgccgtgagctgcctggagcagcagcccagaaacaagcccctgaaggccctggacaccagattcggcagaaagctgagcatcatcagaggcatcgtggagcaggagatccaggccatggtgagcaagagagagaacatcgccacccaccacctgtaccaggcctgggaccccgtgcccagcctgagccccgccaccaccggcgccctgatcagccacgagaagctgctgctgcagatcaaccccgagagagagctgggcagcatgagctacaagctgggccaggtgagcatccacagcgtgtggctgggcaacagcatcacccccctgagagaggaggagtgggacgaggaggaggaggaggaggccgacgcccccgcccccagcagcccccccaccagccccgtgaacagcagaaagcacagagccggcgtggacatccacagctgcagccagttcctgctggagctgtacagcagatggatcctgcccagcagcagcgccagaagaacccccgccatcctgatcagcgaggtggtgagaagcctgctggtggtgagcgacctgttcaccgagagaaaccagttcgagctgatgtacgtgaccctgaccgagctgagaagagtgcaccccagcgaggacgagatcctggcccagtacctggtgcccgccacctgcaaggccgccgccgtgctgggcatggacaaggccgtggccgagcccgtgagcagactgctggagagcaccctgagaagcagccacctgcccagcagagtgggcgccctgcacggcgtgctgtacgtgctggagtgcgacctgctggacgacaccgccaagcagctgatccccgtgatcagcgactacctgctgagcaacctgaagggcatcgcccactgcgtgaacatccacagccagcagcacgtgctggtgatgtgcgccaccgccttctacctgatcgagaactaccccctggacgtgggccccgagttcagcgccagcatcatccagatgtgcggcgtgatgctgagcggcagcgaggagagcacccccagcatcatctaccactgcgccctgagaggcctggagagactgctgctgagcgagcagctgagcagactggacgccgagagcctggtgaagctgagcgtggacagagtgaacgtgcacagcccccacagagccatggccgccctgggcctgatgctgacctgcatgtacaccggcaaggagaaggtgagccccggcagaaccagcgaccccaaccccgccgcccccgacagcgagagcgtgatcgtggccatggagagagtgagcgtgctgttcgacagaatcagaaagggcttcccctgcgaggccagagtggtggccagaatcctgccccagttcctggacgacttcttccccccccaggacatcatgaacaaggtgatcggcgagttcctgagcaaccagcagccctacccccagttcatggccaccgtggtgtacaaggtgttccagaccctgcacagcaccggccagagcagcatggtgagagactgggtgatgctgagcctgagcaacttcacccagagagcccccgtggccatggccacctggagcctgagctgcttcttcgtgagcgccagcaccagcccctgggtggccgccatcctgccccacgtgatcagcagaatgggcaagctggagcaggtggacgtgaacctgttctgcctggtggccaccgacttctacagacaccagatcgaggaggagctggacagaagagccttccagagcgtgctggaggtggtggccgcccccggcagcccctaccacagactgctgacctgcctgagaaacgtgcacaaggtgaccacctgctag

SEQ ID NO: 84836 - DNA, 3114 bp, Artificial Sequence
  Description of Artificial Sequence: Synthetic coding sequence
atggacagaatggccagcagcatgaagcaggtgcccaaccccctgcccaaggtgctgagcagaagaggcgtgggcgccggcctggaggccgccgagagagagagcttcgagagaacccagaccgtgagcatcaacaaggccatcaacacccaggaggtggccgtgaaggagaagcacgccagaacctgcatcctgggcacccaccacgagaagggcgcccagaccttctggagcgtggtgaacagactgcccctgagcagcaacgccgtgctgtgctggaagttctgccacgtgttccacaagctgctgagagacggccaccccaacgtgctgaaggacagcctgagatacagaaacgagctgagcgacatgagcagaatgtggggccacctgagcgagggctacggccagctgtgcagcatctacctgaagctgctgagaaccaagatggagtaccacaccaagaaccccagattccccggcaacctgcagatgagcgacagacagctggacgaggccggcgagagcgacgtgaacaacttcttccagctgaccgtggagatgttcgactacctggagtgcgagctgaacctgttccagaccgtgttcaacagcctggacatgagcagaagcgtgagcgtgaccgccgccggccagtgcagactggcccccctgatccaggtgatcctggactgcagccacctgtacgactacaccgtgaagctgctgttcaagctgcacagctgcctgcccgccgacaccctgcagggccacagagacagattcatggagcagttcaccaagctgaaggacctgttctacagaagcagcaacctgcagtacttcaagagactgatccagatcccccagctgcccgagaacccccccaacttcctgagagccagcgccctgagcgagcacatcagccccgtggtggtgatccccgccgaggccagcagccccgacagcgagcccgtgctggagaaggacgacctgatggacatggacgccagccagcagaacctgttcgacaacaagttcgacgacatcttcggcagcagcttcagcagcgaccccttcaacttcaacagccagaacggcgtgaacaaggacgagaaggaccacctgatcgagagactgtacagagagatcagcggcctgaaggcccagctggagaacatgaagaccgagagccagagagtggtgctgcagctgaagggccacgtgagcgagctggaggccgacctggccgagcagcagcacctgagacagcaggccgccgacgactgcgagttcctgagagccgagctggacgagctgagaagacagagagaggacaccgagaaggcccagagaagcctgagcgagatcgagagaaaggcccaggccaacgagcagagatacagcaagctgaaggagaagtacagcgagctggtgcagaaccacgccgacctgctgagaaagaacgccgaggtgaccaagcaggtgagcatggccagacaggcccaggtggacctggagagagagaagaaggagctggaggacagcctggagagaatcagcgaccagggccagagaaagacccaggagcagctggaggtgctggagagcctgaagcaggagctggccaccagccagagagagctgcaggtgctgcagggcagcctggagaccagcgcccagagcgaggccaactgggccgccgagttcgccgagctggagaaggagagagacagcctggtgagcggcgccgcccacagagaggaggagctgagcgccctgagaaaggagctgcaggacacccagctgaagctggccagcaccgaggagagcatgtgccagctggccaaggaccagagaaagatgctgctggtgggcagcagaaaggccgccgagcaggtgatccaggacgccctgaaccagctggaggagccccccctgatcagctgcgccggcagcgccgaccacctgctgagcaccgtgaccagcatcagcagctgcatcgagcagctggagaagagctggagccagtacctggcctgccccgaggacatcagcggcctgctgcacagcatcaccctgctggcccacctgaccagcgacgccatcgcccacggcgccaccacctgcctgagagccccccccgagcccgccgacagcctgaccgaggcctgcaagcagtacggcagagagaccctggcctacctggccagcctggaggaggagggcagcctggagaacgccgacagcaccgccatgagaaactgcctgagcaagatcaaggccatcggcgaggagctgctgcccagaggcctggacatcaagcaggaggagctgggcgacctggtggacaaggagatggccgccaccagcgccgccatcgagaccgccaccgccagaatcgaggagatgctgagcaagagcagagccggcgacaccggcgtgaagctggaggtgaacgagagaatcctgggctgctgcaccagcctgatgcaggccatccaggtgctgatcgtggccagcaaggacctgcagagagagatcgtggagagcggcagaggcaccgccagccccaaggagttctacgccaagaacagcagatggaccgagggcctgatcagcgccagcaaggccgtgggctggggcgccaccgtgatggtggacgccgccgacctggtggtgcagggcagaggcaagttcgaggagctgatggtgtgcagccacgagatcgccgccagcaccgcccagctggtggccgccagcaaggtgaaggccgacaaggacagccccaacctggcccagctgcagcaggccagcagaggcgtgaaccaggccaccgccggcgtggtggccagcaccatcagcggcaagagccagatcgaggagaccgacaacatggacttcagcagcatgaccctgacccagatcaagagacaggagatggacagccaggtgagagtgctggagctggagaacgagctgcagaaggagagacagaagctgggcgagctgagaaagaagcactacgagctggccggcgtggccgagggctgggaggagggcaccgaggccagcccccccaccctgcaggaggtggtgaccgagaaggagtag

SEQ ID NO: 84837 - DNA, 2961 bp, Artificial Sequence
  Description of Artificial Sequence: Synthetic coding sequence
atggacagaatggccagcagcatgaagcaggtgcccaaccccctgcccaaggtgctgagcagaagaggcgtgggcgccggcctggaggccgccgagagagagagcttcgagagaacccagaccgtgagcatcaacaaggccatcaacacccaggaggtggccgtgaaggagaagcacgccagaacctgcatcctgggcacccaccacgagaagggcgcccagaccttctggagcgtggtgaacagactgcccctgagcagcaacgccgtgctgtgctggaagttctgccacgtgttccacaagctgctgagagacggccaccccaacgtgctgaaggacagcctgagatacagaaacgagctgagcgacatgagcagaatgtggggccacctgagcgagggctacggccagctgtgcagcatctacctgaagctgctgagaaccaagatggagtaccacaccaagaaccccagattccccggcaacctgcagatgagcgacagacagctggacgaggccggcgagagcgacgtgaacaacttcttccagctgaccgtggagatgttcgactacctggagtgcgagctgaacctgttccagaccgtgttcaacagcctggacatgagcagaagcgtgagcgtgaccgccgccggccagtgcagactggcccccctgatccaggtgatcctggactgcagccacctgtacgactacaccgtgaagctgctgttcaagctgcacagctgcctgcccgccgacaccctgcagggccacagagacagattcatggagcagttcaccaagctgaaggacctgttctacagaagcagcaacctgcagtacttcaagagactgatccagatcccccagctgcccgagaacccccccaacttcctgagagccagcgccctgagcgagcacatcagccccgtggtggtgatccccgccgaggccagcagccccgacagcgagcccgtgctggagaaggacgacctgatggacatggacgccagccagcagaacctgttcgacaacaagttcgacgacatcttcggcagcagcttcagcagcgaccccttcaacttcaacagccagaacggcgtgaacaaggacgagaaggaccacctgatcgagagactgtacagagagatcagcggcctgaaggcccagctggagaacatgaagaccgagagccagagagtggtgctgcagctgaagggccacgtgagcgagctggaggccgacctggccgagcagcagcacctgagacagcaggccgccgacgactgcgagttcctgagagccgagctggacgagctgagaagacagagagaggacaccgagaaggcccagagaagcctgagcgagatcgagagaaaggcccaggccaacgagcagagatacagcaagctgaaggagaagtacagcgagctggtgcagaaccacgccgacctgctgagaaagaacgccgaggtgaccaagcaggtgagcatggccagacaggcccaggtggacctggagagagagaagaaggagctggaggacagcctggagagaatcagcgaccagggccagagaaagacccaggagcagctggaggtgctggagagcctgaagcaggagctggccaccagccagagagagctgcaggtgctgcagggcagcctggagaccagcgcccagagcgaggccaactgggccgccgagttcgccgagctggagaaggagagagacagcctggtgagcggcgccgcccacagagaggaggagctgagcgccctgagaaaggagctgcaggacacccagctgaagctggccagcaccgaggagagcatgtgccagctggccaaggaccagagaaagatgctgctggtgggcagcagaaaggccgccgagcaggtgatccaggacgccctgaaccagctggaggagccccccctgatcagctgcgccggcagcgccgaccacctgctgagcaccgtgaccagcatcagcagctgcatcgagcagctggagaagagctggagccagtacctggcctgccccgaggacatcagcggcctgctgcacagcatcaccctgctggcccacctgaccagcgacgccatcgcccacggcgccaccacctgcctgagagccccccccgagcccgccgacagcctgaccgaggcctgcaagcagtacggcagagagaccctggcctacctggccagcctggaggaggagggcagcctggagaacgccgacagcaccgccatgagaaactgcctgagcaagatcaaggccatcggcgaggagctgctgcccagaggcctggacatcaagcaggaggagctgggcgacctggtggacaaggagatggccgccaccagcgccgccatcgagaccgccaccgccagaatcgagggcaccgccagccccaaggagttctacgccaagaacagcagatggaccgagggcctgatcagcgccagcaaggccgtgggctggggcgccaccgtgatggtggacgccgccgacctggtggtgcagggcagaggcaagttcgaggagctgatggtgtgcagccacgagatcgccgccagcaccgcccagctggtggccgccagcaaggtgaaggccgacaaggacagccccaacctggcccagctgcagcaggccagcagaggcgtgaaccaggccaccgccggcgtggtggccagcaccatcagcggcaagagccagatcgaggagaccgacaacatggacttcagcagcatgaccctgacccagatcaagagacaggagatggacagccaggtgagagtgctggagctggagaacgagctgcagaaggagagacagaagctgggcgagctgagaaagaagcactacgagctggccggcgtggccgagggctgggaggagggcaccgaggccagcccccccaccctgcaggaggtggtgaccgagaaggagtag

SEQ ID NO: 84838 - DNA, 3207 bp, Artificial Sequence
  Description of Artificial Sequence: Synthetic coding sequence
atgaacagcatcaagaacgtgcccgccagagtgctgagcagaagacccggccacagcctggaggccgagagagagcagttcgacaagacccaggccatcagcatcagcaaggccatcaacacccaggaggcccccgtgaaggagaagcacgccagaagaatcatcctgggcacccaccacgagaagggcgccttcaccttctggagctacgccatcggcctgcccctgcccagcagcagcatcctgagctggaagttctgccacgtgctgcacaaggtgctgagagacggccaccccaacgtgctgcacgactgccagagatacagaagcaacatcagagagatcggcgacctgtggggccacctgcacgacagatacggccagctggtgaacgtgtacaccaagctgctgctgaccaagatcagcttccacctgaagcacccccagttccccgccggcctggaggtgaccgacgaggtgctggagaaggccgccggcaccgacgtgaacaacatcttccagctgaccgtggagatgttcgactacatggactgcgagctgaagctgagcgagagcgtgttcagacagctgaacaccgccatcgccgtgagccagatgagcagcggccagtgcagactggcccccctgatccaggtgatccaggactgcagccacctgtaccactacaccgtgaagctgctgttcaagctgcacagctgcctgcccgccgacaccctgcagggccacagagacagattccacgagcagttccacagcctgagaaacttcttcagaagagccagcgacatgctgtacttcaagagactgatccagatccccagactgcccgagggcccccccaacttcctgagagccagcgccctggccgagcacatcaagcccgtggtggtgatccccgaggaggcccccgaggacgaggagcccgagaacctgatcgagatcagcaccggcccccccgccggcgagcccgtggtggtggccgacctgttcgaccagaccttcggcccccccaacggcagcgtgaaggacgacagagacctgcagatcgagagcctgaagagagaggtggagatgctgagaagcgagctggagaagatcaagctggaggcccagagatacatcgcccagctgaagagccaggtgaacgccctggagggcgagctggaggagcagagaaagcagaagcagaaggccctggtggacaacgagcagctgagacacgagctggcccagctgagagccgcccagctggagggcgagagaagccagggcctgagagaggaggccgagagaaaggccagcgccaccgaggccagatacaacaagctgaaggagaagcacagcgagctggtgcacgtgcacgccgagctgctgagaaagaacgccgacaccgccaagcagctgaccgtgacccagcagagccaggaggaggtggccagagtgaaggagcagctggccttccaggtggagcaggtgaagagagagagcgagctgaagctggaggagaagagcgaccagctggagaagctgaagagagagctggaggccaaggccggcgagctggccagagcccaggaggccctgagccacaccgagcagagcaagagcgagctgagcagcagactggacaccctgagcgccgagaaggacgccctgagcggcgccgtgagacagagagaggccgacctgctggccgcccagagcctggtgagagagaccgaggccgccctgagcagagagcagcagagaagcagccaggagcagggcgagctgcagggcagactggccgagagagagagccaggagcagggcctgagacagagactgctggacgagcagttcgccgtgctgagaggcgccgccgccgaggccgccggcatcctgcaggacgccgtgagcaagctggacgaccccctgcacctgagatgcaccagcagccccgactacctggtgagcagagcccaggaggccctggacgccgtgagcaccctggaggagggccacgcccagtacctgaccagcctggccgacgccagcgccctggtggccgccctgaccagattcagccacctggccgccgacaccatcatcaacggcggcgccaccagccacctggcccccaccgaccccgccgacagactgatcgacacctgcagagagtgcggcgccagagccctggagctgatgggccagctgcaggaccagcaggccctgagacacatgcaggccagcctggtgagaacccccctgcagggcatcctgcagctgggccaggagctgaagcccaagagcctggacgtgagacaggaggagctgggcgccgtggtggacaaggagatggccgccaccagcgccgccatcgaggacgccgtgagaagaatcgaggacatgatgaaccaggccagacacgccagcagcggcgtgaagctggaggtgaacgagagaatcctgaacagctgcaccgacctgatgaaggccatcagactgctggtgaccaccagcaccagcctgcagaaggagatcgtggagagcggcagaggcgccgccacccagcaggagttctacgccaagaacagcagatggaccgagggcctgatcagcgccagcaaggccgtgggctggggcgccacccagctggtggaggccgccgacaaggtggtgctgcacaccggcaagtacgaggagctgatcgtgtgcagccacgagatcgccgccagcaccgcccagctggtggccgccagcaaggtgaaggccaacaagcacagcccccacctgagcagactgcaggagtgcagcagaaccgtgaacgagagagccgccaacgtggtggccagcaccaagagcggccaggagcagatcgaggacagagacaccatggacttcagcggcctgagcctgatcaagctgaagaagcaggagatggagacccaggtgagagtgctggagctggagaagaccctggaggccgagagaatgagactgggcgagctgagaaagcagcactacgtgctggccggcgccagcggcagccccggcgaggaggtggccatcagacccagcaccgcccccagaagcgtgaccaccaagaagccccccctggcccagaagcccagcgtggcccccagacaggaccaccagctggacaagaaggacggcatctaccccgcccagctggtgaactactag

SEQ ID NO: 84839 - DNA, 753 bp, Artificial Sequence
  Description of Artificial Sequence: Synthetic coding sequence
atggcccacgtgggcaccagcagagtgggcagcgtgctgagcatgagcctgagcatccacctgctggtgcccaccatgaccaagggcgagaccggcaagcccggccaccacgaggcccccagaaccctgcaggccttcccctggacctgggccagagccagccccggcgtgagcgtggacatgagcgccggcctgccccagagcctgctgtgctggcccggcgcccccctgctgcccaccccccccctgcccagcgccacctacgtgggccacagcctgggcctgcccagagccggcagcagcgtgggcccctggttcagcggcagatgggtgggcggcgccctggtgcagtggcccctgggcggcggcggccccggcagcgtggccgccggcctgggcggccccctggtgagatggctgctgggcggcggcgccctggtgagatggcccctgggcggcggcggccccggcagcgtggccgccggctggggcggcccctggttcggcggcagatgggtgggcggcccccccggcagcgtggccgccggctggggcggccccgtgagatggcccctgggcggcggcggccccggcagcgtggccaccggctggggcggcccctggttcggcggcagatgggtgggcggcccccccggcagcgtggccgccggctgcggcggcgccctggtgcagtggcccctgggcggcggcagcctgcacagcatccccagcttccccagagcctggagatag

SEQ ID NO: 84840 - DNA, 2016 bp, Artificial Sequence
  Description of Artificial Sequence: Synthetic coding sequence
atgagacccaagagactgggcagatgctgcgccggcagcagactgggccccggcgaccccgccgccctgacctgcgcccccagccccagcgccagccccgcccccgagcccagcgcccagccccaggccagaggcaccggccagagagtgggcagcagagccaccagcggcagccagttcctgagcgaggccagaaccggcgccagacccgccagcgaggccggcgccaaggccggcgccagaagacccagcgccttcagcgccatccagggcgacgtgagaagcatgcccgacaacagcgacgccccctggaccagattcgtgttccagggccccttcggcagcagagccaccggcagaggcaccggcaaggccgccggcatctggaagacccccgccgcctacgtgggcagaagacccggcgtgagcggccccgagagagccgccttcatcagagagctggaggaggccctgtgccccaacctgcccccccccgtgaagaagatcacccaggaggacgtgaaggtgatgctgtacctgctggaggagctgctgccccccgtgtgggagagcgtgacctacggcatggtgctgcagagagagagagacctgaacaccgccgccagaatcggccagagcctggtgaagcagaacagcgtgctgatggaggagaacagcaagctggaggccctgctgggcagcgccaaggaggagatcctgtacctgagacaccaggtgaacctgagagacgagctgctgcagctgtacagcgacagcgacgaggaggacgaggacgaggaggaggaggaggaggagaaggaggccgaggaggagcaggaggaggaggaggccgaggaggacctgcagtgcgcccacccctgcgacgcccccaagctgatcagccaggaggccctgctgcaccagcaccactgcccccagctggaggccctgcaggagaagctgagactgctggaggaggagaaccaccagctgagagaggaggccagccagctggacaccctggaggacgaggagcagatgctgatcctggagtgcgtggagcagttcagcgaggccagccagcagatggccgagctgagcgaggtgctggtgctgagactggagaactacgagagacagcagcaggaggtggccagactgcaggcccaggtgctgaagctgcagcagagatgcagaatgtacggcgccgagaccgagaagctgcagaagcagctggccagcgagaaggagatccagatgcagctgcaggaggagagcgtgtgggtgggcagccagctgcaggacctgagagagaagtacatggactgcggcggcatgctgatcgagatgcaggaggaggtgaagaccctgagacagcagccccccgtgagcaccggcagcgccacccactacccctacagcgtgcccctggagaccctgcccggcttccaggagaccctggccgaggagctgagaaccagcctgagaagaatgatcagcgaccccgtgtacttcatggagagaaactacgagatgcccagaggcgacaccagcagcctgagatacgacttcagatacagcgaggacagagagcaggtgagaggcttcgaggccgaggagggcctgatgctggccgccgacatcatgagaggcgaggacttcacccccgccgaggagttcgtgccccaggaggagctgggcgccgccaagaaggtgcccgccgaggagggcgtgatggaggaggccgagctggtgagcgaggagaccgagggctgggaggaggtggagctggagctggacgaggccaccagaatgaacgtggtgaccagcgccctggaggccagcggcctgggccccagccacctggacatgaactacgtgctgcagcagctggccaactggcaggacgcccactacagaagacagctgagatggaagatgctgcagaagggcgagtgcccccacggcgccctgcccgccgccagcagaaccagctgcagaagcagctgcagatag

SEQ ID NO: 84841 - DNA, 1809 bp, Artificial Sequence
  Description of Artificial Sequence: Synthetic coding sequence
atgagacccaagagactgggcagatgctgcgccggcagcagactgggccccggcgaccccgccgccctgacctgcgcccccagccccagcgccagccccgcccccgagcccagcgcccagccccaggccagaggcaccggccagagagtgggcagcagagccaccagcggcagccagttcctgagcgaggccagaaccggcgccagacccgccagcgaggccggcgccaaggccggcgccagaagacccagcgccttcagcgccatccagggcgacgtgagaagcatgcccgacaacagcgacgccccctggaccagattcgtgttccagggccccttcggcagcagagccaccggcagaggcaccggcaaggccgccggcatctggaagacccccgccgcctacgtgggcagaagacccggcgtgagcggccccgagagagccgccttcatcagagagctggaggaggccctgtgccccaacctgcccccccccgtgaagaagatcacccaggaggacgtgaaggtgatgctgtacctgctggaggaggtgtgcaccgccttcctgatccagctgctgccccccgtgtgggagagcgtgacctacggcatggtgctgcagagagagagagacctgaacaccgccgccagaatcggccagagcctggtgaagcagaacagcgtgctgatggaggagaacagcaagctggaggccctgctgggcagcgccaaggaggagatcctgtacctgagacaccaggtgaacctgagagacgagctgctgcagctgtacagcgacagcgacgaggaggacgaggacgaggaggaggaggaggaggagaaggaggccgaggaggagcaggaggaggaggaggccgaggaggacctgcagtgcgcccacccctgcgacgcccccaagctgatcagccaggaggccctgctgcaccagcaccactgcccccagctggaggccctgcaggagaagctgagactgctggaggaggagaaccaccagctgagagaggaggccagccagctggacaccctggaggacgaggagcagatgctgatcctggagtgcgtggagcagttcagcgaggccagccagcagatggccgagctgagcgaggtgctggtgctgagactggagaactacgagagacagcagcaggaggtggccagactgcaggcccaggtgctgaagctgcagcagagatgcagaatggagaccctgcccggcttccaggagaccctggccgaggagctgagaaccagcctgagaagaatgatcagcgaccccgtgtacttcatggagagaaactacgagatgcccagaggcgacaccagcagcctgagatacgacttcagatacagcgaggacagagagcaggtgagaggcttcgaggccgaggagggcctgatgctggccgccgacatcatgagaggcgaggacttcacccccgccgaggagttcgtgccccaggaggagctgggcgccgccaagaaggtgcccgccgaggagggcgtgatggaggaggccgagctggtgagcgaggagaccgagggctgggaggaggtggagctggagctggacgaggccaccagaatgaacgtggtgaccagcgccctggaggccagcggcctgggccccagccacctggacatgaactacgtgctgcagcagctggccaactggcaggacgcccactacagaagacagctgagatggaagatgctgcagaagggcgagtgcccccacggcgccctgcccgccgccagcagaaccagctgcagaagcagctgcagatag

SEQ ID NO: 84842 - DNA, 1860 bp, Artificial Sequence
  Description of Artificial Sequence: Synthetic coding sequence
atgagacccaagagactgggcagatgctgcgccggcagcagactgggccccggcgaccccgccgccctgacctgcgcccccagccccagcgccagccccgcccccgagcccagcgcccagccccaggccagaggcaccggccagagagtgggcagcagagccaccagcggcagccagttcctgagcgaggccagaaccggcgccagacccgccagcgaggccggcgccaaggccggcgccagaagacccagcgccttcagcgccatccagggcgacgtgagaagcatgcccgacaacagcgacgccccctggaccagattcgtgttccagggccccttcggcagcagagccaccggcagaggcaccggcaaggccgccggcatctggaagacccccgccgcctacgtgggcagaagacccggcgtgagcggccccgagagagccgccttcatcagagagctggaggaggccctgtgccccaacctgcccccccccgtgaagaagatcacccaggaggacgtgaaggtgatgctgtacctgctggaggagctgctgccccccgtgtgggagagcgtgacctacggcatggtgctgcagagagagagagacctgaacaccgccgccagaatcggccagagcctggtgaagcagaacagcgtgctgatggaggagaacagcaagctggaggccctgctgggcagcgccaaggaggagatcctgtacctgagacaccaggtgaacctgagagacgagctgctgcagctgtacagcgacagcgacgaggaggacgaggacgaggaggaggaggaggaggagaaggaggccgaggaggagcaggaggaggaggaggccgaggaggacctgcagtgcgcccacccctgcgacgcccccaagctgatcagccaggaggccctgctgcaccagcaccactgcccccagctggaggccctgcaggagaagctgagactgctggaggaggagaaccaccagctgagagaggaggccagccagctggacaccctggaggacgaggagcagatgctgatcctggagtgcgtggagcagttcagcgaggccagccagcagatggccgagctgagcgaggtgctggtgctgagactggagaactacgagagacagcagcaggaggtggccagactgcaggcccaggtgctgaagctgcagcagagatgcagaatgtacggcgccgagaccgagaagctgcagaagcagctggccagcgagaaggagatccagatgcagctgcaggaggaggagaccctgcccggcttccaggagaccctggccgaggagctgagaaccagcctgagaagaatgatcagcgaccccgtgtacttcatggagagaaactacgagatgcccagaggcgacaccagcagcctgagatacgacttcagatacagcgaggacagagagcaggtgagaggcttcgaggccgaggagggcctgatgctggccgccgacatcatgagaggcgaggacttcacccccgccgaggagttcgtgccccaggaggagctgggcgccgccaagaaggtgcccgccgaggagggcgtgatggaggaggccgagctggtgagcgaggagaccgagggctgggaggaggtggagctggagctggacgaggccaccagaatgaacgtggtgaccagcgccctggaggccagcggcctgggccccagccacctggacatgaactacgtgctgcagcagctggccaactggcaggacgcccactacagaagacagctgagatggaagatgctgcagaagggcgagtgcccccacggcgccctgcccgccgccagcagaaccagctgcagaagcagctgcagatag

SEQ ID NO: 84843 - DNA, 1785 bp, Artificial Sequence
  Description of Artificial Sequence: Synthetic coding sequence
atgagacccaagagactgggcagatgctgcgccggcagcagactgggccccggcgaccccgccgccctgacctgcgcccccagccccagcgccagccccgcccccgagcccagcgcccagccccaggccagaggcaccggccagagagtgggcagcagagccaccagcggcagccagttcctgagcgaggccagaaccggcgccagacccgccagcgaggccggcgccaaggccggcgccagaagacccagcgccttcagcgccatccagggcgacgtgagaagcatgcccgacaacagcgacgccccctggaccagattcgtgttccagggccccttcggcagcagagccaccggcagaggcaccggcaaggccgccggcatctggaagacccccgccgcctacgtgggcagaagacccggcgtgagcggccccgagagagccgccttcatcagagagctggaggaggccctgtgccccaacctgcccccccccgtgaagaagatcacccaggaggacgtgaaggtgatgctgtacctgctggaggagctgctgccccccgtgtgggagagcgtgacctacggcatggtgctgcagagagagagagacctgaacaccgccgccagaatcggccagagcctggtgaagcagaacagcgtgctgatggaggagaacagcaagctggaggccctgctgggcagcgccaaggaggagatcctgtacctgagacaccaggtgaacctgagagacgagctgctgcagctgtacagcgacagcgacgaggaggacgaggacgaggaggaggaggaggaggagaaggaggccgaggaggagcaggaggaggaggaggccgaggaggacctgcagtgcgcccacccctgcgacgcccccaagctgatcagccaggaggccctgctgcaccagcaccactgcccccagctggaggccctgcaggagaagctgagactgctggaggaggagaaccaccagctgagagaggaggccagccagctggacaccctggaggacgaggagcagatgctgatcctggagtgcgtggagcagttcagcgaggccagccagcagatggccgagctgagcgaggtgctggtgctgagactggagaactacgagagacagcagcaggaggtggccagactgcaggcccaggtgctgaagctgcagcagagatgcagaatggagaccctgcccggcttccaggagaccctggccgaggagctgagaaccagcctgagaagaatgatcagcgaccccgtgtacttcatggagagaaactacgagatgcccagaggcgacaccagcagcctgagatacgacttcagatacagcgaggacagagagcaggtgagaggcttcgaggccgaggagggcctgatgctggccgccgacatcatgagaggcgaggacttcacccccgccgaggagttcgtgccccaggaggagctgggcgccgccaagaaggtgcccgccgaggagggcgtgatggaggaggccgagctggtgagcgaggagaccgagggctgggaggaggtggagctggagctggacgaggccaccagaatgaacgtggtgaccagcgccctggaggccagcggcctgggccccagccacctggacatgaactacgtgctgcagcagctggccaactggcaggacgcccactacagaagacagctgagatggaagatgctgcagaagggcgagtgcccccacggcgccctgcccgccgccagcagaaccagctgcagaagcagctgcagatag

SEQ ID NO: 84844 - DNA, 837 bp, Artificial Sequence
  Description of Artificial Sequence: Synthetic coding sequence
atgaagttcagagccaagatcaccggcaagggctgcctggagctgttcatccacgtgagcggcaccgtggccagactggccaaggtgtgcgtgctgagagtgagacccgacagcctgtgcttcggccccgccggcagcggcggcctgcacgaggccagactgtggtgcgaggtgagacagggcgccttccagcagttcagaatggagggcgtgagcgaggacctggacgagatccacctggagctgaccgccgagcacctgagcagagccgccagaagcgccgccggcgccagcagcctgaagctgcagctgacccacaagagaagacccagcctgaccgtggccgtggagctggtgagcagcctgggcagagccagaagcgtggtgcacgacctgcccgtgagagtgctgcccagaagagtgtggagagactgcctgccccccagcctgagagccagcgacgccagcatcagactgcccagatggagaaccctgagaagcatcgtggagagaatggccaacgtgggcagccacgtgctggtggaggccaacctgagcggcagaatgaccctgagcatcgagaccgaggtggtgagcatccagagctacttcaagaacctgggcaaccccccccagagcgccgtgggcgtgcccgagaacagagacctggagagcatggtgcaggtgagagtggacaacagaaagctgctgcagttcctggagggccagcagatccaccccaccaccgccctgtgcaacatctgggacaacaccctgctgcagctggtgctggtgcaggaggacgtgagcctgcagtacttcatccccgccctgtag

SEQ ID NO: 84845 - DNA, 1065 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggccgagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggccctggacctgcagggcgtggtgttcccctacttccccagactgggcagatacaacctgaacttccacgaggcccagcaggcctgcctggaccaggacgccgtgatcgccagcttcgaccagctgtacgacgcctggagaggcggcctggactggtgcaacgccggctggctgagcgacggcagcgtgcagtaccccatcaccaagcccagagagccctgcggcggccagaacaccgtgcccggcgtgagaaactacggcttctgggacaaggacaagagcagatacgacgtgttctgcttcaccagcaacttcaacggcagattctactacctgatccaccccaccaagctgacctacgacgaggccgtgcaggcctgcctgaacgacggcgcccagatcgccaaggtgggccagatcttcgccgcctggaagatcctgggctacgacagatgcgacgccggctggctggccgacggcagcgtgagataccccatcagcagacccagaagaagatgcagccccaccgaggccgccgtgagattcgtgggcttccccgacaagaagcacaagctgtacggcgtgtactgcttcagagcctacaactag

SEQ ID NO: 84846 - DNA, 549 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggccctggacctgcagggcgtggtgttcccctacttccccagactgggcagatacaacctgaacttccacgaggcccagcaggcctgcctggactag

SEQ ID NO: 84847 - DNA, 477 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggccgagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggccctggacctgcagggctag

SEQ ID NO: 84848 - DNA, 600 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggccgagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggccctggacctgcagggcgtggtgttcccctacttccccagactgggcagatacaacctgaacttccacgaggcccagcaggcctgcctggaccaggacgccgtgatcgccagcttcgaccagctgtacgacgcctggagatag

SEQ ID NO: 84849 - DNA, 777 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggccgagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggccctggacctgcagggcgtggtgttcccctacttccccagactgggcagatacaacctgaacttccacgaggcccagcaggcctgcctggaccaggacgccgtgatcgccagcttcgaccagctgtacgacgcctggagaggcggcctggactggtgcaacgccggctggctgagcgacggcagcgtgcagtaccccatcaccaagcccagagagccctgcggcggccagaacaccgtgcccggcgtgagaaactacggcttctgggacaaggacaagagcagatacgacgtgttctgcttcaccagcaacttcaactag

SEQ ID NO: 84850 - DNA, 462 bp, Artificial Sequence
  Description of Artificial Sequence: Synthetic coding sequence
atgaagagcctgctgctgctggtgctgatcagcatctgctgggccgaccacctgagcgacaactacaccctggaccacgacagagccatccacatccaggccgagaacggcccccacctgctggtggaggccgagcaggccaaggtgttcagccacagaggcggcaacgtgaccctgccctgcaagttctacagagaccccaccgccttcggcagcggcatccacaagatcagaatcaagtggaccaagctgaccagcgactacctgaaggaggtggacgtgttcgtgagcatgggctaccacaagaagacctacggcggctaccagggcagagtgttcctgaagggcggcagcgacagcgacgccagcctggtgatcaccgacctgaccctggaggactacggcagatacaagtgcgaggtgatcgagggcctggaggacgacaccgtggtggtggcctag

SEQ ID NO: 84851 - DNA, 1683 bp, Artificial Sequence
  Description of Artificial Sequence: Synthetic coding sequence
atgttcgccagaatgagcgacctgcacgtgctgctgctgatggccctggtgggcaagaccgcctgcggcttcagcctgatgagcctgctggagagcctggaccccgactggacccccgaccagtacgactacagctacgaggactacaaccaggaggagaacaccagcagcaccctgacccacgccgagaaccccgactggtactacaccgaggaccaggccgacccctgccagcccaacccctgcgagcacggcggcgactgcctggtgcacggcagcaccttcacctgcagctgcctggcccccttcagcggcaacaagtgccagaaggtgcagaacacctgcaaggacaacccctgcggcagaggccagtgcctgatcacccagagccccccctactacagatgcgtgtgcaagcacccctacaccggccccagctgcagccaggtggtgcccgtgtgcagacccaacccctgccagaacggcgccacctgcagcagacacaagagaagaagcaagttcacctgcgcctgccccgaccagttcaagggcaagttctgcgagatcggcagcgacgactgctacgtgggcgacggctacagctacagaggcaagatgaacagaaccgtgaaccagcacgcctgcctgtactggaacagccacctgctgctgcaggagaactacaacatgttcatggaggacgccgagacccacggcatcggcgagcacaacttctgcagaaaccccgacgccgacgagaagccctggtgcttcatcaaggtgaccaacgacaaggtgaagtgggagtactgcgacgtgagcgcctgcagcgcccaggacgtggcctaccccgaggagagccccaccgagcccagcaccaagctgcccggcttcgacagctgcggcaagaccgagatcgccgagagaaagatcaagagaatctacggcggcttcaagagcaccgccggcaagcacccctggcaggccagcctgcagagcagcctgcccctgaccatcagcatgccccagggccacttctgcggcggcgccctgatccacccctgctgggtgctgaccgccgcccactgcaccgacatcaagaccagacacctgaaggtggtgctgggcgaccaggacctgaagaaggaggagttccacgagcagagcttcagagtggagaagatcttcaagtacagccactacaacgagagagacgagatcccccacaacgacatcgccctgctgaagctgaagcccgtggacggccactgcgccctggagagcaagtacgtgaagaccgtgtgcctgcccgacggcagcttccccagcggcagcgagtgccacatcagcggctggggcgtgaccgagaccggcaagggcagcagacagctgctggacgccaaggtgaagctgatcgccaacaccctgtgcaacagcagacagctgtacgaccacatgatcgacgacagcatgatctgcgccggcaacctgcagaagcccggccaggacacctgccagggcgacagcggcggccccctgacctgcgagaaggacggcacctactacgtgtacggcatcgtgagctggggcctggagtgcggcaagagacccggcgtgtacacccaggtgaccaagttcctgaactggatcaaggccaccatcaagagcgagagcggcttctag

SEQ ID NO: 84852 - DNA, 534 bp, Artificial Sequence
  Description of Artificial Sequence: Synthetic coding sequence
atggaggagaacttcatctgcagcagaaagaccatggccctgagcagcacctggatcctgagccccaagaagaccggccccctgaccagcatgatcaccgccaccagaatcatcatcagaaagagaacccccgtggcccacctgcccaccctgagaatcctgaccggcaccaccctgagaaccaagctgatccacgccagccccacccccgtgaacaccgtgggcaccgccagcagcatgggcgcccccagccacgccgccgcctggctgctgagcctgggcatcagcgtgagaaagtgcaagatcagagccagaaccacccacgtggccggcgccaacgtgagcctgcccagagtgctgcccaccaccgccgtgagcgtgaacaccctgacccaggtgcccgccgcccccaagtggttcctgtacgccggccagacccccgccagaatgggcctgcccgcccccggcatcagcggcgaccccagcagccccgtgcccgtgcccaccagcagcagaggcaacagcgtgaagtag

SEQ ID NO: 84853 - DNA, 843 bp, Artificial Sequence
  Description of Artificial Sequence: Synthetic coding sequence
atgttcgccagaatgagcgacctgcacgtgctgctgctgatggccctggtgggcaagaccgcctgcggcttcagcctgatgagcctgctggagagcctggaccccgactggacccccgaccagtacgactacagctacgaggactacaaccaggaggagaacaccagcagcaccctgacccacgccgagaaccccgactggtactacaccgaggaccaggccgacccctgccagcccaacccctgcgagcacggcggcgactgcctggtgcacggcagcaccttcacctgcagctgcctggcccccttcagcggcaacaagtgccagaaggtgcagaacacctgcaaggacaacccctgcggcagaggccagtgcctgatcacccagagccccccctactacagatgcgtgtgcaagcacccctacaccggccccagctgcagccaggtggtgcccgtgtgcagacccaacccctgccagaacggcgccacctgcagcagacacaagagaagaagcaagttcacctgcgcctgccccgaccagttcaagggcaagttctgcgagatcggcagcgacgactgctacgtgggcgacggctacagctacagaggcaagatgaacagaaccgtgaaccagcacgcctgcctgtactggaacagccacctgctgctgcaggagaactacaacatgttcatggaggacgccgagacccacggcatcggcgagcacaacttctgcagaaaccccgacgccgacgagaagccctggtgcttcatcaaggtgaccaacgacaaggtgaagtgggagtactgcgacgtgagcgcctgcagcgcccaggcctag

SEQ ID NO: 84854 - DNA, 1605 bp, Artificial Sequence
  Description of Artificial Sequence: Synthetic coding sequence
atgagcctgctggagagcctggaccccgactggacccccgaccagtacgactacagctacgaggactacaaccaggaggagaacaccagcagcaccctgacccacgccgagaaccccgactggtactacaccgaggaccaggccgacccctgccagcccaacccctgcgagcacggcggcgactgcctggtgcacggcagcaccttcacctgcagctgcctggcccccttcagcggcaacaagtgccagaaggtgcagaacacctgcaaggacaacccctgcggcagaggccagtgcctgatcacccagagccccccctactacagatgcgtgtgcaagcacccctacaccggccccagctgcagccaggtggtgcccgtgtgcagacccaacccctgccagaacggcgccacctgcagcagacacaagagaagaagcaagttcacctgcgcctgccccgaccagttcaagggcaagttctgcgagatcggcagcgacgactgctacgtgggcgacggctacagctacagaggcaagatgaacagaaccgtgaaccagcacgcctgcctgtactggaacagccacctgctgctgcaggagaactacaacatgttcatggaggacgccgagacccacggcatcggcgagcacaacttctgcagaaaccccgacgccgacgagaagccctggtgcttcatcaaggtgaccaacgacaaggtgaagtgggagtactgcgacgtgagcgcctgcagcgcccaggacgtggcctaccccgaggagagccccaccgagcccagcaccaagctgcccggcttcgacagctgcggcaagaccgagatcgccgagagaaagatcaagagaatctacggcggcttcaagagcaccgccggcaagcacccctggcaggccagcctgcagagcagcctgcccctgaccatcagcatgccccagggccacttctgcggcggcgccctgatccacccctgctgggtgctgaccgccgcccactgcaccgacatcaagaccagacacctgaaggtggtgctgggcgaccaggacctgaagaaggaggagttccacgagcagagcttcagagtggagaagatcttcaagtacagccactacaacgagagagacgagatcccccacaacgacatcgccctgctgaagctgaagcccgtggacggccactgcgccctggagagcaagtacgtgaagaccgtgtgcctgcccgacggcagcttccccagcggcagcgagtgccacatcagcggctggggcgtgaccgagaccggcaagggcagcagacagctgctggacgccaaggtgaagctgatcgccaacaccctgtgcaacagcagacagctgtacgaccacatgatcgacgacagcatgatctgcgccggcaacctgcagaagcccggccaggacacctgccagggcgacagcggcggccccctgacctgcgagaaggacggcacctactacgtgtacggcatcgtgagctggggcctggagtgcggcaagagacccggcgtgtacacccaggtgaccaagttcctgaactggatcaaggccaccatcaagagcgagagcggcttctag

SEQ ID NO: 84855 - DNA, 1656 bp, Artificial Sequence
  Description of Artificial Sequence: Synthetic coding sequence
atgctgcccctgctgctgctgcccctgctgtggggcggcagcctgcaggagaagcccgtgtacgagctgcaggtgcagaagagcgtgaccgtgcaggagggcctgtgcgtgctggtgccctgcagcttcagctacccctggagaagctggtacagcagcccccccctgtacgtgtactggttcagagacggcgagatcccctactacgccgaggtggtggccaccaacaaccccgacagaagagtgaagcccgagacccagggcagattcagactgctgggcgacgtgcagaagaagaactgcagcctgagcatcggcgacgccagaatggaggacaccggcagctacttcttcagagtggagagaggcagagacgtgaagtacagctaccagcagaacaagctgaacctggaggtgaccgccctgatcgagaagcccgacatccacttcctggagcccctggagagcggcagacccaccagactgagctgcagcctgcccggcagctgcgaggccggcccccccctgaccttcagctggaccggcaacgccctgagccccctggaccccgagaccaccagaagcagcgagctgaccctgacccccagacccgaggaccacggcaccaacctgacctgccagatgaagagacagggcgcccaggtgaccaccgagagaaccgtgcagctgaacgtgagctacgccccccagaccatcaccatcttcagaaacggcatcgccctggagatcctgcagaacaccagctacctgcccgtgctggagggccaggccctgagactgctgtgcgacgcccccagcaacccccccgcccacctgagctggttccagggcagccccgccctgaacgccacccccatcagcaacaccggcatcctggagctgagaagagtgagaagcgccgaggagggcggcttcacctgcagagcccagcaccccctgggcttcctgcagatcttcctgaacctgagcgtgtacagcctgccccagctgctgggccccagctgcagctgggaggccgagggcctgcactgcagatgcagcttcagagccagacccgcccccagcctgtgctggagactggaggagaagcccctggagggcaacagcagccagggcagcttcaaggtgaacagcagcagcgccggcccctgggccaacagcagcctgatcctgcacggcggcctgagcagcgacctgaaggtgagctgcaaggcctggaacatctacggcagccagagcggcagcgtgctgctgctgcagggcagaagcaacctgggcaccggcgtggtgcccgccgccctgggcggcgccggcgtgatggccctgctgtgcatctgcctgtgcctgatcttcttcctgatcgtgaaggccagaagaaagcaggccgccggcagacccgagaagatggacgacgaggaccccatcatgggcaccatcaccagcggcagcagaaagaagccctggcccgacagccccggcgaccaggccagcccccccggcgacgccccccccctggaggagcagaaggagctgcactacgccagcctgagcttcagcgagatgaagagcagagagcccaaggaccaggaggcccccagcaccaccgagtacagcgagatcaagaccagcaagtag

SEQ ID NO: 84856 - DNA, 558 bp, Artificial Sequence
  Description of Artificial Sequence: Synthetic coding sequence
atgttcagagaggtgttcgccgacgaggaccccgccacctacgtgtgggacggcaactaccaccagccctgggagcccgccgccgccggcgccgtgggcgccggcgcctacagagaggtggaggccgaggaccccggcagactggccgtggaggccctggtgagaaccagaagatgcgtgtgcgtggcccagagatggggcggcaagagagaggtgatgtacaccgccttcaaggccctgggcgacagcgtggactacgtgcagttctgcagagtgtgcgacagcgacaccagactggaccccatggccctgctggagctggtgagagtgctggacgaggaccccagagtgggcgccgtgggcggcgacgtgagaatcctgaaccccctggacagctgggtgagcttcctgagcagcctgagatactgggtggccttcaacgtggagagagcctgccagagctacttccactgcgtgagctgcatcagcggccccctgggcaccccccccggccccgccgccacccagagaagacccagacccagctgcggcggctag

SEQ ID NO: 84857 - DNA, 645 bp, Artificial Sequence
  Description of Artificial Sequence: Synthetic coding sequence
atgttcagagaggtgttcgccgacgaggaccccgccacctacgtgtgggacggcaactaccaccagccctgggagcccgccgccgccggcgccgtgggcgccggcgcctacagagaggtggaggccgaggaccccggcagactggccgtggaggccctggtgagaaccagaagatgcgtgtgcgtggcccagagatggggcggcaagagagaggtgatgtacaccgccttcaaggccctgggcgacagcgtggactacgtgcaggtgtgcgacagcgacaccagactggaccccatggccctgctggagctggtgagagtgctggacgaggaccccagagtgggcgccgtgggcggcgacgtgagaatcctgaaccccctggacagctgggtgagcttcctgagcagcctgagatactgggtggccttcaacgtggagagagcctgccagagctacttccactgcgtgagctgcatcagcggccccctggagagctgccccggccccagagagcacgccatgatgcccagcttcctggcccccgtgcaggtgcacctgcaggtgcccctgctgctgagagacgccctggtgctgcccgccgtggccgagcccgccgacaccctggtgcaggtggtgctgccctag

SEQ ID NO: 84858 - DNA, 1734 bp, Artificial Sequence
  Description of Artificial Sequence: Synthetic coding sequence
atgagacaggacgcccccaagcccacccccgccgcctgcagatgcagcggcctggccagaagagtgctgaccatcgccttcgccctgctgatcctgggcctgatgacctgggcctacgccgccggcgtgcccctggccagcgacagatacggcctgctggccttcggcctgtacggcgccttcctgagcgcccacctggtggcccagagcctgttcgcctacctggagcacagaagagtggccgccgccgccagaggccccctggacgccgccaccgccagaagcgtggccctgaccatcagcgcctaccaggaggaccccgcctacctgagacagtgcctggccagcgccagagccctgctgtaccccagagccagactgagagtgctgatggtggtggacggcaacagagccgaggacctgtacatggtggacatgttcagagaggtgttcgccgacgaggaccccgccacctacgtgtgggacggcaactaccaccagccctgggagcccgccgccgccggcgccgtgggcgccggcgcctacagagaggtggaggccgaggaccccggcagactggccgtggaggccctggtgagaaccagaagatgcgtgtgcgtggcccagagatggggcggcaagagagaggtgatgtacaccgccttcaaggccctgggcgacagcgtggactacgtgcaggtgtgcgacagcgacaccagactggaccccatggccctgctggagctggtgagagtgctggacgaggaccccagagtgggcgccgtgggcggcgacgtgagaatcctgaaccccctggacagctgggtgagcttcctgagcagcctgagatactgggtggccttcaacgtggagagagcctgccagagctacttccactgcgtgagctgcatcagcggccccctgggcctgtacagaaacaacctgctgcagcagttcctggaggcctggtacaaccagaagttcctgggcacccactgcaccttcggcgacgacagacacctgaccaacagaatgctgagcatgggctacgccaccaagtacaccagcagaagcagatgctacagcgagacccccagcagcttcctgagatggctgagccagcagaccagatggagcaagagctacttcagagagtggctgtacaacgccctgtggtggcacagacaccacgcctggatgacctacgaggccgtggtgagcggcctgttccccttcttcgtggccgccaccgtgctgagactgttctacgccggcagaccctgggccctgctgtgggtgctgctgtgcgtgcagggcgtggccctggccaaggccgccttcgccgcctggctgagaggctgcctgagaatggtgctgctgagcctgtacgcccccctgtacatgtgcggcctgctgcccgccaagttcctggccctggtgaccatgaaccagagcggctggggcaccagcggcagaagaaagctggccgccaactacgtgcccctgctgcccctggccctgtgggccctgctgctgctgggcggcctggtgagaagcgtggcccacgaggccagagccgactggagcggccccagcagagccgccgaggcctaccacctggccgccggcgccggcgcctacgtgggctactgggtggccatgctgaccctgtactgggtgggcgtgagaagactgtgcagaagaagaaccggcggctacagagtgcaggtgtag

SEQ ID NO: 84859 - DNA, 1659 bp, Artificial Sequence
  Description of Artificial Sequence: Synthetic coding sequence
atgcactgcgagagattcctgtgcatcctgagaatcatcggcaccaccctgttcggcgtgagcctgctgctgggcatcaccgccgcctacatcgtgggctaccagttcatccagaccgacaactactacttcagcttcggcctgtacggcgccttcctggccagccacctgatcatccagagcctgttcgccttcctggagcacagaaagatgaagaagagcctggagacccccatcaagctgaacaagaccgtggccctgtgcatcgccgcctaccaggaggaccccgactacctgagaaagtgcctgcagagcgtgaagagactgacctaccccggcatcaaggtggtgatggtgatcgacggcaacagcgaggacgacctgtacatgatggacatcttcagcgaggtgatgggcagagacaagagcgccacctacatctggaagaacaacttccacgagaagggccccggcgagaccgacgagagccacaaggagagcagccagcacgtgacccagctggtgctgagcaacaagagcatctgcatcatgcagaagtggggcggcaagagagaggtgatgtacaccgccttcagagccctgggcagaagcgtggactacgtgcaggtgtgcgacagcgacaccatgctggaccccgccagcagcgtggagatggtgaaggtgctggaggaggaccccatggtgggcggcgtgggcggcgacgtgcagatcctgaacaagtacgacagctggatcagcttcctgagcagcgtgagatactggatggccttcaacatcgagagagcctgccagagctacttcggctgcgtgcagtgcatcagcggccccctgggcatgtacagaaacagcctgctgcacgagttcgtggaggactggtacaaccaggagttcatgggcaaccagtgcagcttcggcgacgacagacacctgaccaacagagtgctgagcctgggctacgccaccaagtacaccgccagaagcaagtgcctgaccgagacccccatcgagtacctgagatggctgaaccagcagaccagatggagcaagagctacttcagagagtggctgtacaacgccatgtggttccacaagcaccacctgtggatgacctacgaggccatcatcaccggcttcttccccttcttcctgatcgccaccgtgatccagctgttctacagaggcaagatctggaacatcctgctgttcctgctgaccgtgcagctggtgggcctgatcaagagcagcttcgccagctgcctgagaggcaacatcgtgatggtgttcatgagcctgtacagcgtgctgtacatgagcagcctgctgcccgccaagatgttcgccatcgccaccatcaacaaggccggctggggcaccagcggcagaaagaccatcgtggtgaacttcatcggcctgatccccgtgagcgtgtggttcaccatcctgctgggcggcgtgatcttcaccatctacaaggagagcaagagacccttcagcgagagcaagcagaccgtgctgatcgtgggcaccctgctgtacgcctgctactgggtgatgctgctgaccctgtacgtggtgctgatcaacaagtgcggcagaagaaagaagggccagcagtacgacatggtgctggacgtgtag

SEQ ID NO: 84860 - DNA, 951 bp, Artificial Sequence
  Description of Artificial Sequence: Synthetic coding sequence
atgcactgcgagagattcctgtgcatcctgagaatcatcggcaccaccctgttcggcgtgagcctgctgctgggcatcaccgccgcctacatcgtgggctaccagttcatccagaccgacaactactacttcagcttcggcctgtacggcgccttcctggccagccacctgatcatccagagcctgttcgccttcctggagcacagaaagatgaagaagagcctggagacccccatcaagctgaacaagaccgtggccctgtgcatcgccgcctaccaggaggaccccgactacctgagaaagtgcctgcagagcgtgaagagactgacctaccccggcatcaaggtggtgatggtgatcgacggcaacagcgaggacgacctgtacatgatggacatcttcagcgaggtgatgggcagagacaagagcgccacctacatctggaagaacaacttccacgagaagggccccggcgagaccgacgagagccacaaggagagcagccagcacgtgacccagctggtgctgagcaacaagagcatctgcatcatgcagaagtggggcggcaagagagaggtgatgtacaccgccttcagagccctgggcagaagcgtggactacgtgcaggtgtgcgacagcgacaccatgctggaccccgccagcagcgtggagatggtgaaggtgctggaggaggaccccatggtgggcggcgtgggcggcgacgtgcagatcctgaacaagtacgacagctggatcagcttcctgagcagcgtgagatactggatggccttcaacatcgagagagcctgccagagctacttcggctgcgtgcagtgcatcagcggccccctgggcatgtacagaaacagcctgctgcacgtgctgaccttcgccgtgacccacaacaccctggtgcccctgggcgccgtgcagtactgcggcatcagatag

SEQ ID NO: 84861 - DNA, 1389 bp, Artificial Sequence
  Description of Artificial Sequence: Synthetic coding sequence
atggcccaggtgagcatcaacaacgactacagcgagtgggacctgagcaccgacgccggcgagagagccagactgctgcagagcccctgcgtggacaccgcccccaagagcgagtgggaggccagccccggcggcctggacagaggcaccaccagcaccctgggcgccatcttcatcgtggtgaacgcctgcctgggcgccggcctgctgaacttccccgccgccttcagcaccgccggcggcgtggccgccggcatcgccctgcagatgggcatgctggtgttcatcatcagcggcctggtgatcctggcctactgcagccaggccagcaacgagagaacctaccaggaggtggtgtgggccgtgtgcggcaagctgaccggcgtgctgtgcgaggtggccatcgccgtgtacaccttcggcacctgcatcgccttcctgatcatcatcggcgaccagcaggacaagatcatcgccgtgatggccaaggagcccgagggcgccagcggcccctggtacaccgacagaaagttcaccatcagcctgaccgccttcctgttcatcctgcccctgagcatccccagagagatcggcttccagaagtacgccagcttcctgagcgtggtgggcacctggtacgtgaccgccatcgtgatcatcaagtacatctggcccgacaaggagatgacccccggcaacatcctgaccagacccgccagctggatggccgtgttcaacgccatgcccaccatctgcttcggcttccagtgccacgtgagcagcgtgcccgtgttcaacagcatgcagcagcccgaggtgaagacctggggcggcgtggtgaccgccgccatggtgatcgccctggccgtgtacatgggcaccggcatctgcggcttcctgaccttcggcgccgccgtggaccccgacgtgctgctgagctaccccagcgaggacatggccgtggccgtggccagagccttcatcatcctgagcgtgctgaccagctaccccatcctgcacttctgcggcagagccgtggtggagggcctgtggctgagataccagggcgtgcccgtggaggaggacgtgggcagagagagaagaagaagagtgctgcagaccctggtgtggttcctgctgaccctgctgctggccctgttcatccccgacatcggcaaggtgatcagcgtgatcggcggcctggccgcctgcttcatcttcgtgttccccggcctgtgcctgatccaggccaagctgagcgagatggaggaggtgaagcccgccagctggtgggtgctggtgagctacggcgtgctgctggtgaccctgggcgccttcatcttcggccagaccaccgccaacgccatcttcgtggacctgctggcctag

SEQ ID NO: 84862 - DNA, 1662 bp, Artificial Sequence
  Description of Artificial Sequence: Synthetic coding sequence
atgcccgtgcagctgaccaccgccctgagagtggtgggcaccagcctgttcgccctggccgtgctgggcggcatcctggccgcctacgtgaccggctaccagttcatccacaccgagaagcactacctgagcttcggcctgtacggcgccatcctgggcctgcacctgctgatccagagcctgttcgccttcctggagcacagaagaatgagaagagccggccaggccctgaagctgcccagccccagaagaggcagcgtggccctgtgcatcgccgcctaccaggaggaccccgactacctgagaaagtgcctgagaagcgcccagagaatcagcttccccgacctgaaggtggtgatggtggtggacggcaacagacaggaggacgcctacatgctggacatcttccacgaggtgctgggcggcaccgagcaggccggcttcttcgtgtggagaagcaacttccacgaggccggcgagggcgagaccgaggccagcctgcaggagggcatggacagagtgagagacgtggtgagagccagcaccttcagctgcatcatgcagaagtggggcggcaagagagaggtgatgtacaccgccttcaaggccctgggcgacagcgtggactacatccaggtgtgcgacagcgacaccgtgctggaccccgcctgcaccatcgagatgctgagagtgctggaggaggacccccaggtgggcggcgtgggcggcgacgtgcagatcctgaacaagtacgacagctggatcagcttcctgagcagcgtgagatactggatggccttcaacgtggagagagcctgccagagctacttcggctgcgtgcagtgcatcagcggccccctgggcatgtacagaaacagcctgctgcagcagttcctggaggactggtaccaccagaagttcctgggcagcaagtgcagcttcggcgacgacagacacctgaccaacagagtgctgagcctgggctacagaaccaagtacaccgccagaagcaagtgcctgaccgagacccccaccaagtacctgagatggctgaaccagcagaccagatggagcaagagctacttcagagagtggctgtacaacagcctgtggttccacaagcaccacctgtggatgacctacgagagcgtggtgaccggcttcttccccttcttcctgatcgccaccgtgatccagctgttctacagaggcagaatctggaacatcctgctgttcctgctgaccgtgcagctggtgggcatcatcaaggccacctacgcctgcttcctgagaggcaacgccgagatgatcttcatgagcctgtacagcctgctgtacatgagcagcctgctgcccgccaagatcttcgccatcgccaccatcaacaagagcggctggggcaccagcggcagaaagaccatcgtggtgaacttcatcggcctgatccccgtgagcatctgggtggccgtgctgctgggcggcctggcctacaccgcctactgccaggacctgttcagcgagaccgagctggccttcctggtgagcggcgccatcctgtacggctgctactgggtggccctgctgatgctgtacctggccatcatcgccagaagatgcggcaagaagcccgagcagtacagcctggccttcgccgaggtgtag

SEQ ID NO: 84863 - DNA, 1308 bp, Artificial Sequence
  Description of Artificial Sequence: Synthetic coding sequence
atggccgcccacctgctgcccatctgcgccctgttcctgaccctgctggacatggcccagggcttcagaggccccctgctgcccaacagacccttcaccaccgtgtggaacgccaacacccagtggtgcctggagagacacggcgtggacgtggacgtgagcgtgttcgacgtggtggccaaccccggccagaccttcagaggccccgacatgaccatcttctacagcagccagctgggcacctacccctactacacccccaccggcgagcccgtgttcggcggcctgccccagaacgccagcctgatcgcccacctggccagaaccttccaggacatcctggccgccatccccgcccccgacttcagcggcctggccgtgatcgactgggaggcctggagacccagatgggccttcaactgggacaccaaggacatctacagacagagaagcagagccctggtgcaggcccagcaccccgactggcccgccccccaggtggaggccgtggcccaggaccagttccagggcgccgccagagcctggatggccggcaccctgcagctgggcagagccctgagacccagaggcctgtggggcttctacggcttccccgactgctacaactacgacttcctgagccccaactacaccggccagtgccccagcggcatcagagcccagaacgaccagctgggctggctgtggggccagagcagagccctgtaccccagcatctacatgcccgccgtgctggagggcaccggcaagagccagatgtacgtgcagcacagagtggccgaggccttcagagtggccgtggccgccggcgaccccaacctgcccgtgctgccctacgtgcagatcttctacgacaccaccaaccacttcctgcccctggacgagctggagcacagcctgggcgagagcgccgcccagggcgccgccggcgtggtgctgtgggtgagctgggagaacaccagaaccaaggagagctgccaggccatcaaggagtacatggacaccaccctgggccccttcatcctgaacgtgaccagcggcgccctgctgtgcagccaggccctgtgcagcggccacggcagatgcgtgagaagaaccagccaccccaaggccctgctgctgctgaaccccgccagcttcagcatccagctgacccccggcggcggccccctgagcctgagaggcgccctgagcctggaggaccaggcccagatggccgtggagttcaagtgcagatgctaccccggctggcaggccccctggtgcgagagaaagagcatgtggtag

SEQ ID NO: 84864 - DNA, 1308 bp, Artificial Sequence; identical to SEQ ID NO: 84863
  Description of Artificial Sequence: Synthetic coding sequence

SEQ ID NO: 84865 - DNA, 1218 bp, Artificial Sequence
  Description of Artificial Sequence: Synthetic coding sequence
atggccgcccacctgctgcccatctgcgccctgttcctgaccctgctggacatggcccagggcttcagaggccccctgctgcccaacagacccttcaccaccgtgtggaacgccaacacccagtggtgcctggagagacacggcgtggacgtggacgtgagcgtgttcgacgtggtggccaaccccggccagaccttcagaggccccgacatgaccatcttctacagcagccagctgggcacctacccctactacacccccaccggcgagcccgtgttcggcggcctgccccagaacgccagcctgatcgcccacctggccagaaccttccaggacatcctggccgccatccccgcccccgacttcagcggcctggccgtgatcgactgggaggcctggagacccagatgggccttcaactgggacaccaaggacatctacagacagagaagcagagccctggtgcaggcccagcaccccgactggcccgccccccaggtggaggccgtggcccaggaccagttccagggcgccgccagagcctggatggccggcaccctgcagctgggcagagccctgagacccagaggcctgtggggcttctacggcttccccgactgctacaactacgacttcctgagccccaactacaccggccagtgccccagcggcatcagagcccagaacgaccagctgggctggctgtggggccagagcagagccctgtaccccagcatctacatgcccgccgtgctggagggcaccggcaagagccagatgtacgtgcagcacagagtggccgaggccttcagagtggccgtggccgccggcgaccccaacctgcccgtgctgccctacgtgcagatcttctacgacaccaccaaccacttcctgcccctggagagctgccaggccatcaaggagtacatggacaccaccctgggccccttcatcctgaacgtgaccagcggcgccctgctgtgcagccaggccctgtgcagcggccacggcagatgcgtgagaagaaccagccaccccaaggccctgctgctgctgaaccccgccagcttcagcatccagctgacccccggcggcggccccctgagcctgagaggcgccctgagcctggaggaccaggcccagatggccgtggagttcaagtgcagatgctaccccggctggcaggccccctggtgcgagagaaagagcatgtggtag

SEQ ID NO: 84866 - DNA, 1308 bp, Artificial Sequence; identical to SEQ ID NO: 84863
  Description of Artificial Sequence: Synthetic coding sequence

SEQ ID NO: 84867 - DNA, 312 bp, Artificial Sequence
  Description of Artificial Sequence: Synthetic coding sequence
atggccgcccacctgctgcccatctgcgccctgttcctgaccctgctggacatggcccagggcttcagaggccccctgctgcccaacagacccttcaccaccgtgtggaacgccaacacccagtggtgcctggagagacacggcgtggacgtggacgtgagcgtgttcgacgtggtggccaaccccggccagaccttcagaggccccgacatgaccatcttctacagcagccagctgggcacctacccctactacacccccaccggcgagcccgtgttcggcggcctgccccagaacgccagcctgatctag

SEQ ID NO: 84868 - DNA, 531 bp, Artificial Sequence
  Description of Artificial Sequence: Synthetic coding sequence
atgtacgtgcagcacagagtggccgaggccttcagagtggccgtggccgccggcgaccccaacctgcccgtgctgccctacgtgcagatcttctacgacaccaccaaccacttcctgcccctggacgagctggagcacagcctgggcgagagcgccgcccagggcgccgccggcgtggtgctgtgggtgagctgggagaacaccagaaccaaggagagctgccaggccatcaaggagtacatggacaccaccctgggccccttcatcctgaacgtgaccagcggcgccctgctgtgcagccaggccctgtgcagcggccacggcagatgcgtgagaagaaccagccaccccaaggccctgctgctgctgaaccccgccagcttcagcatccagctgacccccggcggcggccccctgagcctgagaggcgccctgagcctggaggaccaggcccagatggccgtggagttcaagtgcagatgctaccccggctggcaggccccctggtgcgagagaaagagcatgtggtag

SEQ ID NO: 84869 - DNA, 210 bp, Artificial Sequence
  Description of Artificial Sequence: Synthetic coding sequence
atggccgcccacctgctgcccatctgcgccctgttcctgaccctgctggacatggcccagggcttcagaggccccctgctgcccaacagacccttcaccaccgtgtggaacgccaacacccagtggtgcctggagagacacggcgtggacgtggacgtgagcgtgttcgacgtggtggccaaccccggccagaccttcagaggcccctag

SEQ ID NO: 84870 - DNA, 762 bp, Artificial Sequence
  Description of Artificial Sequence: Synthetic coding sequence
atggccggcaccctgcagctgggcagagccctgagacccagaggcctgtggggcttctacggcttccccgactgctacaactacgacttcctgagccccaactacaccggccagtgccccagcggcatcagagcccagaacgaccagctgggctggctgtggggccagagcagagccctgtaccccagcatctacatgcccgccgtgctggagggcaccggcaagagccagatgtacgtgcagcacagagtggccgaggccttcagagtggccgtggccgccggcgaccccaacctgcccgtgctgccctacgtgcagatcttctacgacaccaccaaccacttcctgcccctggacgagctggagcacagcctgggcgagagcgccgcccagggcgccgccggcgtggtgctgtgggtgagctgggagaacaccagaaccaaggagagctgccaggccatcaaggagtacatggacaccaccctgggccccttcatcctgaacgtgaccagcggcgccctgctgtgcagccaggccctgtgcagcggccacggcagatgcgtgagaagaaccagccaccccaaggccctgctgctgctgaaccccgccagcttcagcatccagctgacccccggcggcggccccctgagcctgagaggcgccctgagcctggaggaccaggcccagatggccgtggagttcaagtgcagatgctaccccggctggcaggccccctggtgcgagagaaagagcatgtggtag

SEQ ID NO: 84871 - DNA, 1422 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcaccatcttctacagagacagactgggcctgtaccccagattcgacagcgccggcagaagcgtgcacggcggcgtgccccagaacgtgagcctgtgggcccacagaaagatgctgcagaagagagtggagcactacatcagaacccaggagagcgccggcctggccgtgatcgactgggaggactggagacccgtgtgggtgagaaactggcaggacaaggacgtgtacagaagactgagcagacagctggtggccagcagacaccccgactggccccccgacagaatcgtgaagcaggcccagtacgagttcgagttcgccgcccagcagttcatgctggagaccctgagatacgtgaaggccgtgagacccagacacctgtggggcttctacctgttccccgactgctacaaccacgactacgtgcagaactgggagagctacaccggcagatgccccgacgtggaggtggccagaaacgaccagctggcctggctgtgggccgagagcaccgccctgttccccagcgtgtacctggacgagaccctggccagcagcagacacggcagaaacttcgtgagcttcagagtgcaggaggccctgagagtggccagaacccaccacgccaaccacgccctgcccgtgtacgtgttcaccagacccacctacagcagaagactgaccggcctgagcgagatggacctgatcagcaccatcggcgagagcgccgccctgggcgccgccggcgtgatcctgtggggcgacgccggctacaccaccagcaccgagacctgccagtacctgaaggactacctgaccagactgctggtgccctacgtggtgaacgtgagctgggccacccagtactgcagcagagcccagtgccacggccacggcagatgcgtgagaagaaaccccagcgccagcaccttcctgcacctgagcaccaacagcttcagactggtgcccggccacgcccccggcgagccccagctgagacccgtgggcgagctgagctgggccgacatcgaccacctgcagacccacttcagatgccagtgctacctgggctggagcggcgagcagtgccagtgggaccacagacaggccgccggcggcgccagcgaggcctgggccggcagccacctgaccagcctgctggccctggccgccctggccttcacctggaccctgtag

SEQ ID NO: 84872 - DNA, 1422 bp, Artificial Sequence; identical to SEQ ID NO: 84871
  Description of Artificial Sequence: Synthetic coding sequence

SEQ ID NO: 84873 - DNA, 147 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggctag

SEQ ID NO: 84874 - DNA, 354 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcaccatcttctacagagacagactgggcctgtaccccagattcgacagcgccggcagaagcgtgcacggcggcgtgccccagaacgtgagcctgtgggcccacagaaagatgctgcagaagagagtgtag

SEQ ID NO: 84875 - DNA, 246 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcaccatcttctacagagactag

SEQ ID NO: 84876 - DNA, 231 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcacctag

SEQ ID NO: 84877 - DNA, 1422 bp, Artificial Sequence; identical to SEQ ID NO: 84871
  Description of Artificial Sequence: Synthetic coding sequence

SEQ ID NO: 84878 - DNA, 1422 bp, Artificial Sequence; identical to SEQ ID NO: 84871
  Description of Artificial Sequence: Synthetic coding sequence

SEQ ID NO: 84879 - DNA, 366 bp, Artificial Sequence
  Description of Artificial Sequence: Synthetic coding sequence
atgagagccggccccggccccaccgtgaccctggccctggtgctggccgtgagctgggccatggagctgaagcccaccgccccccccatcttcaccggcagacccttcgtggtggcctgggacgtgcccacccaggactgcggccccagactgaaggtgcccctggacctgaacgccttcgacgtgcaggccagccccaacgagggcttcgtgaaccagaacatcaccatcttctacagagacagactgggcctgtaccccagattcgacagcgccggcagaagcgtgcacggcggcgtgccccagaacgtgagcctgtgggcccacagaaagatgctgcagaagagagtggagcactacatctag

SEQ ID NO: 84880 - DNA, 1254 bp, Artificial Sequence
  Description of Artificial Sequence: Synthetic coding sequence
atgaccacccagctgggccccgccctggtgctgggcgtggccctgtgcctgggctgcggccagcccctgccccaggtgcccgagagacccttcagcgtgctgtggaacgtgcccagcgcccactgcgaggccagattcggcgtgcacctgcccctgaacgccctgggcatcatcgccaacagaggccagcacttccacggccagaacatgaccatcttctacaagaaccagctgggcctgtacccctacttcggccccagaggcaccgcccacaacggcggcatcccccaggccctgcccctggacagacacctggccctggccgcctaccagatccaccacagcctgagacccggcttcgccggccccgccgtgctggactgggaggagtggtgccccctgtgggccggcaactggggcagaagaagagcctaccaggccgccagctgggcctgggcccagcaggtgttccccgacctggacccccaggagcagctgtacaaggcctacaccggcttcgagcaggccgccagagccctgatggaggacaccctgagagtggcccaggccctgagaccccacggcctgtggggcttctaccactaccccgcctgcggcaacggctggcacagcatggccagcaactacaccggcagatgccacgccgccaccctggccagaaacacccagctgcactggctgtgggccgccagcagcgccctgttccccagcatctacctgccccccagactgccccccgcccaccaccaggccttcgtgagacacagactggaggaggccttcagagtggccctggtgggccacagacaccccctgcccgtgctggcctacgtgagactgacccacagaagaagcggcagattcctgagccaggacgacctggtgcagagcatcggcgtgagcgccgccctgggcgccgccggcgtggtgctgtggggcgacctgagcctgagcagcagcgaggaggagtgctggcacctgcacgactacctggtggacaccctgggcccctacgtgatcaacgtgaccagagccgccatggcctgcagccaccagagatgccacggccacggcagatgcgccagaagagaccccggccagatggaggccttcctgcacctgtggcccgacggcagcctgggcgactggaagagcttcagctgccactgctactggggctgggccggccccacctgccaggagcccagacccggccccaaggaggccgtgtag

SEQ ID NO: 84881 - DNA, 1164 bp, Artificial Sequence
  Description of Artificial Sequence: Synthetic coding sequence
atgaccacccagctgggccccgccctggtgctgggcgtggccctgtgcctgggctgcggccagcccctgccccaggtgcccgagagacccttcagcgtgctgtggaacgtgcccagcgcccactgcgaggccagattcggcgtgcacctgcccctgaacgccctgggcatcatcgccaacagaggccagcacttccacggccagaacatgaccatcttctacaagaaccagctgggcctgtacccctacttcggccccagaggcaccgcccacaacggcggcatcccccaggccctgcccctggacagacacctggccctggccgcctaccagatccaccacagcctgagacccggcttcgccggccccgccgtgctggactgggaggagtggtgccccctgtgggccggcaactggggcagaagaagagcctaccaggccgccagctgggcctgggcccagcaggtgttccccgacctggacccccaggagcagctgtacaaggcctacaccggcttcgagcaggccgccagagccctgatggaggacaccctgagagtggcccaggccctgagaccccacggcctgtggggcttctaccactaccccgcctgcggcaacggctggcacagcatggccagcaactacaccggcagatgccacgccgccaccctggccagaaacacccagctgcactggctgtgggccgccagcagcgccctgttccccagcatctacctgccccccagactgccccccgcccaccaccaggccttcgtgagacacagactggaggaggccttcagagtggccctggtgggccacagacaccccctgcccgtgctggcctacgtgagactgacccacagaagaagcggcagattcctgagccaggaggagtgctggcacctgcacgactacctggtggacaccctgggcccctacgtgatcaacgtgaccagagccgccatggcctgcagccaccagagatgccacggccacggcagatgcgccagaagagaccccggccagatggaggccttcctgcacctgtggcccgacggcagcctgggcgactggaagagcttcagctgccactgctactggggctgggccggccccacctgccaggagcccagacccggccccaaggaggccgtgtag

SEQ ID NO: 84882 - DNA, 507 bp, Artificial Sequence
  Description of Artificial Sequence: Synthetic coding sequence
atgctgccccccgcccaccaccaggccttcgtgagacacagactggaggaggccttcagagtggccctggtgggccacagacaccccctgcccgtgctggcctacgtgagactgacccacagaagaagcggcagattcctgagccaggacgacctggtgcagagcatcggcgtgagcgccgccctgggcgccgccggcgtggtgctgtggggcgacctgagcctgagcagcagcgaggaggagtgctggcacctgcacgactacctggtggacaccctgggcccctacgtgatcaacgtgaccagagccgccatggcctgcagccaccagagatgccacggccacggcagatgcgccagaagagaccccggccagatggaggccttcctgcacctgtggcccgacggcagcctgggcgactggaagagcttcagctgccactgctactggggctgggccggccccacctgccaggagcccagacccggccccaaggaggccgtgtag

SEQ ID NO: 84883 - DNA, 483 bp, Artificial Sequence
  Description of Artificial Sequence: Synthetic coding sequence
atgaccacccagctgggccccgccctggtgctgggcgtggccctgtgcctgggctgcggccagcccctgccccaggtgcccgagagacccttcagcgtgctgtggaacgtgcccagcgcccactgcgaggccagattcggcgtgcacctgcccctgaacgccctgggcatcatcgccaacagaggccagcacttccacggccagaacatgaccatcttctacaagaaccagctgggcctgtacccctacttcggccccagaggcaccgcccacaacggcggcatcccccaggccctgcccctggacagacacctggccctggccgcctaccagatccaccacagcctgagacccggcttcgccggccccgccgtgctggactgggaggagtggtgccccctgtgggccggcaactggggcagaagaagagcctaccaggccgccagctgggcctgggcccagcaggtgttccccgacctgtag

SEQ ID NO: 84884 - DNA, 1164 bp, Artificial Sequence; identical to SEQ ID NO: 84881
  Description of Artificial Sequence: Synthetic coding sequence

SEQ ID NO: 84885 - DNA, 417 bp, Artificial Sequence
  Description of Artificial Sequence: Synthetic coding sequence
atgctgccccccgcccaccaccaggccttcgtgagacacagactggaggaggccttcagagtggccctggtgggccacagacaccccctgcccgtgctggcctacgtgagactgacccacagaagaagcggcagattcctgagccaggaggagtgctggcacctgcacgactacctggtggacaccctgggcccctacgtgatcaacgtgaccagagccgccatggcctgcagccaccagagatgccacggccacggcagatgcgccagaagagaccccggccagatggaggccttcctgcacctgtggcccgacggcagcctgggcgactggaagagcttcagctgccactgctactggggctgggccggccccacctgccaggagcccagacccggccccaaggaggccgtgtag

SEQ ID NO: 84886 - DNA, 1518 bp, Artificial Sequence
  Description of Artificial Sequence: Synthetic coding sequence
atgagcagcgtgcagcagcagccccccccccccagaagagtgaccaacgtgggcagcctgctgctgaccccccaggagaacgagagcctgttcaccttcctgggcaagaagtgcgtgaccatgagcagcgccgtggtgcagctgtacgccgccgacagaaactgcatgtggagcaagaagtgcagcggcgtggcctgcctggtgaaggacaacccccagagaagctacttcctgagaatcttcgacatcaaggacggcaagctgctgtgggagcaggagctgtacaacaacttcgtgtacaacagccccagaggctacttccacaccttcgccggcgacacctgccaggtggccctgaacttcgccaacgaggaggaggccaagaagttcagaaaggccgtgaccgacctgctgggcagaagacagagaaagagcgagaagagaagagacccccccaacggccccaacctgcccatggccaccgtggacatcaagaaccccgagatcaccaccaacagattctacggcccccaggtgaacaacatcagccacaccaaggagaagaagaagggcaaggccaagaagaagagactgaccaaggccgacatcggcacccccagcaacttccagcacatcggccacgtgggctgggaccccaacaccggcttcgacctgaacaacctggaccccgagctgaagaacctgttcgacatgtgcggcatcagcgaggcccagctgaaggacagagagaccagcaaggtgatctacgacttcatcgagaagaccggcggcgtggaggccgtgaagaacgagctgagaagacaggccccccccccccccccccccagcagaggcggccccccccccccccccccccccccccacaacagcggccccccccccccccccgccagaggcagaggcgcccccccccccccccccagcagagcccccaccgccgccccccccccccccccccccagcagacccagcgtggccgtgcccccccccccccccaacagaatgtaccccccccccccccccgccctgcccagcagcgcccccagcggcccccccccccccccccccagcgtgctgggcgtgggccccgtggcccccccccccccccccccccccccccccccccccggccccccccccccccccggcctgcccagcgacggcgaccaccaggtgcccaccaccgccggcaacaaggccgccctgctggaccagatcagagagggcgcccagctgaagaaggtggagcagaacagcagacccgtgagctgcagcggcagagacgccctgctggaccagatcagacagggcatccagctgaagagcgtggccgacggccaggagagcaccccccccacccccgcccccaccagcggcatcgtgggcgccctgatggaggtgatgcagaagagaagcaaggccatccacagcagcgacgaggacgaggacgaggacgacgaggaggacttcgaggacgacgacgagtgggaggactag

SEQ ID NO: 84887 - DNA, 1446 bp, Artificial Sequence
  Description of Artificial Sequence: Synthetic coding sequence
atgaaggtgctgagcgagggccagctgaagctgtgcgtggtgcagcccgtgcacctgaccagctggctgctgatcttcttcatcctgaagagcatcagctgcctgaagcccgccagactgcccatctaccagagaaagcccttcatcgccgcctggaacgcccccaccgaccagtgcctgatcaagtacaacctgagactgaacctgaagatgttccccgtgatcggcagccccctggccaaggccagaggccagaacgtgaccatcttctacgtgaacagactgggctactacccctggtacaccagccagggcgtgcccatcaacggcggcctgccccagaacatcagcctgcaggtgcacctggagaaggccgaccaggacatcaactactacatccccgccgaggacttcagcggcctggccgtgatcgactgggagtactggagaccccagtgggccagaaactggaacagcaaggacgtgtacagacagaagagcagaaagctgatcagcgacatgggcaagaacgtgagcgccaccgacatcgagtacctggccaaggtgaccttcgaggagagcgccaaggccttcatgaaggagaccatcaagctgggcatcaagagcagacccaagggcctgtggggctactacctgtaccccgactgccacaactacaacgtgtacgcccccaactacagcggcagctgccccgaggacgaggtgctgagaaacaacgagctgagctggctgtggaacagcagcgccgccctgtaccccagcatcggcgtgtggaagagcctgggcgacagcgagaacatcctgagattcagcaagttcagagtgcacgagagcatgagaatcagcaccatgaccagccacgactacgccctgcccgtgttcgtgtacaccagactgggctacagagacgagcccctgttcttcctgagcaagcaggacctggtgagcaccatcggcgagagcgccgccctgggcgccgccggcatcgtgatctggggcgacatgaacctgaccgccagcaaggccaactgcaccaaggtgaagcagttcgtgagcagcgacctgggcagctacatcgccaacgtgaccagagccgccgaggtgtgcagcctgcacctgtgcagaaacaacggcagatgcatcagaaagatgtggaacgcccccagctacctgcacctgaaccccgccagctaccacatcgaggccagcgaggacggcgagttcaccgtgaagggcaaggccagcgacaccgacctggccgtgatggccgacaccttcagctgccactgctaccagggctacgagggcgccgactgcagagagatcaagaccgccgacggctgcagcggcgtgagccccagccccggcagcctgatgaccctgtgcctgctgctgctggccagctacagaagcatccagctgtag

SEQ ID NO: 84888 - DNA, 138 bp, Artificial Sequence
  Description of Artificial Sequence: Synthetic coding sequence
atgaaggtgctgagcgagggccagctgaagctgtgcgtggtgcagcccgtgcacctgaccagctggctgctgatcttcttcatcctgaagagcatcagctgcctgaagcccgccagactgcccatctaccagagatag

SEQ ID NO: 84889 - DNA, 192 bp, Artificial Sequence
  Description of Artificial Sequence: Synthetic coding sequence
atgaaggtgctgagcgagggccagctgaagctgtgcgtggtgcagcccgtgcacctgaccagctggctgctgatcttcttcatcctgaagagcatcagctgcctgaagcccgccagactgcccatctaccagagaaagcccttcatcgccgcctggaacgcccccaccgaccagtgcctgatcaagtactag

SEQ ID NO: 84890 - DNA, 15366 bp, Artificial Sequence
  Description of Artificial Sequence: Synthetic coding sequence
atgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagcctggacacccactactaccacttcaagctgatcaacaagggcagaagaatccagcagctgttctggatgaacgacagcttcagaccccaggccaagctgagcaagaagggcagagtgaagaagggccacgcccacgtgcagccccagcccagcggcagccaggagcccagagacccccagagccccgtgttccacctgcaccccgccagcatggagctgtaccccggccaggccatcgacgtgatcctggagggctacagcgccacccccagaatcgtgaaggagaagctggtgtgccacgccatcatcggcgcccagaagggcaagagcctggtgatggccgtgaacatcacctgcgagttcgtggcccccctgatccagctgagcaccaagcagctgatctacagactggagaagaagcccaacagcatcctgaagcccgactaccagcccctggccatcaagaacatcagcaccctgcccgtgaacctgctgctgagcaccagcggccccttcttcatctgcgagaccgacaagagcctgctgcccgccacccccgagcccatcaagctggagatcgacgaggagaagaacctgctgatcaagttcgaccccagctacagaaacgacctgaacaactgggtggccgaggagatcctggccatcaagtacgtggagcacccccagatcgacagcctggacctgagaggcgaggtgcactaccccaacctgagcttcgagaccaaggagctggacttcggctgcatcctgaacgacaccgagctgatcagatacgtgaccatcaccaactgcagccccctggtggtgaagttcagatggttcttcctggtgaacgacgaggagaaccagatcagattcgtgaccctgcccaagaagccctacagcgcccccgtgagccagatggagagcatccccgccaccagcgaggccgccagcccccccgccatcctggtgaccgtggagagccccgagatggacctgaacgacttcgtgaagaccgtgctggtggacgaggacgccagacccgaggagaaggagctgagaaagaccaaggccagcagcgtgatcagcgacgagatcaagatcagcagcaccgagatcgagagaatctacagcagccagagccaggtggaggaccaggagagcctgcagacctgcgagcagaacgagatgctgagcatcggcatcgaggaggtgttcgacatcctgcccctgttcggcgtgctgcagccccacagcagccaccagatcagcttcaccttctacggccacgccaacatcatcgcccaggccaaggccctgtgcgaggtggaggagggccccacctacgagatcaccctgaagggcgaggccagcctggtgaactacagcttcgacaccaaggacatccactacggcctgcagctgttcgaccacgtgaccgagagagagatcaccctgaccaacatgggcaaggtgggcttcgagttcaaggtgctgaccgaccaccagagcagccccgacaacctgctgcccggcgtgcccctgatcctgcccgtgagcggcttcatcagcagccaccaggagcaggtgctgaaggtgtactacctgcccggcgtgcccgaggtgttcaagagaagcttccagatccagatcgcccacctggaccccgagaacatcaccctgagcggcgagggcatcttcccccagatctgcctggacctgcccagaaacctgaccgccaacgagaagtacgagatgttcctgaaccaggccagaaagaacaccgacaaggagtacaacaagtgcgagatgctggaccacttcgacatcatcaccgaggaggtgcccgaggacgagcccgccgaggtgagcgcccacctgcagatggaggtggagagactgatcgtgcagagctacgtgctggagcaccagaagaccaccacccccgaccccatggacgacccctgcttcagccacagaagcagaagaaagctggccaagatccagctgcccgagtacatcctggacttcggctacatcatcctgggcgaggtgagaacccacatcatcaagatcatcaacaccagccacttccccgtgagcttccacgccgacaagagagtgctgcacgagaccggcttcagcaccgagctggacagagtgaagaacctgccccactgcgagaccgagatcttcgaggtgagattcgacccccagggcgccaacctgcccgtgggcagcaaggaggtgatcctgcccatcaaggtggtgggcggccccaccgtgcacatctgcctgcaggccaaggtgaccatccccaccatgaccctgagcagaggcaaggtggacttcgccaccatccagtgcggccagtgcctggtggagaccatccagctgagcaaccacctgcaggtgccctgcgagtggttcgtgcagagccagaagcccgtggacaagctggagaagcacatgcccaagtacctgagacagaagctgagagccgagctgaagcccaagaccagaatcttcgagatccagcccatcagcggcgtgctggaccccggcgagaagagcaacgtgcaggtgaagttcatgcccaaggaggagaagttctacagccagaccctggtgttccagatcgcccagagcgcccagaagctgaccctgctggccagaggccagggcctggagcccagactggagttcagccccagcgtgctggacctgggccccctgctgctgtgcgcccccggcgacgaggccgaggtgatcgtgaagaacccctgcaacttccccatcgagttctacagcctggagttcgaccagcagtacctgatcgaggagaagatcctgagaaagctgaagggctacgacagctacaacaccctgctgctgccccccagaaaccccggcgagaagctgccccccgagctgtacgagtacttcaaggagatcaagaagagcaaggaggagcagatgagagccaagtacctggagaacctggcccaggagaacgaggaggaggacatcaccagcagcgaccagggcaccagcaacagcaccaagagaaccagcctgagcagaggcatcagcgtgaccagcaacctggaggagtggcacgccctgctggtggagagcaagacctacctggaggaggaggaggacgaggagagcctggagaagatcatcttccagaccgacaagctgcagagcatcgacagccacagcatggaggaggtgggcgaggtggagaacaaccccgtgagcaaggccatcgccagacacctgggcatcgacatcagcgccgagggcagactggccaagaacagaaagggcatcgccatcatcatccacggcacccccctgagcggcaagagcgccaacgccgtgagcgtggccaagtactacaacgccgcctgcctgagcatcgacagcatcgtgctggaggccgtggccaacagcaacaacatccccggcatcagagccagagagctgtgcatcagagccgccatcgagcagagcgtgaaggagggcgaggaggccgcccaggaggccgccgtgggccagaacgtgatcggccagggcagactgagcaccgacaccctgggcaagctggccagcgagatgaccctggtggcccccgagatcaagcccggcaagagcgtgagaggcagcgtggtgatcaccaagagcaaggccgacagccacggcagcggcagccagaagcagcaccacagccaccagagcgagaccccccagatcagcagcagccccctgccccccggccccatccacagatggctgagcgtgagccccagcgtgggcggcgagaccggcctgatgagctgcgtgctgcccgacgagctgctggtgcagatcctggccgagagaatccagctgagcgactgctacagaggcgtggtgttcgacggcctggacaccctgttcgcccagaacgccgccgccgccctgctgtgcctgctgaaggccatcggcagcagagagcacatctacatcctgaacatggcccaggactacgccgccatgaaggcccaggagaaggccaagaaggagcaggaggagagaaagcacaagggcgccctggagaaggagaaggagagactgcagaacatggacgaggaggagtacgacgccctgaccgaggaggagaagctgaccttcgacagaggcatccagcaggccctgagagagagaaagaagagagagcaggagagactggccaaggagatgcaggagaagaagctgcagcaggagctggagagacagaaggaggaggacgagctgaagagaagagtgaagaagggcaagcagggccccatcaaggaggagccccccatgaagaagagccaggccgccaacaagcaggtgccccccctgaccaaggtggacgtgaagatggagaccatcgagagaaagatcagcgtgagagagcagaccatgagcgagaaggaggagctgaacaagaagaagagaaacatgggcgacgtgagcatgcacggcctgcccctggtgcaggaccaggaggacagcgagggcgacaacagcaaggaccccgacaagcagctggcccccaagttcaagacctacgagctgaccctgaaggacgtgcagaacatcctgatgtactgggacagaaagcagggcgtgcagctgccccccgccggcatggaggaggccccccacgagcccgacgaccagagacaggtgcccctgggcggcagaagaggcagaaaggacagagagagagagagactggagaaggagagaaccgagaaggagagactggagagagagaaggccgagagagagagactggagaagctgagagccctggaggagagaagcgactgggagggcgagggcgaggaggaccacgagggcaagaaggagaaggacctgggcgtgcccttcctggacatccagacccccgacttcgagggcctgagctggaagcaggccctggagagcgacaagctgcccaagggcgagcagatcctggacatcctgggcctgggcgccagcggcccccccatccccccccccgccctgttcagcatcgtgagctaccccgtgaagagaccccccctgaccatgaccgacgacctggagcacttcgtgttcgtgatcccccccagcgaggacatcagcctggacgagaagaaggagatggagatcgagagcgacttcctggccaccaccaacaccaccaaggcccaggaggagcagaccagcagcagcaagggcggcaagcagaagatgaaggagaagatcgaccaggtgttcgagatccagaaggacaagagacacatggccctgaacagaaaggtgctgagcggcgagcccgccggcaccatcagccagctgagcgacaccgacctggacaacttcaacggccagcacagccaggagaagttcaccagactgaaccacttcagatggatcgtgcccgccaacggcgaggtgaccctgcaggtgcacttcagcagcgacgagttcggcaacttcgaccagaccttcaacttcgagatcctgggcacctgctgccagtaccagctgtactgcagaggcatctgcacctacccctacatctgccaggaccccaaggtggtgttcccccagagaaagatggacatgaagaccaacgaggtgatcttcaagaagtacgtgatgagcaccgagacctactacttcggccccctgctgtgcggcaagagcagagacaagtacaagagcagcctgttccccggcaacatggagaccctgaccatcctgaacaccagcctgatggtggtggaggccagcttctacttccagaacgacgtgaaggccaacacctacttcctggagcccaacaccatggtgctgaagcccaacgagaagcagatcctgaacgtgtgggcctaccccaccagcgtgggcgtgttcgaggacagcatcgtgtgctgcatcaacgacaaccccgagcccgccatcttccagctgagctgccagggcatcagacccgagctggagctggagcccagacagctgcacttcgacagactgctgctgcacagacaggagagcagagtggtgctgctgagaaacgtgaccctgctgcccgtggcctggagaatcaccagcctggagcacctgggcgacgacttcaccgtgagcctgatgcagggcaccatcccccccgaggccgagtacggcctgcacctgtacttccagcccaccaagcccgtgaacatcaagaaggccatcagactggaggtgctggacgccgagaacctgctgggcgtggtgcagatcgagaacatcatggtgttcgccgaggcctacgacatcgccctggacatcaccttccccaagggcgccgagggcggcctggacttcggcatcgtgagagtgaccgaggaggccaagcagcccctgcagctgaagaacagaggcaagtacgagatcgccttcagcttcagcgtggacagcgtgggcatcagcacccccaacatcaacagcatgatcagcgtgcagcccaagaagggcagcctgacccccaccgagaagcccaccaacgtgcaggtgttcttccacgccaagaaggaggtgaagatcgagcaccagcccgtgctgagatgccagatcatcgagcccaacatcagcgagggcggcgagatcatcgccagcatccccatcaagttcagcgccaacgccgtgtacagcaagtacaacatcacccccagcagcgtgatcaacttcggcgccctgatctgcggcaccagaaagagcaccaccttcaccatcgagaaccagggcgtgaccgacttcaagttcgccctgtacaagctgaccggcgagagccccatccaccagaagaaggccgccagccacgtgagacacgccagaagcagagagagcgagagcttctacaagaccggcagcagcagagccgccaagttcagcgacaccatccagaaggaggtgaccaccaccggccaggccagattcgcccacggcatgttcaccgtgtaccccggcttcggcagcatccccagcggcggccagcaggtgatcaacgtggactgcgtggccgacgccatgggcaagtgcgaggagttcatcgccatcgacatcagcggcagagaccccgccgtgcaccccgccggcatcctgtacaccctgctggccgaggcctgcctgcccgccttcgtgaccgagaacaacgccctgatcttcgaggagcaccagatctgcaccagcgccaacctgcaccacatcctgcagaccatcgagagcggcggcctgttcgtggaggacgagaacaagttcatcttctgcaacgtgctggtgggcagacaggccaaggccagattcaagatcagcaacgtgggcaagatcacctgcgacgtgaacatcgtggtgagacccatcagcaacaagcccttcgccagaatcgtggacatcttcgaggtggagcccagcaagatgtgcatcgccagccacagccacgccttcgccaccgtgagcttcaccccccagatcatgcagaactaccagtgcatcttcgaggccaccctggacggcctgcccagcaccctggccaagagcagaggcctggtgttcgacatcgccggcgagggcaacctgcccagagtgaccgtggtgagacccgtgctgcacaaccagtacggcaaccccctgctgctgttcaagagactgctgctgggccacagcgagaagctgcccctgatcctgaagaacaacggcgtgctgcccgcccagctgcacgtggacctgcaggacgagctgggcgtgttcagcctgaagggcagacccaccaccgcctacatctacatcaccgaggagaacaagccccacgtgaaggccaagaaggcccacaccgccagcctggtggtgagccccggcgacaccgccgagttcgacgtggtgttccacagccagaaggtgggcagaatgagaggcatcatccacctgagcgtgatcaacaaccagtacgaggagaccagcatccacatggtgggcgagggctacgaggacgacatcaccctggacaacatccacggcctggtggcccccaccagccaggaggacatcagcatcagcgagttcaccgagatcatcgaggacaacgacatggaggacctggtggccgccgccctggtggaccacatccagttcggcgactgccacatcggccacagctacaacgccagcttcaccgtgaccaaccacagccaggtgaacctgatcagattcgagtggcccgtgagcgccaccatcgccttcagcccccagatgggccacctgcaccccggctgcgccaaggacatcgtggtgaccatgaagagcgacgtgcccatcaacctgaagaacatgagaatcagatgcaagctgagcagaatcatgttccagctgcccgccgaccaggtgcccgactgggacgacagaatgcacaccgtgaagtgggtggacgtgcccagaaacatgcccggcaccttcaccaccaagagaaaggtgatcgagaccgaccccgagcccgcccacagcgtgctggaggagaactaccaggagctgcagctgcagatcagcgccaacgtggacttcgccagctaccactgccaggccagagacgtgagattcaaggagaccctggtgtaccagaccagagtgttcgagttcgacgtgatcaacagcggcagagtgcagctggagttcagctgggtgagcgaggacaccagcaaggccgtgagcttcgccaagcccgaccaccagggcagcgcccagaaggaccagctgagccagggcaccatgcacaccggcagcaccctggacagcaccatggaccactgggccgagggcagcccccagcccttcagcgtggagcccagcagcggcatcgtgcccgtgggcaagatccagaagttcaaggtgaagttcagccccctggacatcggcgacttcgagagcaacctgttctgccagatccccaacctgccccccggcgagcagggccccgtgctggtggccaagggcagaagcaccctgcccatctgccacttcgacctgaaggacagcgactacatcagcggccaccagagaaaccccgagctgagaggcagcagcggcggcgccctggaccccaacaccagagtgatcgagttcaccaccgtgggcatcggcggcaagaacctgagaaccttcaccatcctgaaccccaccaacagcacctacagcttctgctggatcagcgaggagatcgagagcctgcagaaccccgccgccttcacctgcctgaccgagaagggcttcatccaccccgagaagaaggccgagatcgtgttccagttcacccccttccacctgggcatcaccgagagcagctggaccttcctgatccccgagcacaacatcaccgtgcccttcctgctggtgggcaagaccaccgagcccctgatcagcctgaacaagagccacctgaacttcagcagcctgctgatcggcagagaggccagagagaccgtgcagatcatcaacaaggaggagcagggcttcgacttcagcttccaggacaacagcagatacagcgagggcttcagcaacagcctgctggtgtgccccatggagggctggatcccccccctgagcagattccccatcgacatcttcttcacccccaagcaggagggcgacgtgaacttcaacctgatctgcaacgtggagaagaaggtgcaccccgtgaccctgaacgtgaaggccgagggctacaccatgaacgtggagatcaagtgcaaggacagaaccggcagcatcaccctgctgacccccaaccagaccaacatcatcaacttctacgaggtggagctgaacgagtgcgtgcagtgcgagttcaacttcatcaacaccggcaagttcaccttcagcttccaggcccagctgtgcggcagcaagaccctgctgcagtacctggagttcagccccatcgacagcaccgtggacgtgggccagagcgtgcacgccaccctgagcttccagcccctgaagaagtgcgtgctgaccgacctggagctgatcatcaagatcagccacggccccaccttcatgtgcaacatcagcggctgcgccgtgagccccgccatccacttcagcttcaccagctacaacttcggcacctgcttcatctaccaggccggcatgcccccctacaagcagaccctggtgatcaccaacaaggaggagacccccatgagcatcgactgcctgtacaccaacaccacccacctggaggtgaacagcagagtggacgtggtgaagcccggcaacaccctggagatccccatcaccttctaccccagagagagcatcaactaccaggagctgatccccttcgagatcaacggcctgagccagcagaccgtggagatcaagggcaagggcaccaagatgaagatcctggtgctggaccccgccaacagaatcgtgaagctgggcgccgtgctgcccggccaggtggtgaagagaaccgtgagcatcatgaacaacagcctggcccagctgaccttcaaccagagcatcctgttcaccatccccgagctgcaggagcccaaggtgctgaccctggcccccttccacaacatcaccctgaagcccaaggaggtgtgcaagctggaggtgatcttcgcccccaagaagagagtgccccccttcagcgaggaggtgttcatggagtgcatgggcctgctgagacccctgttcctgctgagcggctgctgccaggccctggagatcagcctggaccaggagcacatccccttcggccccgtggtgtaccagacccaggccaccagaagaatcctgatgatgaacaccggcgacgtgggcgccagattcaagtgggacatcaagaagttcgagccccacttcagcatcagccccgaggagggctacatcaccagcggcatggaggtgagcttcgaggtgacctaccaccccaccgaggtgggcaaggagagcctgtgcaagaacatcctgtgctacatccagggcggcagccccctgagcctgaccctgagcggcgtgtgcgtgggcccccccgccgtgaaggaggtggtgaacttcacctgccaggtgagaagcaagcacacccagaccatcctgctgagcaacagaaccaaccagacctggaacctgcaccccatcttcgagggcgagcactgggagggccccgagttcatcaccctggaggcccaccagcagaacaagccctacgagatcacctacagacccagaaccatgaacctggagaacagaaagcaccagggcaccctgttcttccccctgcccgacggcaccggctggctgtacgccctgcacggcaccagcgagctgcccaaggccgtggccaacatctacagagaggtgccctgcaagaccccctacaccgagctgctgcccatcaccaactggctgaacaagccccagagattcagagtgatcgtggagatcctgaagcccgagaagcccgacctgagcatcaccatgaagggcctggactacatcgacgtgctgagcggcagcaagaaggactacaagctgaacttcttcagccacaaggagggcacctacgccgccaaggtgatcttcagaaacgaggtgaccaacgagttcctgtactacaacgtgagcttcagagtgatccccagcggcatcatcaagaccatcgagatggtgacccccgtgagacaggtggccagcgccagcatcaagctggagaaccccctgccctacagcgtgaccttcagcaccgagtgcagaatgcccgacatcgccctgcccagccagttcgtggtgcccgccaacagcgagggcaccttcagcttcgagttccagcccctgaaggccggcgagaccttcggcagactgaccctgcacaacaccgacctgggctactaccagtacgagctgtacctgaaggccacccccgccctgcccgagaagcccgtgcacttccagaccgtgctgggcagcagccagatcatcctggtgaagttcatcaactacaccagacagagaaccgagtactactgcagaaccgactgcaccgacttccacgccgagaagctgatcaacgccgcccccggcggccagggcggcaccgaggccagcgtggaggtgctgttcgagcccagccacctgggcgagaccaagggcatcctgatcctgagcagcctggccggcggcgagtacatcatccccctgttcggcatggccctgccccccaagccccagggccccttcagcatcagagccggctacagcatcatcatccccttcaagaacgtgttctaccacatggtgaccttcagcatcatcgtggacaaccccgccttcaccatcagagccggcgagagcgtgagacccaagaagatcaacaacatcaccgtgagcttcgagggcaaccccagcggcagcaagacccccatcaccaccaagctgaccgtgagctgcccccccggcgagggcagcgagaccggcgtgaagtgggtgtactacctgaagggcatcaccctgtag

SEQ ID NO: 84891 - DNA, 2853 bp, Artificial Sequence
  Description of Artificial Sequence: Synthetic coding sequence
atggagagcgccggcggcttcaagctgggcatggagcccctgagcggcggcggcgtgtgcgagaagaagaagctgctgaagatgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagatag

SEQ ID NO: 84892 - DNA, 2823 bp, Artificial Sequence
  Description of Artificial Sequence: Synthetic coding sequence
atggagagcgccggcggcttcaagctgggcgagaagaagaagctgctgaagatgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagatag

SEQ ID NO: 84893 - DNA, 15363 bp, Artificial Sequence
  Description of Artificial Sequence: Synthetic coding sequence
atgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagcctggacacccactactaccacttcaagctgatcaacaagggcagaagaatccagcagctgttctggatgaacgacagcttcagaccccaggccaagctgagcaagaagggcagagtgaagaagggccacgcccacgtgcagccccagcccagcggcagccaggagcccagagacccccagagccccgtgttccacctgcaccccgccagcatggagctgtaccccggccaggccatcgacgtgatcctggagggctacagcgccacccccagaatcgtgaaggagaagctggtgtgccacgccatcatcggcgcccagaagggcaagagcctggtgatggccgtgaacatcacctgcgagttcgtggcccccctgatccagctgagcaccaagcagctgatctacagactggagaagaagcccaacagcatcctgaagcccgactaccagcccctggccatcaagaacatcagcaccctgcccgtgaacctgctgctgagcaccagcggccccttcttcatctgcgagaccgacaagagcctgctgcccgccacccccgagcccatcaagctggagatcgacgaggagaagaacctgctgatcaagttcgaccccagctacagaaacgacctgaacaactgggtggccgaggagatcctggccatcaagtacgtggagcacccccagatcgacagcctggacctgagaggcgaggtgcactaccccaacctgagcttcgagaccaaggagctggacttcggctgcatcctgaacgacaccgagctgatcagatacgtgaccatcaccaactgcagccccctggtggtgaagttcagatggttcttcctggtgaacgacgaggagaaccagatcagattcgtgaccctgcccaagaagccctacagcgcccccgtgagccagatggagagcatccccgccaccagcgaggccgccagcccccccgccatcctggtgaccgtggagagccccgagatggacctgaacgacttcgtgaagaccgtgctggtggacgaggacgccagacccgaggagaaggagctgagaaagaccaaggccagcagcgtgatcagcgacgtgagatgccccttccacggcgaggagagaatctacagcagccagagccaggtggaggaccaggagagcctgcagacctgcgagcagaacgagatgctgagcatcggcatcgaggaggtgttcgacatcctgcccctgttcggcgtgctgcagccccacagcagccaccagatcagcttcaccttctacggccacgccaacatcatcgcccaggccaaggccctgtgcgaggtggaggagggccccacctacgagatcaccctgaagggcgaggccagcctggtgaactacagcttcgacaccaaggacatccactacggcctgcagctgttcgaccacgtgaccgagagagagatcaccctgaccaacatgggcaaggtgggcttcgagttcaaggtgctgaccgaccaccagagcagccccgacaacctgctgcccggcgtgcccctgatcctgcccgtgagcggcttcatcagcagccaccaggagcaggtgctgaaggtgtactacctgcccggcgtgcccgaggtgttcaagagaagcttccagatccagatcgcccacctggaccccgagaacatcaccctgagcggcgagggcatcttcccccagatctgcctggacctgcccagaaacctgaccgccaacgagaagtacgagatgttcctgaaccaggccagaaagaacaccgacaaggagtacaacaagtgcgagatgctggaccacttcgacatcatcaccgaggaggtgcccgaggacgagcccgccgaggtgagcgcccacctgcagatggaggtggagagactgatcgtgcagagctacgtgctggagcaccagaagaccaccacccccgaccccatggacgacccctgcttcagccacagaagcagaagaaagctggccaagatccagctgcccgagtacatcctggacttcggctacatcatcctgggcgaggtgagaacccacatcatcaagatcatcaacaccagccacttccccgtgagcttccacgccgacaagagagtgctgcacgagaccggcttcagcaccgagctggacagagtgaagaacctgccccactgcgagaccgagatcttcgaggtgagattcgacccccagggcgccaacctgcccgtgggcagcaaggaggtgatcctgcccatcaaggtggtgggcggccccaccgtgcacatctgcctgcaggccaaggtgaccatccccaccatgaccctgagcagaggcaaggtggacttcgccaccatccagtgcggccagtgcctggtggagaccatccagctgagcaaccacctgcaggtgccctgcgagtggttcgtgcagagccagaagcccgtggacaagctggagaagcacatgcccaagtacctgagacagaagctgagagccgagctgaagcccaagaccagaatcttcgagatccagcccatcagcggcgtgctggaccccggcgagaagagcaacgtgcaggtgaagttcatgcccaaggaggagaagttctacagccagaccctggtgttccagatcgcccagagcgcccagaagctgaccctgctggccagaggccagggcctggagcccagactggagttcagccccagcgtgctggacctgggccccctgctgctgtgcgcccccggcgacgaggccgaggtgatcgtgaagaacccctgcaacttccccatcgagttctacagcctggagttcgaccagcagtacctgatcgaggagaagatcctgagaaagctgaagggctacgacagctacaacaccctgctgctgccccccagaaaccccggcgagaagctgccccccgagctgtacgagtacttcaaggagatcaagaagagcaaggaggagcagatgagagccaagtacctggagaacctggcccaggagaacgaggaggaggacatcaccagcagcgaccagggcaccagcaacagcaccaagagaaccagcctgagcagaggcatcagcgtgaccagcaacctggaggagtggcacgccctgctggtggagagcaagacctacctggaggaggaggaggacgaggagagcctggagaagatcatcttccagaccgacaagctgcagagcatcgacagccacagcatggaggaggtgggcgaggtggagaacaaccccgtgagcaaggccatcgccagacacctgggcatcgacatcagcgccgagggcagactggccaagaacagaaagggcatcgccatcatcatccacggcacccccctgagcggcaagagcgccaacgccgtgagcgtggccaagtactacaacgccgcctgcctgagcatcgacagcatcgtgctggaggccgtggccaacagcaacaacatccccggcatcagagccagagagctgtgcatcagagccgccatcgagcagagcgtgaaggagggcgaggaggccgcccaggaggccgccgtgggccagaacgtgatcggccagggcagactgagcaccgacaccctgggcaagctggccagcgagatgaccctggtggcccccgagatcaagcccggcaagagcgtgagaggcagcgtggtgatcaccaagagcaaggccgacagccacggcagcggcagccagaagcagcaccacagccaccagagcgagaccccccagatcagcagcagccccctgccccccggccccatccacagatggctgagcgtgagccccagcgtgggcggcgagaccggcctgatgagctgcgtgctgcccgacgagctgctggtgcagatcctggccgagagaatccagctgagcgactgctacagaggcgtggtgttcgacggcctggacaccctgttcgcccagaacgccgccgccgccctgctgtgcctgctgaaggccatcggcagcagagagcacatctacatcctgaacatggcccaggactacgccgccatgaaggcccaggagaaggccaagaaggagcaggaggagagaaagcacaagggcgccctggagaaggagaaggagagactgcagaacatggacgaggaggagtacgacgccctgaccgaggaggagaagctgaccttcgacagaggcatccagcaggccctgagagagagaaagaagagagagcaggagagactggccaaggagatgcaggagaagaagctgcagcaggagctggagagacagaaggaggaggacgagctgaagagaagagtgaagaagggcaagcagggccccatcaaggaggagccccccatgaagaagagccaggccgccaacaagcaggtgccccccctgaccaaggtggacgtgaagatggagaccatcgagagaaagatcagcgtgagagagcagaccatgagcgagaaggaggagctgaacaagaagaagagaaacatgggcgacgtgagcatgcacggcctgcccctggtgcaggaccaggaggacagcgagggcgacaacagcaaggaccccgacaagcagctggcccccaagttcaagacctacgagctgaccctgaaggacgtgcagaacatcctgatgtactgggacagaaagcagggcgtgcagctgccccccgccggcatggaggaggccccccacgagcccgacgaccagagacaggtgcccctgggcggcagaagaggcagaaaggacagagagagagagagactggagaaggagagaaccgagaaggagagactggagagagagaaggccgagagagagagactggagaagctgagagccctggaggagagaagcgactgggagggcgagggcgaggaggaccacgagggcaagaaggagaaggacctgggcgtgcccttcctggacatccagacccccgacttcgagggcctgagctggaagcaggccctggagagcgacaagctgcccaagggcgagcagatcctggacatcctgggcctgggcgccagcggcccccccatccccccccccgccctgttcagcatcgtgagctaccccgtgaagagaccccccctgaccatgaccgacgacctggagcacttcgtgttcgtgatcccccccagcgaggacatcagcctggacgagaagaaggagatggagatcgagagcgacttcctggccaccaccaacaccaccaaggcccaggaggagcagaccagcagcagcaagggcggcaagcagaagatgaaggagaagatcgaccaggtgttcgagatccagaaggacaagagacacatggccctgaacagaaaggtgctgagcggcgagcccgccggcaccatcagccagctgagcgacaccgacctggacaacttcaacggccagcacagccaggagaagttcaccagactgaaccacttcagatggatcgtgcccgccaacggcgaggtgaccctgcaggtgcacttcagcagcgacgagttcggcaacttcgaccagaccttcaacttcgagatcctgggcacctgctgccagtaccagctgtactgcagaggcatctgcacctacccctacatctgccaggaccccaaggtggtgttcccccagagaaagatggacatgaagaccaacgaggtgatcttcaagaagtacgtgatgagcaccgagacctactacttcggccccctgctgtgcggcaagagcagagacaagtacaagagcagcctgttccccggcaacatggagaccctgaccatcctgaacaccagcctgatggtggtggaggccagcttctacttccagaacgacgtgaaggccaacacctacttcctggagcccaacaccatggtgctgaagcccaacgagaagcagatcctgaacgtgtgggcctaccccaccagcgtgggcgtgttcgaggacagcatcgtgtgctgcatcaacgacaaccccgagcccgccatcttccagctgagctgccagggcatcagacccgagctggagctggagcccagacagctgcacttcgacagactgctgctgcacagacaggagagcagagtggtgctgctgagaaacgtgaccctgctgcccgtggcctggagaatcaccagcctggagcacctgggcgacgacttcaccgtgagcctgatgcagggcaccatcccccccgaggccgagtacggcctgcacctgtacttccagcccaccaagcccgtgaacatcaagaaggccatcagactggaggtgctggacgccgagaacctgctgggcgtggtgcagatcgagaacatcatggtgttcgccgaggcctacgacatcgccctggacatcaccttccccaagggcgccgagggcggcctggacttcggcatcgtgagagtgaccgaggaggccaagcagcccctgcagctgaagaacagaggcaagtacgagatcgccttcagcttcagcgtggacagcgtgggcatcagcacccccaacatcaacagcatgatcagcgtgcagcccaagaagggcagcctgacccccaccgagaagcccaccaacgtgcaggtgttcttccacgccaagaaggaggtgaagatcgagcaccagcccgtgctgagatgccagatcatcgagcccaacatcagcgagggcggcgagatcatcgccagcatccccatcaagttcagcgccaacgccgtgtacagcaagtacaacatcacccccagcagcgtgatcaacttcggcgccctgatctgcggcaccagaaagagcaccaccttcaccatcgagaaccagggcgtgaccgacttcaagttcgccctgtacaagctgaccggcgagagccccatccaccagaagaaggccgccagccacgtgagacacgccagaagcagagagagcgagagcttctacaagaccggcagcagcagagccgccaagttcagcgacaccatccagaaggaggtgaccaccaccggccaggccagattcgcccacggcatgttcaccgtgtaccccggcttcggcagcatccccagcggcggccagcaggtgatcaacgtggactgcgtggccgacgccatgggcaagtgcgaggagttcatcgccatcgacatcagcggcagagaccccgccgtgcaccccgccggcatcctgtacaccctgctggccgaggcctgcctgcccgccttcgtgaccgagaacaacgccctgatcttcgaggagcaccagatctgcaccagcgccaacctgcaccacatcctgcagaccatcgagagcggcggcctgttcgtggaggacgagaacaagttcatcttctgcaacgtgctggtgggcagacaggccaaggccagattcaagatcagcaacgtgggcaagatcacctgcgacgtgaacatcgtggtgagacccatcagcaacaagcccttcgccagaatcgtggacatcttcgaggtggagcccagcaagatgtgcatcgccagccacagccacgccttcgccaccgtgagcttcaccccccagatcatgcagaactaccagtgcatcttcgaggccaccctggacggcctgcccagcaccctggccaagagcagaggcctggtgttcgacatcgccggcgagggcaacctgcccagagtgaccgtggtgagacccgtgctgcacaaccagtacggcaaccccctgctgctgttcaagagactgctgctgggccacagcgagaagctgcccctgatcctgaagaacaacggcgtgctgcccgcccagctgcacgtggacctgcaggacgagctgggcgtgttcagcctgaagggcagacccaccaccgcctacatctacatcaccgaggagaacaagccccacgtgaaggccaagaaggcccacaccgccagcctggtggtgagccccggcgacaccgccgagttcgacgtggtgttccacagccagaaggtgggcagaatgagaggcatcatccacctgagcgtgatcaacaaccagtacgaggagaccagcatccacatggtgggcgagggctacgaggacgacatcaccctggacaacatccacggcctggtggcccccaccagccaggaggacatcagcatcagcgagttcaccgagatcatcgaggacaacgacatggaggacctggtggccgccgccctggtggaccacatccagttcggcgactgccacatcggccacagctacaacgccagcttcaccgtgaccaaccacagccaggtgaacctgatcagattcgagtggcccgtgagcgccaccatcgccttcagcccccagatgggccacctgcaccccggctgcgccaaggacatcgtggtgaccatgaagagcgacgtgcccatcaacctgaagaacatgagaatcagatgcaagctgagcagaatcatgttccagctgcccgccgaccaggtgcccgactgggacgacagaatgcacaccgtgaagtgggtggacgtgcccagaaacatgcccggcaccttcaccaccaagagaaaggtgatcgagaccgaccccgagcccgcccacagcgtgctggaggagaactaccaggagctgcagctgcagatcagcgccaacgtggacttcgccagctaccactgccaggccagagacgtgagattcaaggagaccctggtgtaccagaccagagtgttcgagttcgacgtgatcaacagcggcagagtgcagctggagttcagctgggtgagcgaggacaccagcaaggccgtgagcttcgccaagcccgaccaccagggcagcgcccagaaggaccagctgagccagggcaccatgcacaccggcagcaccctggacagcaccatggaccactgggccgagggcagcccccagcccttcagcgtggagcccagcagcggcatcgtgcccgtgggcaagatccagaagttcaaggtgaagttcagccccctggacatcggcgacttcgagagcaacctgttctgccagatccccaacctgccccccggcgagcagggccccgtgctggtggccaagggcagaagcaccctgcccatctgccacttcgacctgaaggacagcgactacatcagcggccaccagagaaaccccgagctgagaggcagcagcggcggcgccctggaccccaacaccagagtgatcgagttcaccaccgtgggcatcggcggcaagaacctgagaaccttcaccatcctgaaccccaccaacagcacctacagcttctgctggatcagcgaggagatcgagagcctgcagaaccccgccgccttcacctgcctgaccgagaagggcttcatccaccccgagaagaaggccgagatcgtgttccagttcacccccttccacctgggcatcaccgagagcagctggaccttcctgatccccgagcacaacatcaccgtgcccttcctgctggtgggcaagaccaccgagcccctgatcagcctgaacaagagccacctgaacttcagcagcctgctgatcggcagagaggccagagagaccgtgcagatcatcaacaaggaggagcagggcttcgacttcagcttccaggacaacagcagatacagcgagggcttcagcaacagcctgctggtgtgccccatggagggctggatcccccccctgagcagattccccatcgacatcttcttcacccccaagcaggagggcgacgtgaacttcaacctgatctgcaacgtggagaagaaggtgcaccccgtgaccctgaacgtgaaggccgagggctacaccatgaacgtggagatcaagtgcaaggacagaaccggcagcatcaccctgctgacccccaaccagaccaacatcatcaacttctacgaggtggagctgaacgagtgcgtgcagtgcgagttcaacttcatcaacaccggcaagttcaccttcagcttccaggcccagctgtgcggcagcaagaccctgctgcagtacctggagttcagccccatcgacagcaccgtggacgtgggccagagcgtgcacgccaccctgagcttccagcccctgaagaagtgcgtgctgaccgacctggagctgatcatcaagatcagccacggccccaccttcatgtgcaacatcagcggctgcgccgtgagccccgccatccacttcagcttcaccagctacaacttcggcacctgcttcatctaccaggccggcatgcccccctacaagcagaccctggtgatcaccaacaaggaggagacccccatgagcatcgactgcctgtacaccaacaccacccacctggaggtgaacagcagagtggacgtggtgaagcccggcaacaccctggagatccccatcaccttctaccccagagagagcatcaactaccaggagctgatccccttcgagatcaacggcctgagccagcagaccgtggagatcaagggcaagggcaccaagatgaagatcctggtgctggaccccgccaacagaatcgtgaagctgggcgccgtgctgcccggccaggtggtgaagagaaccgtgagcatcatgaacaacagcctggcccagctgaccttcaaccagagcatcctgttcaccatccccgagctgcaggagcccaaggtgctgaccctggcccccttccacaacatcaccctgaagcccaaggaggtgtgcaagctggaggtgatcttcgcccccaagaagagagtgccccccttcagcgaggaggtgttcatggagtgcatgggcctgctgagacccctgttcctgctgagcggctgctgccaggccctggagatcagcctggaccaggagcacatccccttcggccccgtggtgtaccagacccaggccaccagaagaatcctgatgatgaacaccggcgacgtgggcgccagattcaagtgggacatcaagaagttcgagccccacttcagcatcagccccgaggagggctacatcaccagcggcatggaggtgagcttcgaggtgacctaccaccccaccgaggtgggcaaggagagcctgtgcaagaacatcctgtgctacatccagggcggcagccccctgagcctgaccctgagcggcgtgtgcgtgggcccccccgccgtgaaggaggtggtgaacttcacctgccaggtgagaagcaagcacacccagaccatcctgctgagcaacagaaccaaccagacctggaacctgcaccccatcttcgagggcgagcactgggagggccccgagttcatcaccctggaggcccaccagcagaacaagccctacgagatcacctacagacccagaaccatgaacctggagaacagaaagcaccagggcaccctgttcttccccctgcccgacggcaccggctggctgtacgccctgcacggcaccagcgagctgcccaaggccgtggccaacatctacagagaggtgccctgcaagaccccctacaccgagctgctgcccatcaccaactggctgaacaagccccagagattcagagtgatcgtggagatcctgaagcccgagaagcccgacctgagcatcaccatgaagggcctggactacatcgacgtgctgagcggcagcaagaaggactacaagctgaacttcttcagccacaaggagggcacctacgccgccaaggtgatcttcagaaacgaggtgaccaacgagttcctgtactacaacgtgagcttcagagtgatccccagcggcatcatcaagaccatcgagatggtgacccccgtgagacaggtggccagcgccagcatcaagctggagaaccccctgccctacagcgtgaccttcagcaccgagtgcagaatgcccgacatcgccctgcccagccagttcgtggtgcccgccaacagcgagggcaccttcagcttcgagttccagcccctgaaggccggcgagaccttcggcagactgaccctgcacaacaccgacctgggctactaccagtacgagctgtacctgaaggccacccccgccctgcccgagaagcccgtgcacttccagaccgtgctgggcagcagccagatcatcctggtgaagttcatcaactacaccagacagagaaccgagtactactgcagaaccgactgcaccgacttccacgccgagaagctgatcaacgccgcccccggcggccagggcggcaccgaggccagcgtggaggtgctgttcgagcccagccacctgggcgagaccaagggcatcctgatcctgagcagcctggccggcggcgagtacatcatccccctgttcggcatggccctgccccccaagccccagggccccttcagcatcagagccggctacagcatcatcatccccttcaagaacgtgttctaccacatggtgaccttcagcatcatcgtggacaaccccgccttcaccatcagagccggcgagagcgtgagacccaagaagatcaacaacatcaccgtgagcttcgagggcaaccccagcggcagcaagacccccatcaccaccaagctgaccgtgagctgcccccccggcgagggcagcgagaccggcgtgaagtgggtgtactacctgaagggcatcaccctgtag

SEQ ID NO: 84894 - DNA, 3054 bp, Artificial Sequence
  Description of Artificial Sequence: Synthetic coding sequence
atgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagcctggacacccactactaccacttcaagctgatcaacaagggcagaagaatccagcagctgttctggatgaacgacagcttcagaccccaggccaagctgagcaagaagggcagagtgaagaagggccacgcccacgtgcagccccagcccagcggcagccaggagcccagagacccccagagccccgtgttccacctgcaccccgccagcatggagctgtaccccggccaggccatcgacgtgatcctggagggctacagcgccacccccagagtgagaggctag

SEQ ID NO: 84895 - DNA, 2223 bp, Artificial Sequence
  Description of Artificial Sequence: Synthetic coding sequence
atgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcgccacccaggagctgagagacccccaggtgctgatccccttccagagattcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagcgcccccgagctgtgcaacagaaaggtgatgctgagcgtgctgcagtggaagatccacagagccaagagaagcctgcccagagacaccgtggccgtgacctag

SEQ ID NO: 84896 - DNA, 3645 bp, Artificial Sequence
  Description of Artificial Sequence: Synthetic coding sequence
atgaccagcagaagactggaggagagcatgggcgccgtgcagatgggcctggtgaacatgttcaagggcttccagagcaaggtgctgccccccctgagccccaaggtggtgaccgaggaggaggtgaacagaatgctgacccccagcgagttcctgaaggagatgagcctgaccaccgagcagagactggccaagaccagactgatgtgcagaccccagatcatcgagctgctggacatgggcgagaccacccaccagaagttcagcggcatcgacctggaccaggccctgttccagcccttccccagcgagatcatcttccagaactacaccccctgcgaggtgtacgaggtgcccctgatcctgagaaacaacgacaagatccccagactggtgaaggtggtggaggagagcagcccctacttcaaggtgatcagccccaaggacatcggccacaaggtggcccccggcgtgcccagcatcttcagaatcctgttcacccccgaggagaacaaggactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaagggcagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcaccgccagatgcgtggtgcccgccctgcacctggtgaacaccgaggtggacttcggccactgcttcctgaagtacccctacgagaagaccctgcagctggccaaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttcagcctggacacccactactaccacttcaagctgatcaacaagggcagaagaatccagcagctgttctggatgaacgacagcttcagaccccaggccaagctgagcaagaagggcagagtgaagaagggccacgcccacgtgcagccccagcccagcggcagccaggagcccagagacccccagagccccgtgttccacctgcaccccgccagcatggagctgtaccccggccaggccatcgacgtgatcctggagggctacagcgccacccccagaaagcccaacagcatcctgaagcccgactaccagcccctggccatcaagaacatcagcaccctgcccgtgaacctgctgctgagcaccagcggccccttcttcatctgcgagaccgacaagagcctgctgcccgccacccccgagcccatcaagctggagatcgacgaggagaagaacctgctgatcaagttcgaccccagctacagaaacgacctgaacaactgggtggccgaggagatcctggccatcaagtacgtggagcacccccagatcgacagcctggacctgagaggcgaggtgcactaccccaacctgagcttcgagaccaaggagctggacttcggctgcatcctgaacgacaccgagctgatcagatacgtgaccatcaccaactgcagccccctggtggtgaagttcagatggttcttcctggtgaacgacgaggagaaccagatcagattcgtgaccctgcccaagaagccctacagcgcccccgtgagccagatggagagcatccccgccaccagcgaggccgccagcccccccgccatcctggtgaccgtggagagccccgagatggacctgaacgacttcgtgaagtag

SEQ ID NO: 84897 - DNA, 3054 bp, Artificial Sequence; identical to SEQ ID NO: 84894
  Description of Artificial Sequence: Synthetic coding sequence

SEQ ID NO: 84898 - DNA, 822 bp, Artificial Sequence
  Description of Artificial Sequence: Synthetic coding sequence
atggccacctgggacgagaaggccgtgaccagaagagccaaggtggcccccgccgagagaatgagcaagttcctgagacacttcaccgtggtgggcgacgactaccacgcctggaacatcaactacaagaagtgggagaacgaggaggaggaggaggaggaggagcagcccccccccacccccgtgagcggcgaggagggcagagccgccgcccccgacgtggcccccgcccccggccccgcccccagagcccccctggacttcagaggcatgctgagaaagctgttcagcagccacagattccaggtgatcatcatctgcctggtggtgctggacgccctgctggtgctggccgagctgatcctggacctgaagatcatccagcccgacaagaacaactacgccgccatggtgttccactacatgagcatcaccatcctggtgttcttcatgatggagatcatcttcaagctgttcgtgttcagactggagttcttccaccacaagttcgagatcctggacgccgtggtggtggtggtgagcttcatcctggacatcgtgctgctgttccaggagcaccagttcgaggccctgggcctgctgatcctgctgagactgtggagagtggccagaatcatcaacggcatcatcatcagcgtgaagaccagaagcgagagacagctgctgagactgaagcagatgaacgtgcagctggccgccaagatccagcacctggagttcagctgcagcgagaaggagcaggagatcgagagactgaacaagctgctgagacagcacggcctgctgggcgaggtgaactag

SEQ ID NO: 84899 - DNA, 822 bp, Artificial Sequence; identical to SEQ ID NO: 84898
  Description of Artificial Sequence: Synthetic coding sequence

SEQ ID NO: 84900 - DNA, 237 bp, Artificial Sequence
  Description of Artificial Sequence: Synthetic coding sequence
atggccacctgggacgagaaggccgtgaccagaagagccaaggtggcccccgccgagagaatgagcaagttcctgagacacttcaccgtggtgggcgacgactaccacgcctggaacatcaactacaagaagtgggagaacgaggaggaggaggaggaggaggagcagcccccccccacccccgtgagcggcgaggagggcagagccgccgcccccgacgtggcccccgccccctag

SEQ ID NO: 84901 - DNA, 900 bp, Artificial Sequence
  Description of Artificial Sequence: Synthetic coding sequence
atggaggagctgctgcccgacggccagatctgggccaacatggaccccgaggagagaatgctggccgccgccaccgccttcacccacatctgcgccggccagggcgagggcgacgtgagaagagaggcccagagcatccagtacgacccctacagcaaggccagcgtggcccccggcaagagacccgccctgcccgtgcagctgcagtacccccacgtggagagcaacgtgcccagcgagaccgtgagcgaggccagccagagactgagaaagcccgtgatgaagagaaaggtgctgagaagaaagcccgacggcgaggtgctggtgaccgacgagagcatcatcagcgagagcgagagcggcaccgagaacgaccaggacctgtgggacctgagacagagactgatgaacgtgcagttccaggaggacaaggagagcagcttcgacgtgagccagaagttcaacctgccccacgagtaccagggcatcagccaggaccagctgatctgcagcctgcagagagagggcatgggcagccccgcctacgagcaggacctgatcgtggccagcagacccaagagcttcatcctgcccaagctggaccagctgagcagaaacagaggcaagaccgacagagtggccagatacttcgagtacaagagagactgggacagcatcagactgcccggcgaggaccacagaaaggagctgagatggggcgtgagagagcagatgctgtgcagagccgagccccagagcaagccccagcacatctacgtgcccaacaactacctggtgcccaccgagaagaagagaagcgccctgagatggggcgtgagatgcgacctggccaacggcgtgatccccagaaagctgcccttccccctgagccccagctag

SEQ ID NO: 84902 - DNA, 900 bp, Artificial Sequence; identical to SEQ ID NO: 84901
  Description of Artificial Sequence: Synthetic coding sequence

SEQ ID NO: 84903 - DNA, 900 bp, Artificial Sequence; identical to SEQ ID NO: 84901
  Description of Artificial Sequence: Synthetic coding sequence

SEQ ID NO: 84904 - DNA, 1113 bp, Artificial Sequence
  Description of Artificial Sequence: Synthetic coding sequence
atgctgcccagactgatctgcatcaacgactacgagcagcacgccaagagcgtgctgcccaagagcatctacgactactacagaagcggcgccaacgacgaggagaccctggccgacaacatcgccgccttcagcagatggaagctgtaccccagaatgctgagaaacgtggccgagaccgacctgagcaccagcgtgctgggccagagagtgagcatgcccatctgcgtgggcgccaccgccatgcagagaatggcccacgtggacggcgagctggccaccgtgagagcctgccagagcctgggcaccggcatgatgctgagcagctgggccaccagcagcatcgaggaggtggccgaggccggccccgaggccctgagatggctgcagctgtacatctacaaggacagagaggtgaccaagaagctggtgagacaggccgagaagatgggctacaaggccatcttcgtgaccgtggacaccccctacctgggcaacagactggacgacgtgagaaacagattcaagctgcccccccagctgagaatgaagaacttcgagaccagcaccctgagcttcagccccgaggagaacttcggcgacgacagcggcctggccgcctacgtggccaaggccatcgaccccagcatcagctgggaggacatcaagtggctgagaagactgaccagcctgcccatcgtggccaagggcatcctgagaggcgacgacgccagagaggccgtgaagcacggcctgaacggcatcctggtgagcaaccacggcgccagacagctggacggcgtgcccgccaccatcgacgtgctgcccgagatcgtggaggccgtggagggcaaggtggaggtgttcctggacggcggcgtgagaaagggcaccgacgtgctgaaggccctggccctgggcgccaaggccgtgttcgtgggcagacccatcgtgtggggcctggccttccagggcgagaagggcgtgcaggacgtgctggagatcctgaaggaggagttcagactggccatggccctgagcggctgccagaacgtgaaggtgatcgacaagaccctggtgagaaagaaccccctggccgtgagcaagatctag

SEQ ID NO: 84905 - DNA, 1056 bp, Artificial Sequence
  Description of Artificial Sequence: Synthetic coding sequence
atgagcctggtgtgcctgaccgacttccaggcccacgccagagagcagctgagcaagagcaccagagacttcatcgagggcggcgccgacgacagcatcaccagagacgacaacatcgccgccttcaagagaatcagactgagacccagatacctgagagacgtgagcgaggtggacaccagaaccaccatccagggcgaggagatcagcgcccccatctgcatcgcccccaccggcttccactgcctggtgtggcccgacggcgagatgagcaccgccagagccgcccaggccgccggcatctgctacatcaccagcaccttcgccagctgcagcctggaggacatcgtgatcgccgcccccgagggcctgagatggttccagctgtacgtgcaccccgacctgcagctgaacaagcagctgatccagagagtggagagcctgggcttcaaggccctggtgatcaccctggacacccccgtgtgcggcaacagaagacacgacatcagaaaccagctgagaagaaacctgaccctgaccgacctgcagagccccaagaagggcaacgccatcccctacttccagatgacccccatcagcaccagcctgtgctggaacgacctgagctggttccagagcatcaccagactgcccatcatcctgaagggcatcctgaccaaggaggacgccgagctggccgtgaagcacaacgtgcagggcatcatcgtgagcaaccacggcggcagacagctggacgaggtgctggccagcatcgacgccctgaccgaggtggtggccgccgtgaagggcaagatcgaggtgtacctggacggcggcgtgagaaccggcaacgacgtgctgaaggccctggccctgggcgccaagtgcatcttcctgggcagacccatcctgtggggcctggcctgcaagggcgagcacggcgtgaaggaggtgctgaacatcctgaccaacgagttccacaccagcatggccctgaccggctgcagaagcgtggccgagatcaacagaaacctggtgcagttcagcagactgtag

SEQ ID NO: 84906 - DNA, 1095 bp, Artificial Sequence
  Description of Artificial Sequence: Synthetic coding sequence
atggaggacaagatgtggagcgagtgcgagggccccgagatgagcctggtgtgcctgaccgacttccaggcccacgccagagagcagctgagcaagagcaccagagacttcatcgagggcggcgccgacgacagcatcaccagagacgacaacatcgccgccttcaagagaatcagactgagacccagatacctgagagacgtgagcgaggtggacaccagaaccaccatccagggcgaggagatcagcgcccccatctgcatcgcccccaccggcttccactgcctggtgtggcccgacggcgagatgagcaccgccagagccgcccaggccgccggcatctgctacatcaccagcaccttcgccagctgcagcctggaggacatcgtgatcgccgcccccgagggcctgagatggttccagctgtacgtgcaccccgacctgcagctgaacaagcagctgatccagagagtggagagcctgggcttcaaggccctggtgatcaccctggacacccccgtgtgcggcaacagaagacacgacatcagaaaccagctgagaagaaacctgaccctgaccgacctgcagagccccaagaagggcaacgccatcccctacttccagatgacccccatcagcaccagcctgtgctggaacgacctgagctggttccagagcatcaccagactgcccatcatcctgaagggcatcctgaccaaggaggacgccgagctggccgtgaagcacaacgtgcagggcatcatcgtgagcaaccacggcggcagacagctggacgaggtgctggccagcatcgacgccctgaccgaggtggtggccgccgtgaagggcaagatcgaggtgtacctggacggcggcgtgagaaccggcaacgacgtgctgaaggccctggccctgggcgccaagtgcatcttcctgggcagacccatcctgtggggcctggcctgcaagggcgagcacggcgtgaaggaggtgctgaacatcctgaccaacgagttccacaccagcatggccctgaccggctgcagaagcgtggccgagatcaacagaaacctggtgcagttcagcagactgtag

SEQ ID NO: 84907 - DNA, 561 bp, Artificial Sequence
  Description of Artificial Sequence: Synthetic coding sequence
atgagcctggtgtgcctgaccgacttccaggcccacgccagagagcagctgagcaagagcaccagagacttcatcgagggcggcgccgacgacagcatcaccagagacgacaacatcgccgccttcaagagaatcagactgagacccagatacctgagagacgtgagcgaggtggacaccagaaccaccatccagggcgaggagatcagcgcccccatctgcatcgcccccaccggcttccactgcctggtgtggcccgacggcgagatgagcaccgccagagcccccgagggcctgagatggttccagctgtacgtgcaccccgacctgcagctgaacaagcagctgatccagagagtggagagcctgggcttcaaggccctggtgatcaccctggacacccccgtgtgcggcaacagaagacacgacatcagaaaccagctgagaagaaacctgaccctgaccgacctgcagagccccaagaagggcaacgccatcccctacttccagatgacccccatcagcaccagcctgtgctggaacgacctgagctggttctag

SEQ ID NO: 84908 - DNA, 2292 bp, Artificial Sequence
  Description of Artificial Sequence: Synthetic coding sequence
atggtggcctgcagagccatcggcatcctgagcagattcagcgccttcagaatcctgagaagcagaggctacatctgcagaaacttcaccggcagcagcgccctgctgaccagaacccacatcaactacggcgtgaagggcgacgtggccgtggtgagaatcaacagccccaacagcaaggtgaacaccctgagcaaggagctgcacagcgagttcagcgaggtgatgaacgagatctgggccagcgaccagatcagaagcgccgtgctgatcagcagcaagcccggctgcttcatcgccggcgccgacatcaacatgctggccgcctgcaagaccctgcaggaggtgacccagctgagccaggaggcccagagaatcgtggagaagctggagaagagcaccaagcccatcgtggccgccatcaacggcagctgcctgggcggcggcctggaggtggccatcagctgccagtacagaatcgccaccaaggacagaaagaccgtgctgggcacccccgaggtgctgctgggcgccctgcccggcgccggcggcacccagagactgcccaagatggtgggcgtgcccgccgccctggacatgatgctgaccggcagaagcatcagagccgacagagccaagaagatgggcctggtggaccagctggtggagcccctgggccccggcctgaagccccccgaggagagaaccatcgagtacctggaggaggtggccatcaccttcgccaagggcctggccgacaagaagatcagccccaagagagacaagggcctggtggagaagctgaccgcctacgccatgaccatccccttcgtgagacagcaggtgtacaagaaggtggaggagaaggtgagaaagcagaccaagggcctgtaccccgcccccctgaagatcatcgacgtggtgaagaccggcatcgagcagggcagcgacgccggctacctgtgcgagagccagaagttcggcgagctggtgatgaccaaggagagcaaggccctgatgggcctgtaccacggccaggtgctgtgcaagaagaacaagttcggcgccccccagaaggacgtgaagcacctggccatcctgggcgccggcctgatgggcgccggcatcgcccaggtgagcgtggacaagggcctgaagaccatcctgaaggacgccaccctgaccgccctggacagaggccagcagcaggtgttcaagggcctgaacgacaaggtgaagaagaaggccctgaccagcttcgagagagacagcatcttcagcaacctgaccggccagctggactaccagggcttcgagaaggccgacatggtgatcgaggccgtgttcgaggacctgagcctgaagcacagagtgctgaaggaggtggaggccgtgatccccgaccactgcatcttcgccagcaacaccagcgccctgcccatcagcgagatcgccgccgtgagcaagagacccgagaaggtgatcggcatgcactacttcagccccgtggacaagatgcagctgctggagatcatcaccaccgagaagaccagcaaggacaccagcgccagcgccgtggccgtgggcctgaagcagggcaaggtgatcatcgtggtgaaggacggccccggcttctacaccaccagatgcctggcccccatgatgagcgaggtgatcagaatcctgcaggagggcgtggaccccaagaagctggacagcctgaccaccagcttcggcttccccgtgggcgccgccaccctggtggacgaggtgggcgtggacgtggccaagcacgtggccgaggacctgggcaaggtgttcggcgagagattcggcggcggcaaccccgagctgctgacccagatggtgagcaagggcttcctgggcagaaagagcggcaagggcttctacatctaccaggagggcgtgaagagaaaggacctgaacagcgacatggacagcatcctggccagcctgaagctgccccccaagagcgaggtgagcagcgacgaggacatccagttcagactggtgaccagattcgtgaacgaggccgtgatgtgcctgcaggagggcatcctggccacccccgccgagggcgacatcggcgccgtgttcggcctgggcttccccccctgcctgggcggccccttcagattcgtggacctgtacggcgcccagaagatcgtggacagactgaagaagtacgaggccgcctacggcaagcagttcaccccctgccagctgctggccgaccacgccaacagccccaacaagaagttctaccagtag

SEQ ID NO: 84909 - DNA, 783 bp, Artificial Sequence
  Description of Artificial Sequence: Synthetic coding sequence
atggagagcaagggcatgtggcagctgttcgagctgaccctgcccatccagagcatgctggccgcctgcaagaccctgcaggaggtgacccagctgagccaggaggcccagagaatcgtggagaagctggagaagagcaccaagcccatcgtggccgccatcaacggcagctgcctgggcggcggcctggaggtggccatcagctgccagtacagaatcgccaccaaggacagaaagaccgtgctgggcacccccgaggtgctgctgggcgccctgcccggcgccggcggcacccagagactgcccaagatggtgggcgtgcccgccgccctggacatgatgctgaccggcagaagcatcagagccgacagagccaagaagatgggcctggtggaccagctggtggagcccctgggccccggcctgaagccccccgaggagagaaccatcgagtacctggaggaggtggccatcaccttcgccaagggcctggccgacaagaagatcagccccaagagagacaagggcctggtggagaagctgaccgcctacgccatgaccatccccttcgtgagacagcaggtgtacaagaaggtggaggagaaggtgagaaagcagaccaagggcctgtaccccgcccccctgaagatcatcgacgtggtgaagaccggcatcgagcagggcagcgacgccggctacctgtgcgagagccaggtgaacctgttccccttcaacgtgctgctgagcgtgaagggcaagctgaagatccagagcagcgtgtag

SEQ ID NO: 84910 - DNA, 1425 bp, Artificial Sequence
  Description of Artificial Sequence: Synthetic coding sequence
atgaccatcctgacctaccccttcaagaacctgcccaccgccagcaagtgggccctgagattcagcatcagacccctgagctgcagcagccagctgagagccgcccccgccgtgcagaccaagaccaagaagaccctggccaagcccaacatcagaaacgtggtggtggtggacggcgtgagaacccccttcctgctgagcggcaccagctacaaggacctgatgccccacgacctggccagagccgccctgaccggcctgctgcacagaaccagcgtgcccaaggaggtggtggactacatcatcttcggcaccgtgatccaggaggtgaagaccagcaacgtggccagagaggccgccctgggcgccggcttcagcgacaagacccccgcccacaccgtgaccatggcctgcatcagcgccaaccaggccatgaccaccggcgtgggcctgatcgccagcggccagtgcgacgtgatcgtggccggcggcgtggagctgatgagcgacgtgcccatcagacacagcagaaagatgagaaagctgatgctggacctgaacaaggccaagagcatgggccagagactgagcctgatcagcaagttcagattcaacttcctggcccccgagctgcccgccgtgagcgagttcagcaccagcgagaccatgggccacagcgccgacagactggccgccgccttcgccgtgagcagactggagcaggacgagtacgccctgagaagccacagcctggccaagaaggcccaggacgagggcctgctgagcgacgtggtgcccttcaaggtgcccggcaaggacaccgtgaccaaggacaacggcatcagacccagcagcctggagcagatggccaagctgaagcccgccttcatcaagccctacggcaccgtgaccgccgccaacagcagcttcctgaccgacggcgccagcgccatgctgatcatggccgaggagaaggccctggccatgggctacaagcccaaggcctacctgagagacttcatgtacgtgagccaggaccccaaggaccagctgctgctgggccccacctacgccacccccaaggtgctggagaaggccggcctgaccatgaacgacatcgacgccttcgagttccacgaggccttcagcggccagatcctggccaacttcaaggccatggacagcgactggttcgccgagaactacatgggcagaaagaccaaggtgggcctgccccccctggagaagttcaacaactggggcggcagcctgagcctgggccaccccttcggcgccaccggctgcagactggtgatggccgccgccaacagactgagaaaggagggcggccagtacggcctggtggccgcctgcgccgccggcggccagggccacgccatgatcgtggaggcctaccccaagtag

SEQ ID NO: 84911 - DNA, 258 bp, Artificial Sequence
  Description of Artificial Sequence: Synthetic coding sequence
atgaccatcctgacctaccccttcaagaacctgcccaccgccagcaagtgggccctgagattcagcatcagacccctgagctgcagcagccagctgagagccgcccccgccgtgcagaccaagaccaagaagaccctggccaagcccaacatcagaaacgtggtggtggtggacggcgtgagaacccccttcctgctgagcggcaccagctacaaggacctgatgccccacgacctggccagagccgccctgacctag

SEQ ID NO: 84912 - DNA, 531 bp, Artificial Sequence
  Description of Artificial Sequence: Synthetic coding sequence
atgaccatcctgacctaccccttcaagaacctgcccaccgccagcaagtgggccctgagattcagcatcagacccctgagctgcagcagccagctgagagccgcccccgccgtgcagaccaagaccaagaagaccctggccaagcccaacatcagaaacgtggtggtggtggacggcgtgagaacccccttcctgctgagcggcaccagctacaaggacctgatgccccacgacctggccagagccgccctgaccggcctgctgcacagaaccagcgtgcccaaggaggtggtggactacatcatcttcggcaccgtgatccaggaggtgaagaccagcaacgtggccagagaggccgccctgggcgccggcttcagcgacaagacccccgcccacaccgtgaccatggcctgcatcagcgccaaccaggccatgaccaccggcgtgggcctgatcgccagcggccagtgcgacgtgatcgtggccggcggcgtggagctgatgagcgacgtgcccatcagacacagctag

SEQ ID NO: 84913 - DNA, 453 bp, Artificial Sequence
  Description of Artificial Sequence: Synthetic coding sequence
atgaccatcctgacctaccccttcaagaacctgcccaccgccagcaagtgggccctgagattcagcatcagacccctgagctgcagcagccagctgagagccgcccccgccgtgcagaccaagaccaagaagaccctggccaagcccaacatcagaaacgtggtggtggtggacggcgtgagaacccccttcctgctgagcggcaccagctacaaggacctgatgccccacgacctggccagagccgccctgaccggcctgctgcacagaaccagcgtgcccaaggaggtggtggactacatcatcttcggcaccgtgatccaggaggtgaagaccagcaacgtggccagagaggccgccctgggcgccggcttcagcgacaagacccccgcccacaccgtgaccatggcctgcatcagcgccaaccaggccatgaccaccggcgtgggctag

SEQ ID NO: 84914 - DNA, 1380 bp, Artificial Sequence
  Description of Artificial Sequence: Synthetic coding sequence
atgaccatcctgacctaccccttcaagaacctgcccaccgccagcaagtgggccctgagattcagcatcagacccctgagctgcagcagccagctgagagccgcccccgccgtgcagaccaagaccaagaagaccctggccaagcccaacatcagaaacgtggtggtggtggacggcgtgagaacccccttcctgctgagcggcaccagcggcctgctgcacagaaccagcgtgcccaaggaggtggtggactacatcatcttcggcaccgtgatccaggaggtgaagaccagcaacgtggccagagaggccgccctgggcgccggcttcagcgacaagacccccgcccacaccgtgaccatggcctgcatcagcgccaaccaggccatgaccaccggcgtgggcctgatcgccagcggccagtgcgacgtgatcgtggccggcggcgtggagctgatgagcgacgtgcccatcagacacagcagaaagatgagaaagctgatgctggacctgaacaaggccaagagcatgggccagagactgagcctgatcagcaagttcagattcaacttcctggcccccgagctgcccgccgtgagcgagttcagcaccagcgagaccatgggccacagcgccgacagactggccgccgccttcgccgtgagcagactggagcaggacgagtacgccctgagaagccacagcctggccaagaaggcccaggacgagggcctgctgagcgacgtggtgcccttcaaggtgcccggcaaggacaccgtgaccaaggacaacggcatcagacccagcagcctggagcagatggccaagctgaagcccgccttcatcaagccctacggcaccgtgaccgccgccaacagcagcttcctgaccgacggcgccagcgccatgctgatcatggccgaggagaaggccctggccatgggctacaagcccaaggcctacctgagagacttcatgtacgtgagccaggaccccaaggaccagctgctgctgggccccacctacgccacccccaaggtgctggagaaggccggcctgaccatgaacgacatcgacgccttcgagttccacgaggccttcagcggccagatcctggccaacttcaaggccatggacagcgactggttcgccgagaactacatgggcagaaagaccaaggtgggcctgccccccctggagaagttcaacaactggggcggcagcctgagcctgggccaccccttcggcgccaccggctgcagactggtgatggccgccgccaacagactgagaaaggagggcggccagtacggcctggtggccgcctgcgccgccggcggccagggccacgccatgatcgtggaggcctaccccaagtag

SEQ ID NO: 84915 - DNA, 1359 bp, Artificial Sequence
  Description of Artificial Sequence: Synthetic coding sequence
atgaccctggtgagcggctggctgctgtacggctggatcatcgccgtgcagaccaagaccaagaagaccctggccaagcccaacatcagaaacgtggtggtggtggacggcgtgagaacccccttcctgctgagcggcaccagctacaaggacctgatgccccacgacctggccagagccgccctgaccggcctgctgcacagaaccagcgtgcccaaggaggtggtggactacatcatcttcggcaccgtgatccaggaggtgaagaccagcaacgtggccagagaggccgccctgggcgccggcttcagcgacaagacccccgcccacaccgtgaccatggcctgcatcagcgccaaccaggccatgaccaccggcgtgggcctgatcgccagcggccagtgcgacgtgatcgtggccggcggcgtggagctgatgagcgacgtgcccatcagacacagcagaaagatgagaaagctgatgctggacctgaacaaggccaagagcatgggccagagactgagcctgatcagcaagttcagattcaacttcctggcccccgagctgcccgccgtgagcgagttcagcaccagcgagaccatgggccacagcgccgacagactggccgccgccttcgccgtgagcagactggagcaggacgagtacgccctgagaagccacagcctggccaagaaggcccaggacgagggcctgctgagcgacgtggtgcccttcaaggtgcccggcaaggacaccgtgaccaaggacaacggcatcagacccagcagcctggagcagatggccaagctgaagcccgccttcatcaagccctacggcaccgtgaccgccgccaacagcagcttcctgaccgacggcgccagcgccatgctgatcatggccgaggagaaggccctggccatgggctacaagcccaaggcctacctgagagacttcatgtacgtgagccaggaccccaaggaccagctgctgctgggccccacctacgccacccccaaggtgctggagaaggccggcctgaccatgaacgacatcgacgccttcgagttccacgaggccttcagcggccagatcctggccaacttcaaggccatggacagcgactggttcgccgagaactacatgggcagaaagaccaaggtgggcctgccccccctggagaagttcaacaactggggcggcagcctgagcctgggccaccccttcggcgccaccggctgcagactggtgatggccgccgccaacagactgagaaaggagggcggccagtacggcctggtggccgcctgcgccgccggcggccagggccacgccatgatcgtggaggcctaccccaagtag

SEQ ID NO: 84916 - DNA, 783 bp, Artificial Sequence
  Description of Artificial Sequence: Synthetic coding sequence
atgaaggtggaggtgctgcccgccctgaccgacaactacatgtacctggtgatcgacgacgagaccaaggaggccgccatcgtggaccccgtgcagccccagaaggtggtggacgccgccagaaagcacggcgtgaagctgaccaccgtgctgaccacccaccaccactgggaccacgccggcggcaacgagaagctggtgaagctggagagcggcctgaaggtgtacggcggcgacgacagaatcggcgccctgacccacaagatcacccacctgagcaccctgcaggtgggcagcctgaacgtgaagtgcctggccaccccctgccacaccagcggccacatctgctacttcgtgagcaagcccggcggcagcgagccccccgccgtgttcaccggcgacaccctgttcgtggccggctgcggcaagttctacgagggcaccgccgacgagatgtgcaaggccctgctggaggtgctgggcagactgccccccgacaccagagtgtactgcggccacgagtacaccatcaacaacctgaagttcgccagacacgtggagcccggcaacgccgccatcagagagaagctggcctgggccaaggagaagtacagcatcggcgagcccaccgtgcccagcaccctggccgaggagttcacctacaaccccttcatgagagtgagagagaagaccgtgcagcagcacgccggcgagaccgaccccgtgaccaccatgagagccgtgagaagagagaaggaccagttcaagatgcccagagactag

SEQ ID NO: 84917 - DNA, 927 bp, Artificial Sequence
  Description of Artificial Sequence: Synthetic coding sequence
atggtggtgggcagaggcctgctgggcagaagaagcctggccgccctgggcgccgcctgcgccagaagaggcctgggccccgccctgctgggcgtgttctgccacaccgacctgagaaagaacctgaccgtggacgagggcaccatgaaggtggaggtgctgcccgccctgaccgacaactacatgtacctggtgatcgacgacgagaccaaggaggccgccatcgtggaccccgtgcagccccagaaggtggtggacgccgccagaaagcacggcgtgaagctgaccaccgtgctgaccacccaccaccactgggaccacgccggcggcaacgagaagctggtgaagctggagagcggcctgaaggtgtacggcggcgacgacagaatcggcgccctgacccacaagatcacccacctgagcaccctgcaggtgggcagcctgaacgtgaagtgcctggccaccccctgccacaccagcggccacatctgctacttcgtgagcaagcccggcggcagcgagccccccgccgtgttcaccggcgacaccctgttcgtggccggctgcggcaagttctacgagggcaccgccgacgagatgtgcaaggccctgctggaggtgctgggcagactgccccccgacaccagagtgtactgcggccacgagtacaccatcaacaacctgaagttcgccagacacgtggagcccggcaacgccgccatcagagagaagctggcctgggccaaggagaagtacagcatcggcgagcccaccgtgcccagcaccctggccgaggagttcacctacaaccccttcatgagagtgagagagaagaccgtgcagcagcacgccggcgagaccgaccccgtgaccaccatgagagccgtgagaagagagaaggaccagttcaagatgcccagagactag

SEQ ID NO: 84918 - DNA, 711 bp, Artificial Sequence
  Description of Artificial Sequence: Synthetic coding sequence
atggtggtgggcagaggcctgctgggcagaagaagcctggccgccctgggcgccgcctgcgccagaagaggcctgggccccgccctgctgggcgtgttctgccacaccgacctgagaaagaacctgaccgtggacgagggcaccatgaaggtggaggtgctgcccgccctgaccgacaactacatgtacctggtgatcgacgacgagaccaaggaggccgccatcgtggaccccgtgcagccccagaaggtggtggacgccgccagaaagcacggcgtgaagctgaccaccgtgctgaccacccaccaccactgggaccacgccggcggcaacgagaagctggtgaagctggagagcggcctgaaggtgtacggcggcgacgacagaatcggcgccctgacccacaagatcacccacctgagcaccctgcaggtgaccccctgcctgtggctggccgccggcagcagcatgaagggcctgagaatgagatgcgtgaagctgtgctggagaagctgggccggcagccccagaacccaggagagcaccgtggccaccagcacccccagcaccaccagcagcctgcacgccacctggagccccgccatgccccccagcggcagaagctggcccggccccagaagaagcaccgccagcggcagcccccagtgccaccccccctggcagagaagcctgcccaccacccccagctag

SEQ ID NO: 84919 - DNA, 1128 bp, Artificial Sequence
  Description of Artificial Sequence: Synthetic coding sequence
atggccatgaccggctggagctgcctggtgaccggcgccggcggcttcctgggccagagaatcatcagactgctggtgaaggagaaggagctgaaggagatcagagtgctggacaaggccttcggccccgagctgagagaggagttcagcaagctgcagaacaagaccaagctgaccgtgctggagggcgacatcctggacgagcccttcctgaagagagcctgccaggacgtgagcgtgatcatccacaccgcctgcatcatcgacgtgttcggcgtgacccacagagagagcatcatgaacgtgaacgtgaagggcacccagctgctgctggaggcctgcgtgcaggccagcgtgcccgtgttcatctacaccagcagcatcgaggtggccggccccaacagctacaaggagatcatccagaacggccacgaggaggagcccctggagaacacctggcccgccccctacccccacagcaagaagctggccgagaaggccgtgctggccgccaacggctggaacctgaagaacggcggcaccctgtacacctgcgccctgagacccatgtacatctacggcgagggcagcagattcctgagcgccagcatcaacgaggccctgaacaacaacggcatcctgagcagcgtgggcaagttcagcaccgtgaaccccgtgtacgtgggcaacgtggcctgggcccacatcctggccctgagagccctgcaggaccccaagaaggcccccagcatcagaggccagttctactacatcagcgacgacaccccccaccagagctacgacaacctgaactacaccctgagcaaggagttcggcctgagactggacagcagatggagcttccccctgagcctgatgtactggatcggcttcctgctggagatcgtgagcttcctgctgagacccatctacacctacagaccccccttcaacagacacatcgtgaccctgagcaacagcgtgttcaccttcagctacaagaaggcccagagagacctggcctacaagcccctgtacagctgggaggaggccaagcagaagaccgtggagtgggtgggcagcctggtggacagacacaaggagaccctgaagagcaagacccagtag

SEQ ID NO: 84920 - DNA, 1122 bp, Artificial Sequence
  Description of Artificial Sequence: Synthetic coding sequence
atgaccggctggagctgcctggtgaccggcgccggcggcttcctgggccagagaatcatcagactgctggtgaaggagaaggagctgaaggagatcagagtgctggacaaggccttcggccccgagctgagagaggagttcagcaagctgcagaacaagaccaagctgaccgtgctggagggcgacatcctggacgagcccttcctgaagagagcctgccaggacgtgagcgtgatcatccacaccgcctgcatcatcgacgtgttcggcgtgacccacagagagagcatcatgaacgtgaacgtgaagggcacccagctgctgctggaggcctgcgtgcaggccagcgtgcccgtgttcatctacaccagcagcatcgaggtggccggccccaacagctacaaggagatcatccagaacggccacgaggaggagcccctggagaacacctggcccgccccctacccccacagcaagaagctggccgagaaggccgtgctggccgccaacggctggaacctgaagaacggcggcaccctgtacacctgcgccctgagacccatgtacatctacggcgagggcagcagattcctgagcgccagcatcaacgaggccctgaacaacaacggcatcctgagcagcgtgggcaagttcagcaccgtgaaccccgtgtacgtgggcaacgtggcctgggcccacatcctggccctgagagccctgcaggaccccaagaaggcccccagcatcagaggccagttctactacatcagcgacgacaccccccaccagagctacgacaacctgaactacaccctgagcaaggagttcggcctgagactggacagcagatggagcttccccctgagcctgatgtactggatcggcttcctgctggagatcgtgagcttcctgctgagacccatctacacctacagaccccccttcaacagacacatcgtgaccctgagcaacagcgtgttcaccttcagctacaagaaggcccagagagacctggcctacaagcccctgtacagctgggaggaggccaagcagaagaccgtggagtgggtgggcagcctggtggacagacacaaggagaccctgaagagcaagacccagtag

SEQ ID NO: 84921 - DNA, 1122 bp, Artificial Sequence; identical to SEQ ID NO: 84920
  Description of Artificial Sequence: Synthetic coding sequence

SEQ ID NO: 84922 - DNA, 249 bp, Artificial Sequence
  Description of Artificial Sequence: Synthetic coding sequence
atgaccggctggagctgcctggtgaccggcgccggcggcttcctgggccagagaatcatcagactgctggtgaaggagaaggagctgaaggagatcagagtgctggacaaggccttcggccccgagctgagagaggagttcagcaagctgcagaacaagaccaagctgaccgtgctggagggcgacatcctggacgagcccttcctgaagagagcctgccaggacgtgagcgtgatcatccacacctag

SEQ ID NO: 84923 - DNA, 1119 bp, Artificial Sequence
  Description of Artificial Sequence: Synthetic coding sequence
atgggctggagctgcctggtgaccggcgccggcggcctgctgggccagagaatcgtgagactgctggtggaggagaaggagctgaaggagatcagagccctggacaaggccttcagacccgagctgagagaggagttcagcaagctgcagaacagaaccaagctgaccgtgctggagggcgacatcctggacgagcccttcctgaagagagcctgccaggacgtgagcgtggtgatccacaccgcctgcatcatcgacgtgttcggcgtgacccacagagagagcatcatgaacgtgaacgtgaagggcacccagctgctgctggaggcctgcgtgcaggccagcgtgcccgtgttcatctacaccagcagcatcgaggtggccggccccaacagctacaaggagatcatccagaacggccacgaggaggagcccctggagaacacctggcccaccccctacccctacagcaagaagctggccgagaaggccgtgctggccgccaacggctggaacctgaagaacggcgacaccctgtacacctgcgccctgagacccacctacatctacggcgagggcggccccttcctgagcgccagcatcaacgaggccctgaacaacaacggcatcctgagcagcgtgggcaagttcagcaccgtgaaccccgtgtacgtgggcaacgtggcctgggcccacatcctggccctgagagccctgagagaccccaagaaggcccccagcgtgagaggccagttctactacatcagcgacgacaccccccaccagagctacgacaacctgaactacatcctgagcaaggagttcggcctgagactggacagcagatggagcctgcccctgaccctgatgtactggatcggcttcctgctggaggtggtgagcttcctgctgagccccatctacagctaccagccccccttcaacagacacaccgtgaccctgagcaacagcgtgttcaccttcagctacaagaaggcccagagagacctggcctacaagcccctgtacagctgggaggaggccaagcagaagaccgtggagtgggtgggcagcctggtggacagacacaaggagaccctgaagagcaagacccagtag

SEQ ID NO: 84924 - DNA, 588 bp, Artificial Sequence
  Description of Artificial Sequence: Synthetic coding sequence
atgggctggagctgcctggtgaccggcgccggcggcctgctgggccagagaatcgtgagactgctggtggaggagaaggagctgaaggagatcagagccctggacaaggccttcagacccgagctgagagaggagttcagcaagctgcagaacagaaccaagctgaccgtgctggagggcgacatcctggacgagcccttcctgaagagagcctgccaggacgtgagcgtggtgatccacaccgcctgcatcatcgacgtgttcggcgtgacccacagagagagcatcatgaacgtgaacgtgaagggcacccagctgctgctggaggcctgcgtgcaggccagcgtgcccgtgttcatctacaccagcagcatcgaggtggccggccccaacagctacaaggagatcatccagaacggccacgaggaggagcccctggagaacacctggcccaccccctacccctacagcaagaagctggccgagaaggccgtgctggccgccaacggctggaacctgaagaacggcgacaccctgtacacctgcgccctgagacccacctacatctacggcgagggcggcccctag

SEQ ID NO: 84925 - DNA, 1119 bp, Artificial Sequence; identical to SEQ ID NO: 84923
  Description of Artificial Sequence: Synthetic coding sequence

SEQ ID NO: 84926 - DNA, 591 bp, Artificial Sequence
  Description of Artificial Sequence: Synthetic coding sequence
atggccgacagcgcccaggcccagaagctggtgtacctggtgaccggcggctgcggcttcctgggcgagcacgtggtgagaatgctgctgcagagagagcccagactgggcgagctgagagtgttcgaccagcacctgggcccctggctggaggagctgaagaccggccccgtgagagtgaccgccatccagggcgacgtgacccaggcccacgaggtggccgccgccgtggccggcgcccacgtggtgatccacaccgccggcctggtggacgtgttcggcagagccagccccaagaccatccacgaggtgaacgtgcagggcaccagaaacgtgatcgaggcctgcgtgcagaccggcaccagattcctggtgtacaccagcagcatggaggtggtgggccccaacaccaagggccaccccttctacagaggcaacgaggacaccccctacgaggccgtgcacagacacccctacccctgcagcaaggccctggccgagtggctggtgctggaggccaacggcagaaaggccatgctgcccggctgcacctgctggcagcccggcagctggagcagcggccagccctag

SEQ ID NO: 84927 - DNA, 1110 bp, Artificial Sequence
  Description of Artificial Sequence: Synthetic coding sequence
atggccgacagcgcccaggcccagaagctggtgtacctggtgaccggcggctgcggcttcctgggcgagcacgtggtgagaatgctgctgcagagagagcccagactgggcgagctgagagtgttcgaccagcacctgggcccctggctggaggagctgaagaccggccccgtgagagtgaccgccatccagggcgacgtgacccaggcccacgaggtggccgccgccgtggccggcgcccacgtggtgatccacaccgccggcctggtggacgtgttcggcagagccagccccaagaccatccacgaggtgaacgtgcagggcaccagaaacgtgatcgaggcctgcgtgcagaccggcaccagattcctggtgtacaccagcagcatggaggtggtgggccccaacaccaagggccaccccttctacagaggcaacgaggacaccccctacgaggccgtgcacagacacccctacccctgcagcaaggccctggccgagtggctggtgctggaggccaacggcagaaaggtgagaggcggcctgcccctggtgacctgcgccctgagacccaccggcatctacggcgagggccaccagatcatgagagacttctacagacagggcctgagactgggcggctggctgttcagagccatccccgccagcgtggagcacggcagagtgtacgtgggcaacgtggcctggatgcacgtgctggccgccagagagctggagcagagagccaccctgatgggcggccaggtgtacttctgctacgacggcagcccctacagaagctacgaggacttcaacatggagttcctgggcccctgcggcctgagactggtgggcgccagacccctgctgccctactggctgctggtgttcctggccgccctgaacgccctgctgcagtggctgctgagacccctggtgctgtacgcccccctgctgaacccctacaccctggccgtggccaacaccaccttcaccgtgagcaccgacaaggcccagagacacttcggctacgagcccctgttcagctgggaggacagcagaaccagaaccatcctgtgggtgcaggccgccaccggcagcgcccagtag

SEQ ID NO: 84928 - DNA, 591 bp, Artificial Sequence; identical to SEQ ID NO: 84926
  Description of Artificial Sequence: Synthetic coding sequence

SEQ ID NO: 84929 - DNA, 1086 bp, Artificial Sequence
  Description of Artificial Sequence: Synthetic coding sequence
atgagcggcaacggcaacgccgccgccaccgccgaggagaacagccccaagatgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccagggcgccctgggcgtggaggtgagagccaaggaccaggacatcctggacctggtgggcgtgctgcacgaccccgagaccctgctgagatgcatcgccgagagagccttcctgagacacctggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 84930 - DNA, 1035 bp, Artificial Sequence
  Description of Artificial Sequence: Synthetic coding sequence
atgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccagggcgccctgggcgtggaggtgagagccaaggaccaggacatcctggacctggtgggcgtgctgcacgaccccgagaccctgctgagatgcatcgccgagagagccttcctgagacacctggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 84931 - DNA, 1035 bp, Artificial Sequence; identical to SEQ ID NO: 84930
  Description of Artificial Sequence: Synthetic coding sequence

SEQ ID NO: 84932 - DNA, 564 bp, Artificial Sequence
  Description of Artificial Sequence: Synthetic coding sequence
atgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagtag

SEQ ID NO: 84933 - DNA, 1035 bp, Artificial Sequence; identical to SEQ ID NO: 84930
  Description of Artificial Sequence: Synthetic coding sequence

SEQ ID NO: 84934 - DNA, 564 bp, Artificial Sequence; identical to SEQ ID NO: 84932
  Description of Artificial Sequence: Synthetic coding sequence

SEQ ID NO: 84935 - DNA, 915 bp, Artificial Sequence
  Description of Artificial Sequence: Synthetic coding sequence
atgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccaggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 84936 - DNA, 966 bp, Artificial Sequence
  Description of Artificial Sequence: Synthetic coding sequence
atgagcggcaacggcaacgccgccgccaccgccgaggagaacagccccaagatgagagtgatcagagtgggcaccagaaagagccagctggccagaatccagaccgacagcgtggtggccaccctgaaggccagctaccccggcctgcagttcgagatcatcgccatgagcaccaccggcgacaagatcctggacaccgccctgagcaagatcggcgagaagagcctgttcaccaaggagctggagcacgccctggagaagaacgaggtggacctggtggtgcacagcctgaaggacctgcccaccgtgctgccccccggcttcaccatcggcgccatctgcaagagagagaacccccacgacgccgtggtgttccaccccaagttcgtgggcaagaccctggagaccctgcccgagaagagcgtggtgggcaccagcagcctgagaagagccgcccagctgcagagaaagttcccccacctggagttcagaagcatcagaggcaacctgaacaccagactgagaaagctggacgagcagcaggagttcagcgccatcatcctggccaccgccggcctgcagagaatgggctggcacaacagagtgggccagatcctgcaccccgaggagtgcatgtacgccgtgggccaggagggcggctgcagcgtgcccgtggccgtgcacaccgccatgaaggacggccagctgtacctgaccggcggcgtgtggagcctggacggcagcgacagcatccaggagaccatgcaggccaccatccacgtgcccgcccagcacgaggacggccccgaggacgacccccagctggtgggcatcaccgccagaaacatccccagaggcccccagctggccgcccagaacctgggcatcagcctggccaacctgctgctgagcaagggcgccaagaacatcctggacgtggccagacagctgaacgacgcccactag

SEQ ID NO: 84937 - DNA, 879 bp, Artificial Sequence
  Description of Artificial Sequence: Synthetic coding sequence
atggccttcatgaagaagtacctgctgcccatcctgggcctgttcatggcctactactactacagcgccaacgaggagttcagacccgagatgctgcagggcaagaaggtgatcgtgaccggcgccagcaagggcatcggcagagagatggcctaccacctggccaagatgggcgcccacgtggtggtgaccgccagaagcaaggagaccctgcagaaggtggtgagccactgcctggagctgggcgccgccagcgcccactacatcgccggcaccatggaggacatgaccttcgccgagcagttcgtggcccaggccggcaagctgatgggcggcctggacatgctgatcctgaaccacatcaccaacaccagcctgaacctgttccacgacgacatccaccacgtgagaaagagcatggaggtgaacttcctgagctacgtggtgctgaccgtggccgccctgcccatgctgaagcagagcaacggcagcatcgtggtggtgagcagcctggccggcaaggtggcctaccccatggtggccgcctacagcgccagcaagttcgccctggacggcttcttcagcagcatcagaaaggagtacagcgtgagcagagtgaacgtgagcatcaccctgtgcgtgctgggcctgatcgacaccgagaccgccatgaaggccgtgagcggcatcgtgcacatgcaggccgcccccaaggaggagtgcgccctggagatcatcaagggcggcgccctgagacaggaggaggtgtactacgacagcagcctgtggaccaccctgctgatcagaaacccctgcagaaagatcctggagttcctgtacagcaccagctacaacatggacagattcatcaacaagtag

SEQ ID NO: 84938 - DNA, 879 bp, Artificial Sequence; identical to SEQ ID NO: 84937
  Description of Artificial Sequence: Synthetic coding sequence

SEQ ID NO: 84939 - DNA, 879 bp, Artificial Sequence; identical to SEQ ID NO: 84937
  Description of Artificial Sequence: Synthetic coding sequence

SEQ ID NO: 84940 - DNA, 1218 bp, Artificial Sequence
  Description of Artificial Sequence: Synthetic coding sequence
atggagagatggccctggcccagcggcggcgcctggctgctggtggccgccagagccctgctgcagctgctgagaagcgacctgagactgggcagacccctgctggccgccctggccctgctggccgccctggactggctgtgccagagactgctgcccccccccgccgccctggccgtgctggccgccgccggctggatcgccctgagcagactggccagaccccagagactgcccgtggccaccagagccgtgctgatcaccggctgcgacagcggcttcggcaaggagaccgccaagaagctggacagcatgggcttcaccgtgctggccaccgtgctggagctgaacagccccggcgccatcgagctgagaacctgctgcagccccagactgagactgctgcagatggacctgaccaagcccggcgacatcagcagagtgctggagttcaccaaggcccacaccaccagcaccggcctgtggggcctggtgaacaacgccggccacaacgaggtggtggccgacgccgagctgagccccgtggccaccttcagaagctgcatggaggtgaacttcttcggcgccctggagctgaccaagggcctgctgcccctgctgagaagcagcagaggcagaatcgtgaccgtgggcagccccgccggcgacatgccctacccctgcctgggcgcctacggcaccagcaaggccgccgtggccctgctgatggacaccttcagctgcgagctgctgccctggggcgtgaaggtgagcatcatccagcccggctgcttcaagaccgagagcgtgagaaacgtgggccagtgggagaagagaaagcagctgctgctggccaacctgccccaggagctgctgcaggcctacggcaaggactacatcgagcacctgcacggccagttcctgcacagcctgagactggccatgagcgacctgacccccgtggtggacgccatcaccgacgccctgctggccgccagacccagaagaagatactaccccggccagggcctgggcctgatgtacttcatccactactacctgcccgagggcctgagaagaagattcctgcaggccttcttcatcagccactgcctgcccagagccctgcagcccggccagcccggcaccacccccccccaggacgccgcccaggaccccaacctgagccccggccccagccccgccgtggccagatag

SEQ ID NO: 84941 - DNA, 2232 bp, Artificial Sequence
  Description of Artificial Sequence: Synthetic coding sequence
atggaggccgtggccgtggccgccgccgtgggcgtgctgctgctggccggcgccggcggcgccgccggcgacgaggccagagaggccgccgccgtgagagccctggtggccagactgctgggccccggccccgccgccgacttcagcgtgagcgtggagagagccctggccgccaagcccggcctggacacctacagcctgggcggcggcggcgccgccagagtgagagtgagaggcagcaccggcgtggccgccgccgccggcctgcacagatacctgagagacttctgcggctgccacgtggcctggagcggcagccagctgagactgcccagacccctgcccgccgtgcccggcgagctgaccgaggccacccccaacagatacagatactaccagaacgtgtgcacccagagctacagcttcgtgtggtgggactgggccagatgggagagagagatcgactggatggccctgaacggcatcaacctggccctggcctggagcggccaggaggccatctggcagagagtgtacctggccctgggcctgacccaggccgagatcaacgagttcttcaccggccccgccttcctggcctggggcagaatgggcaacctgcacacctgggacggccccctgccccccagctggcacatcaagcagctgtacctgcagcacagagtgctggaccagatgagaagcttcggcatgacccccgtgctgcccgccttcgccggccacgtgcccgaggccgtgaccagagtgttcccccaggtgaacgtgaccaagatgggcagctggggccacttcaactgcagctacagctgcagcttcctgctggcccccgaggaccccatcttccccatcatcggcagcctgttcctgagagagctgatcaaggagttcggcaccgaccacatctacggcgccgacaccttcaacgagatgcagccccccagcagcgagcccagctacctggccgccgccaccaccgccgtgtacgaggccatgaccgccgtggacaccgaggccgtgtggctgctgcagggctggctgttccagcaccagccccagttctggggccccgcccagatcagagccgtgctgggcgccgtgcccagaggcagactgctggtgctggacctgttcgccgagagccagcccgtgtacaccagaaccgccagcttccagggccagcccttcatctggtgcatgctgcacaacttcggcggcaaccacggcctgttcggcgccctggaggccgtgaacggcggccccgaggccgccagactgttccccaacagcaccatggtgggcaccggcatggcccccgagggcatcagccagaacgaggtggtgtacagcctgatggccgagctgggctggagaaaggaccccgtgcccgacctggccgcctgggtgaccagcttcgccgccagaagatacggcgtgagccaccccgacgccggcgccgcctggagactgctgctgagaagcgtgtacaactgcagcggcgaggcctgcagaggccacaacagaagccccctggtgagaagacccagcctgcagatgaacaccagcatctggtacaacagaagcgacgtgttcgaggcctggagactgctgctgaccagcgcccccagcctggccaccagccccgccttcagatacgacctgctggacctgaccagacaggccgtgcaggagctggtgagcctgtactacgaggaggccagaagcgcctacctgagcaaggagctggccagcctgctgagagccggcggcgtgctggcctacgagctgctgcccgccctggacgaggtgctggccagcgacagcagattcctgctgggcagctggctggagcaggccagagccgccgccgtgagcgaggccgaggccgacttctacgagcagaacagcagataccagctgaccctgtggggccccgagggcaacatcctggactacgccaacaagcagctggccggcctggtggccaactactacacccccagatggagactgttcctggaggccctggtggacagcgtggcccagggcatccccttccagcagcaccagttcgacaagaacgtgttccagctggagcaggccttcgtgctgagcaagcagagataccccagccagcccagaggcgacaccgtggacctggccaagaagatcttcctgaagtactaccccagatgggtggccggcagctggtag

SEQ ID NO: 84942 - DNA, 450 bp, Artificial Sequence
  Description of Artificial Sequence: Synthetic coding sequence
atggccagaaccgtggtgctgatcaccggctgcagcagcggcatcggcctgcacctggccgtgagactggccagcgaccccagccagagcttcaaggtgtacgccaccctgagagacctgaagacccagggcagactgtgggaggccgccagagccctggcctgcccccccggcagcctggagaccctgcagctggacgtgagagacagcaagagcgtggccgccgccagagagagagtgaccgagggcagagtggacgtgctggtgtgcaacgccggcctgggcctgctgggccccctggaggccctgggcgaggacgccgtggccagcgtgctggacgtgaacgtggtgggcaccgtgagaatgctgcaggccttcctgcccgacatgaagagaagaggcagcggcagagtgctggtgaccggcagcgtgggcggcctgatggcctag

SEQ ID NO: 84943 - DNA, 987 bp, Artificial Sequence
  Description of Artificial Sequence: Synthetic coding sequence
atggccagaaccgtggtgctgatcaccggctgcagcagcggcatcggcctgcacctggccgtgagactggccagcgaccccagccagagcttcaaggtgtacgccaccctgagagacctgaagacccagggcagactgtgggaggccgccagagccctggcctgcccccccggcagcctggagaccctgcagctggacgtgagagacagcaagagcgtggccgccgccagagagagagtgaccgagggcagagtggacgtgctggtgtgcaacgccggcctgggcctgctgggccccctggaggccctgggcgaggacgccgtggccagcgtgctggacgtgaacgtggtgggcaccgtgagaatgctgcaggccttcctgcccgacatgaagagaagaggcagcggcagagtgctggtgaccggcagcgtgggcggcctgatgggcctgcccttcaacgacgtgtactgcgccagcaagttcgccctggagggcctgtgcgagagcctggccgtgctgctgctgcccttcggcgtgcacctgagcctgatcgagtgcggccccgtgcacaccgccttcatggagaaggtgctgggcagccccgaggaggtgctggacagaaccgacatccacaccttccacagattctaccagtacctggcccacagcaagcaggtgttcagagaggccgcccagaaccccgaggaggtggccgaggtgttcctgaccgccctgagagcccccaagcccaccctgagatacttcaccaccgagagattcctgcccctgctgagaatgagactggacgaccccagcggcagcaactacgtgaccgccatgcacagagaggtgttcggcgacgtgcccgccaaggccgaggccggcgccgaggccggcggcggcgccggccccggcgccgaggacgaggccggcagaggcgccgtgggcgaccccgagctgggcgacccccccgccgccccccagtag

SEQ ID NO: 84944 - DNA, 447 bp, Artificial Sequence
  Description of Artificial Sequence: Synthetic coding sequence
atggcctgcaccgtggtgctgatcaccggctgcagcagcggcatcggcctgcacctggccatccacctggccctggaccccagccagagcttcaaggtgtacgccaccctgagagacctgaagacccagggcagactgtgggaggccgccagagccctggcctgcccccagggcagcctggagagactgcagctggacgtgagaaacagcagcagcctggccgccgccagagagagagtgaccgagggcagagtggacgtgctggtgtgcgacaccggcctgggcctgctgggccccctgggcgaggacgccgtggccagcgtgctggacgtgaacgtggtgggcaccgtgagagtgctgcaggacttcctgcccgacatgaagagacccggcagcggcagagtgctggtgaccggcagcatgggcggcctgatgggcgagtggtag

SEQ ID NO: 84945 - DNA, 786 bp, Artificial Sequence
  Description of Artificial Sequence: Synthetic coding sequence
atggccgccgcctgcagaagcgtgaagggcctggtggccgtgatcaccggcggcgccagcggcctgggcctggccaccgccgagagactggtgggccagggcgccagcgccgtgctgctggacctgcccaacagcggcggcgaggcccaggccaagaagctgggcaacaactgcgtgttcgcccccgccgacgtgaccagcgagaaggacgtgcagaccgccctggccctggccaagggcaagttcggcagagtggacgtggccgtgaactgcgccggcatcgccgtggccagcaagacctacaacctgaagaagggccagacccacaccctggaggacttccagagagtgctggacgtgaacctgatgggcaccttcaacgtgatcagactggtggccggcgagatgggccagaacgagcccgaccagggcggccagagaggcgtgatcatcaacaccgccagcgtggccgccttcgagggccaggtgggccaggccgcctacagcgccagcaagggcggcatcgtgggcatgaccctgcccatcgccagagacctggcccccatcggcatcagagtgatgaccatcgcccccggcctgttcggcacccccctgctgaccagcctgcccgagaaggtgtgcaacttcctggccagccaggtgcccttccccagcagactgggcgaccccgccgagtacgcccacctggtgcaggccatcatcgagaaccccttcctgaacggcgaggtgatcagactggacggcgccatcagaatgcagccctag

SEQ ID NO: 84946 - DNA, 510 bp, Artificial Sequence
  Description of Artificial Sequence: Synthetic coding sequence
atggccgccgcctgcagaagcgtgaagggcctggtggccgtgatcaccggcggcgccagcggcctgggcctggccaccgccgagagactggtgggccagggcgccagcgccgtgctgctggacctgcccaacagcggcggcgaggcccaggccaagaagctgggcaacaactgcgtgttcgcccccgccgacgtgaccagcgagaaggacgtgcagaccgccctggccctggccaagggcaagttcggcagagtggacgtggccgtgaactgcgccggcatcgccgtggccagcaagacctacaacctgaagaagggccagacccacaccctggaggacttccagagagtgctggacgtgaacctgatgggcaccttcaacgtgatcagactggtggccggcgagatgggccagaacgagcccgaccagggcggccagagaggcgtgatcatcaacaccgccagcgtggccgccttcgagggccaggtgtgcctggccccccactgctag

SEQ ID NO: 84947 - DNA, 759 bp, Artificial Sequence
  Description of Artificial Sequence: Synthetic coding sequence
atggccgccgcctgcagaagcgtgaagggcctggtggccgtgatcaccggcggcgccagcggcctgggcctggccaccgccgagagactggtgggccagggcgccagcgccgtgctgctggacctgcccaacagcggcggcgaggcccaggccaagaagctgggcaacaactgcgtgttcgcccccgccgacgtgaccagcgagaaggacgtgcagaccgccctggccctggccaagggcaagttcggcagagtggacgtggccgtgaactgcgccggcatcgccgtggccagcaagacctacaacctgaagaagggccagacccacaccctggaggacttccagagagtgctggacgtgaacctgatgggcaccttcaacgtgatcagactggtggccggcgagatgggccagaacgagcccgaccagggcggccagagaggcgtgatcatcaacaccgccagcgtggccgccttcgagggccaggtgggccaggccgcctacagcgccagcaagggcggcatcgtgggcatgaccctgcccatcgccagagacctggcccccatcggcctgttcggcacccccctgctgaccagcctgcccgagaaggtgtgcaacttcctggccagccaggtgcccttccccagcagactgggcgaccccgccgagtacgcccacctggtgcaggccatcatcgagaaccccttcctgaacggcgaggtgatcagactggacggcgccatcagaatgcagccctag

SEQ ID NO: 84948 - DNA, 903 bp, Artificial Sequence
  Description of Artificial Sequence: Synthetic coding sequence
atgaagttcctgctggacatcctgctgctgctgcccctgctgatcgtgtgcagcctggagagcttcgtgaagctgttcatccccaagagaagaaagagcgtgaccggcgagatcgtgctgatcaccggcgccggccacggcatcggcagactgaccgcctacgagttcgccaagctgaagagcaagctggtgctgtgggacatcaacaagcacggcctggaggagaccgccgccaagtgcaagggcctgggcgccaaggtgcacaccttcgtggtggactgcagcaacagagaggacatctacagcagcgccaagaaggtgaaggccgagatcggcgacgtgagcatcctggtgaacaacgccggcgtggtgtacaccagcgacctgttcgccacccaggacccccagatcgagaagaccttcgaggtgaacgtgctggcccacttctggaccaccaaggccttcctgcccgccatgaccaagaacaaccacggccacatcgtgaccgtggccagcgccgccggccacgtgagcgtgcccttcctgctggcctactgcagcagcaagttcgccgccgtgggcttccacaagaccctgaccgacgagctggccgccctgcagatcaccggcgtgaagaccacctgcctgtgccccaacttcgtgaacaccggcttcatcaagaaccccagcaccagcctgggccccaccctggagcccgaggaggtggtgaacagactgatgcacggcatcctgaccgagcagaagatgatcttcatccccagcagcatcgccttcctgaccaccctggagagaatcctgcccgagagattcctggccgtgctgaagcagaagatcagcgtgaagttcgacgccgtgatcggctacaagatgaaggcccagtag

SEQ ID NO: 84949 - DNA, 795 bp, Artificial Sequence
  Description of Artificial Sequence: Synthetic coding sequence
atgaacatcatcctggagatcctgctgctgctgatcaccatcatctacagctacctggagagcctggtgaagttcttcatcccccagagaagaaagagcgtggccggcgagatcgtgctgatcaccggcgccggccacggcatcggcagacagaccacctacgagttcgccaagagacagagcatcctggtgctgtgggacatcaacaaggtgaagaaggaggtgggcgacgtgaccatcgtggtgaacaacgccggcaccgtgtaccccgccgacctgctgagcaccaaggacgaggagatcaccaagaccttcgaggtgaacatcctgggccacttctggatcaccaaggccctgctgcccagcatgatggagagaaaccacggccacatcgtgaccgtggccagcgtgtgcggccacgagggcatcccctacctgatcccctactgcagcagcaagttcgccgccgtgggcttccacagaggcctgaccagcgagctgcaggccctgggcaagaccggcatcaagaccagctgcctgtgccccgtgttcgtgaacaccggcttcaccaagaaccccagcaccagactgtggcccgtgctggagaccgacgaggtggtgagaagcctgatcgacggcatcctgaccaacaagaagatgatcttcgtgcccagctacatcaacatcttcctgagactgcagaagttcctgcccgagagagccagcgccatcctgaacagaatgcagaacatccagttcgaggccgtggtgggccacaagatcaagatgaagtag

SEQ ID NO: 84950 - DNA, 903 bp, Artificial Sequence
  Description of Artificial Sequence: Synthetic coding sequence
atgaacatcatcctggagatcctgctgctgctgatcaccatcatctacagctacctggagagcctggtgaagttcttcatcccccagagaagaaagagcgtggccggcgagatcgtgctgatcaccggcgccggccacggcatcggcagacagaccacctacgagttcgccaagagacagagcatcctggtgctgtgggacatcaacaagagaggcgtggaggagaccgccgccgagtgcagaaagctgggcgtgaccgcccacgcctacgtggtggactgcagcaacagagaggagatctacagaagcctgaaccaggtgaagaaggaggtgggcgacgtgaccatcgtggtgaacaacgccggcaccgtgtaccccgccgacctgctgagcaccaaggacgaggagatcaccaagaccttcgaggtgaacatcctgggccacttctggatcaccaaggccctgctgcccagcatgatggagagaaaccacggccacatcgtgaccgtggccagcgtgtgcggccacgagggcatcccctacctgatcccctactgcagcagcaagttcgccgccgtgggcttccacagaggcctgaccagcgagctgcaggccctgggcaagaccggcatcaagaccagctgcctgtgccccgtgttcgtgaacaccggcttcaccaagaaccccagcaccagactgtggcccgtgctggagaccgacgaggtggtgagaagcctgatcgacggcatcctgaccaacaagaagatgatcttcgtgcccagctacatcaacatcttcctgagactgcagaagttcctgcccgagagagccagcgccatcctgaacagaatgcagaacatccagttcgaggccgtggtgggccacaagatcaagatgaagtag

SEQ ID NO: 84951 - DNA, 813 bp, Artificial Sequence
  Description of Artificial Sequence: Synthetic coding sequence
atggccaccggcaccagatacgccggcaaggtggtggtggtgaccggcggcggcagaggcatcggcgccggcatcgtgagagccttcgtgaacagcggcgccagagtggtgatctgcgacaaggacgagagcggcggcagagccctggagcaggagctgcccggcgccgtgttcatcctgtgcgacgtgacccaggaggacgacgtgaagaccctggtgagcgagaccatcagaagattcggcagactggactgcgtggtgaacaacgccggccaccacccccccccccagagacccgaggagaccagcgcccagggcttcagacagctgctggagctgaacctgctgggcacctacaccctgaccaagctggccctgccctacctgagaaagagccagggcaacgtgatcaacatcagcagcctggtgggcgccatcggccaggcccaggccgtgccctacgtggccaccaagggcgccgtgaccgccatgaccaaggccctggccctggacgagagcccctacggcgtgagagtgaactgcatcagccccggcaacatctggacccccctgtgggaggagctggccgccctgatgcccgaccccagagccaccatcagagagggcatgctggcccagcccctgggcagaatgggccagcccgccgaggtgggcgccgccgccgtgttcctggccagcgaggccaacttctgcaccggcatcgagctgctggtgaccggcggcgccgagctgggctacggctgcaaggccagcagaagcacccccgtggacgcccccgacatccccagctag

SEQ ID NO: 84952 - DNA, 1164 bp, Artificial Sequence
  Description of Artificial Sequence: Synthetic coding sequence
atgagcaccttcttcagcgacaccgcctggatctgcctggccgtgcccaccgtgctgtgcggcaccgtgttctgcaagtacaagaagagcagcggccagctgtggagctggatggtgtgcctggccggcctgtgcgccgtgtgcctgctgatcctgagccccttctggggcctgatcctgttcagcgtgagctgcttcctgatgtacacctacctgagcggccaggagctgctgcccgtggaccagaaggccgtgctggtgaccggcggcgactgcggcctgggccacgccctgtgcaagtacctggacgagctgggcttcaccgtgttcgccggcgtgctgaacgagaacggccccggcgccgaggagctgagaagaacctgcagccccagactgagcgtgctgcagatggacatcaccaagcccgtgcagatcaaggacgcctacagcaaggtggccgccatgctgcaggacagaggcctgtgggccgtgatcaacaacgccggcgtgctgggcttccccaccgacggcgagctgctgctgatgaccgactacaagcagtgcatggccgtgaacttcttcggcaccgtggaggtgaccaagaccttcctgcccctgctgagaaagagcaagggcagactggtgaacgtgagcagcatgggcggcggcgcccccatggagagactggccagctacggcagcagcaaggccgccgtgaccatgttcagcagcgtgatgagactggagctgagcaagtggggcatcaaggtggccagcatccagcccggcggcttcctgaccaacatcgccggcaccagcgacaagtgggagaagctggagaaggacatcctggaccacctgcccgccgaggtgcaggaggactacggccaggactacatcctggcccagagaaacttcctgctgctgatcaacagcctggccagcaaggacttcagccccgtgctgagagacatccagcacgccatcctggccaagagccccttcgcctactacacccccggcaagggcgcctacctgtggatctgcctggcccactacctgcccatcggcatctacgactacttcgccaagagacacttcggccaggacaagcccatgcccagagccctgagaatgcccaactacaagaagaaggccacctag

SEQ ID NO: 84953 - DNA, 783 bp, Artificial Sequence
  Description of Artificial Sequence: Synthetic coding sequence
atgggcgacgtgctggagcagttcttcatcctgaccggcctgctggtgtgcctggcctgcctggccaagtgcgtgagattcagcagatgcgtgctgctgaactactggaaggtgctgcccaagagcttcctgagaagcatgggccagtgggccgtgatcaccggcgccggcgacggcatcggcaaggcctacagcttcgagctggccaagagaggcctgaacgtggtgctgatcagcagaaccctggagaagctggaggccatcgccaccgagatcgagagaaccaccggcagaagcgtgaagatcatccaggccgacttcaccaaggacgacatctacgagcacatcaaggagaagctggccggcctggagatcggcatcctggtgaacaacgtgggcatgctgcccaacctgctgcccagccacttcctgaacgcccccgacgagatccagagcctgatccactgcaacatcaccagcgtggtgaagatgacccagctgatcctgaagcacatggagagcagacagaagggcctgatcctgaacatcagcagcggcatcgccctgttcccctggcccctgtacagcatgtacagcgccagcaaggccttcgtgtgcgccttcagcaaggccctgcaggaggagtacaaggccaaggaggtgatcatccaggccggcttcctgagcctgatccccgcctgggccttctacagcggcgccttccagagactgctgctgacccactacgtggcctacctgaagctgaacaccaaggtgagatag

SEQ ID NO: 84954 - DNA, 933 bp, Artificial Sequence
  Description of Artificial Sequence: Synthetic coding sequence
atgggcgacgtgctggagcagttcttcatcctgaccggcctgctggtgtgcctggcctgcctggccaagtgcgtgagattcagcagatgcgtgctgctgaactactggaaggtgctgcccaagagcttcctgagaagcatgggccagtgggccgtgatcaccggcgccggcgacggcatcggcaaggcctacagcttcgagctggccaagagaggcctgaacgtggtgctgatcagcagaaccctggagaagctggaggccatcgccaccgagatcgagagaaccaccggcagaagcgtgaagatcatccaggccgacttcaccaaggacgacatctacgagcacatcaaggagaagctggccggcctggagatcggcatcctggtgaacaacgtgggcatgctgcccaacctgctgcccagccacttcctgaacgcccccgacgagatccagagcctgatccactgcaacatcaccagcgtggtgaagatgacccagctgatcctgaagcacatggagagcagacagaagggcctgatcctgaacatcagcagcggcatcgccctgttcccctggcccctgtacagcatgtacagcgccagcaaggccttcgtgtgcgccttcagcaaggccctgcaggaggagtacaaggccaaggaggtgatcatccaggtgctgaccccctacgccgtgagcaccgccatgaccaagtacctgaacaccaacgtgatcaccaagaccgccgacgagttcgtgaaggagagcctgaactacgtgaccatcggcggcgagacctgcggctgcctggcccacgagatcctggccggcttcctgagcctgatccccgcctgggccttctacagcggcgccttccagagactgctgctgacccactacgtggcctacctgaagctgaacaccaaggtgagatag

SEQ ID NO: 84955 - DNA, 2211 bp, Artificial Sequence
  Description of Artificial Sequence: Synthetic coding sequence
atgggcagccccctgagattcgacggcagagtggtgctggtgaccggcgccggcgccggcctgggcagagcctacgccctggccttcgccgagagaggcgccctggtggtggtgaacgacctgggcggcgacttcaagggcgtgggcaagggcagcctggccgccgacaaggtggtggaggagatcagaagaagaggcggcaaggccgtggccaactacgacagcgtggaggagggcgagaaggtggtgaagaccgccctggacgccttcggcagaatcgacgtggtggtgaacaacgccggcatcctgagagacagaagcttcgccagaatcagcgacgaggactgggacatcatccacagagtgcacctgagaggcagcttccaggtgaccagagccgcctgggagcacatgaagaagcagaagtacggcagaatcatcatgaccagcagcgccagcggcatctacggcaacttcggccaggccaactacagcgccgccaagctgggcctgctgggcctggccaacagcctggccatcgagggcagaaagagcaacatccactgcaacaccatcgcccccaacgccggcagcagaatgacccagaccgtgatgcccgaggacctggtggaggccctgaagcccgagtacgtggcccccctggtgctgtggctgtgccacgagagctgcgaggagaacggcggcctgttcgaggtgggcgccggctggatcggcaagctgagatgggagagaaccctgggcgccatcgtgagacagaagaaccaccccatgacccccgaggccgtgaaggccaactggaagaagatctgcgacttcgagaacgccagcaagccccagagcatccaggagagcaccggcagcatcatcgaggtgctgagcaagatcgacagcgagggcggcgtgagcgccaaccacaccagcagagccaccagcaccgccaccagcggcttcgccggcgccatcggccagaagctgccccccttcagctacgcctacaccgagctggaggccatcatgtacgccctgggcgtgggcgccagcatcaaggaccccaaggacctgaagttcatctacgagggcagcagcgacttcagctgcctgcccaccttcggcgtgatcatcggccagaagagcatgatgggcggcggcctggccgagatccccggcctgagcatcaacttcgccaaggtgctgcacggcgagcagtacctggagctgtacaagcccctgcccagagccggcaagctgaagtgcgaggccgtggtggccgacgtgctggacaagggcagcggcgtggtgatcatcatggacgtgtacagctacagcgagaaggagctgatctgccacaaccagttcagcctgttcctggtgggcagcggcggcttcggcggcaagagaaccagcgacaaggtgaaggtggccgtggccatccccaacagaccccccgacgccgtgctgaccgacaccaccagcctgaaccaggccgccctgtacagactgagcggcgactggaaccccctgcacatcgaccccaacttcgccagcctggccggcttcgacaagcccatcctgcacggcctgtgcaccttcggcttcagcgccagaagagtgctgcagcagttcgccgacaacgacgtgagcagattcaaggccatcaaggccagattcgccaagcccgtgtaccccggccagaccctgcagaccgagatgtggaaggagggcaacagaatccacttccagaccaaggtgcaggagaccggcgacatcgtgatcagcaacgcctacgtggacctggcccccaccagcggcaccagcgccaagacccccagcgagggcggcaagctgcagagcaccttcgtgttcgaggagatcggcagaagactgaaggacatcggccccgaggtggtgaagaaggtgaacgccgtgttcgagtggcacatcaccaagggcggcaacatcggcgccaagtggaccatcgacctgaagagcggcagcggcaaggtgtaccagggccccgccaagggcgccgccgacaccaccatcatcctgagcgacgaggacttcatggaggtggtgctgggcaagctggacccccagaaggccttcttcagcggcagactgaaggccagaggcaacatcatgctgagccagaagctgcagatgatcctgaaggactacgccaagctgtag

SEQ ID NO: 84956 - DNA, 2286 bp, Artificial Sequence
  Description of Artificial Sequence: Synthetic coding sequence
atggtgatcctggaggccccccacctgctgagaagaaaggagcccgagacccccggcctgagcagcagaatcggccccagcctgtgccccggcttctgcagaaagagaagcgtgagctgctgcttccagaacctgtgcaacaaccccatggagaagatcatcagccagtgcagattcttcgtgagcatgaacgacctgggcggcgacttcaagggcgtgggcaagggcagcctggccgccgacaaggtggtggaggagatcagaagaagaggcggcaaggccgtggccaactacgacagcgtggaggagggcgagaaggtggtgaagaccgccctggacgccttcggcagaatcgacgtggtggtgaacaacgccggcatcctgagagacagaagcttcgccagaatcagcgacgaggactgggacatcatccacagagtgcacctgagaggcagcttccaggtgaccagagccgcctgggagcacatgaagaagcagaagtacggcagaatcatcatgaccagcagcgccagcggcatctacggcaacttcggccaggccaactacagcgccgccaagctgggcctgctgggcctggccaacagcctggccatcgagggcagaaagagcaacatccactgcaacaccatcgcccccaacgccggcagcagaatgacccagaccgtgatgcccgaggacctggtggaggccctgaagcccgagtacgtggcccccctggtgctgtggctgtgccacgagagctgcgaggagaacggcggcctgttcgaggtgggcgccggctggatcggcaagctgagatgggagagaaccctgggcgccatcgtgagacagaagaaccaccccatgacccccgaggccgtgaaggccaactggaagaagatctgcgacttcgagaacgccagcaagccccagagcatccaggagagcaccggcagcatcatcgaggtgctgagcaagatcgacagcgagggcggcgtgagcgccaaccacaccagcagagccaccagcaccgccaccagcggcttcgccggcgccatcggccagaagctgccccccttcagctacgcctacaccgagctggaggccatcatgtacgccctgggcgtgggcgccagcatcaaggaccccaaggacctgaagttcatctacgagggcagcagcgacttcagctgcctgcccaccttcggcgtgatcatcggccagaagagcatgatgggcggcggcctggccgagatccccggcctgagcatcaacttcgccaaggtgctgcacggcgagcagtacctggagctgtacaagcccctgcccagagccggcaagctgaagtgcgaggccgtggtggccgacgtgctggacaagggcagcggcgtggtgatcatcatggacgtgtacagctacagcgagaaggagctgatctgccacaaccagttcagcctgttcctggtgggcagcggcggcttcggcggcaagagaaccagcgacaaggtgaaggtggccgtggccatccccaacagaccccccgacgccgtgctgaccgacaccaccagcctgaaccaggccgccctgtacagactgagcggcgactggaaccccctgcacatcgaccccaacttcgccagcctggccggcttcgacaagcccatcctgcacggcctgtgcaccttcggcttcagcgccagaagagtgctgcagcagttcgccgacaacgacgtgagcagattcaaggccatcaaggccagattcgccaagcccgtgtaccccggccagaccctgcagaccgagatgtggaaggagggcaacagaatccacttccagaccaaggtgcaggagaccggcgacatcgtgatcagcaacgcctacgtggacctggcccccaccagcggcaccagcgccaagacccccagcgagggcggcaagctgcagagcaccttcgtgttcgaggagatcggcagaagactgaaggacatcggccccgaggtggtgaagaaggtgaacgccgtgttcgagtggcacatcaccaagggcggcaacatcggcgccaagtggaccatcgacctgaagagcggcagcggcaaggtgtaccagggccccgccaagggcgccgccgacaccaccatcatcctgagcgacgaggacttcatggaggtggtgctgggcaagctggacccccagaaggccttcttcagcggcagactgaaggccagaggcaacatcatgctgagccagaagctgcagatgatcctgaaggactacgccaagctgtag

SEQ ID NO: 84957 - DNA, 2139 bp, Artificial Sequence
  Description of Artificial Sequence: Synthetic coding sequence
atggagaagatcatcagccagtgcagattcttcgtgagcatgaacgacctgggcggcgacttcaagggcgtgggcaagggcagcctggccgccgacaaggtggtggaggagatcagaagaagaggcggcaaggccgtggccaactacgacagcgtggaggagggcgagaaggtggtgaagaccgccctggacgccttcggcagaatcgacgtggtggtgaacaacgccggcatcctgagagacagaagcttcgccagaatcagcgacgaggactgggacatcatccacagagtgcacctgagaggcagcttccaggtgaccagagccgcctgggagcacatgaagaagcagaagtacggcagaatcatcatgaccagcagcgccagcggcatctacggcaacttcggccaggccaactacagcgccgccaagctgggcctgctgggcctggccaacagcctggccatcgagggcagaaagagcaacatccactgcaacaccatcgcccccaacgccggcagcagaatgacccagaccgtgatgcccgaggacctggtggaggccctgaagcccgagtacgtggcccccctggtgctgtggctgtgccacgagagctgcgaggagaacggcggcctgttcgaggtgggcgccggctggatcggcaagctgagatgggagagaaccctgggcgccatcgtgagacagaagaaccaccccatgacccccgaggccgtgaaggccaactggaagaagatctgcgacttcgagaacgccagcaagccccagagcatccaggagagcaccggcagcatcatcgaggtgctgagcaagatcgacagcgagggcggcgtgagcgccaaccacaccagcagagccaccagcaccgccaccagcggcttcgccggcgccatcggccagaagctgccccccttcagctacgcctacaccgagctggaggccatcatgtacgccctgggcgtgggcgccagcatcaaggaccccaaggacctgaagttcatctacgagggcagcagcgacttcagctgcctgcccaccttcggcgtgatcatcggccagaagagcatgatgggcggcggcctggccgagatccccggcctgagcatcaacttcgccaaggtgctgcacggcgagcagtacctggagctgtacaagcccctgcccagagccggcaagctgaagtgcgaggccgtggtggccgacgtgctggacaagggcagcggcgtggtgatcatcatggacgtgtacagctacagcgagaaggagctgatctgccacaaccagttcagcctgttcctggtgggcagcggcggcttcggcggcaagagaaccagcgacaaggtgaaggtggccgtggccatccccaacagaccccccgacgccgtgctgaccgacaccaccagcctgaaccaggccgccctgtacagactgagcggcgactggaaccccctgcacatcgaccccaacttcgccagcctggccggcttcgacaagcccatcctgcacggcctgtgcaccttcggcttcagcgccagaagagtgctgcagcagttcgccgacaacgacgtgagcagattcaaggccatcaaggccagattcgccaagcccgtgtaccccggccagaccctgcagaccgagatgtggaaggagggcaacagaatccacttccagaccaaggtgcaggagaccggcgacatcgtgatcagcaacgcctacgtggacctggcccccaccagcggcaccagcgccaagacccccagcgagggcggcaagctgcagagcaccttcgtgttcgaggagatcggcagaagactgaaggacatcggccccgaggtggtgaagaaggtgaacgccgtgttcgagtggcacatcaccaagggcggcaacatcggcgccaagtggaccatcgacctgaagagcggcagcggcaaggtgtaccagggccccgccaagggcgccgccgacaccaccatcatcctgagcgacgaggacttcatggaggtggtgctgggcaagctggacccccagaaggccttcttcagcggcagactgaaggccagaggcaacatcatgctgagccagaagctgcagatgatcctgaaggactacgccaagctgtag

SEQ ID NO: 84958 - DNA, 1800 bp, Artificial Sequence
  Description of Artificial Sequence: Synthetic coding sequence
atgaagaagcagaagtacggcagaatcatcatgaccagcagcgccagcggcatctacggcaacttcggccaggccaactacagcgccgccaagctgggcctgctgggcctggccaacagcctggccatcgagggcagaaagagcaacatccactgcaacaccatcgcccccaacgccggcagcagaatgacccagaccgtgatgcccgaggacctggtggaggccctgaagcccgagtacgtggcccccctggtgctgtggctgtgccacgagagctgcgaggagaacggcggcctgttcgaggtgggcgccggctggatcggcaagctgagatgggagagaaccctgggcgccatcgtgagacagaagaaccaccccatgacccccgaggccgtgaaggccaactggaagaagatctgcgacttcgagaacgccagcaagccccagagcatccaggagagcaccggcagcatcatcgaggtgctgagcaagatcgacagcgagggcggcgtgagcgccaaccacaccagcagagccaccagcaccgccaccagcggcttcgccggcgccatcggccagaagctgccccccttcagctacgcctacaccgagctggaggccatcatgtacgccctgggcgtgggcgccagcatcaaggaccccaaggacctgaagttcatctacgagggcagcagcgacttcagctgcctgcccaccttcggcgtgatcatcggccagaagagcatgatgggcggcggcctggccgagatccccggcctgagcatcaacttcgccaaggtgctgcacggcgagcagtacctggagctgtacaagcccctgcccagagccggcaagctgaagtgcgaggccgtggtggccgacgtgctggacaagggcagcggcgtggtgatcatcatggacgtgtacagctacagcgagaaggagctgatctgccacaaccagttcagcctgttcctggtgggcagcggcggcttcggcggcaagagaaccagcgacaaggtgaaggtggccgtggccatccccaacagaccccccgacgccgtgctgaccgacaccaccagcctgaaccaggccgccctgtacagactgagcggcgactggaaccccctgcacatcgaccccaacttcgccagcctggccggcttcgacaagcccatcctgcacggcctgtgcaccttcggcttcagcgccagaagagtgctgcagcagttcgccgacaacgacgtgagcagattcaaggccatcaaggccagattcgccaagcccgtgtaccccggccagaccctgcagaccgagatgtggaaggagggcaacagaatccacttccagaccaaggtgcaggagaccggcgacatcgtgatcagcaacgcctacgtggacctggcccccaccagcggcaccagcgccaagacccccagcgagggcggcaagctgcagagcaccttcgtgttcgaggagatcggcagaagactgaaggacatcggccccgaggtggtgaagaaggtgaacgccgtgttcgagtggcacatcaccaagggcggcaacatcggcgccaagtggaccatcgacctgaagagcggcagcggcaaggtgtaccagggccccgccaagggcgccgccgacaccaccatcatcctgagcgacgaggacttcatggaggtggtgctgggcaagctggacccccagaaggccttcttcagcggcagactgaaggccagaggcaacatcatgctgagccagaagctgcagatgatcctgaaggactacgccaagctgtag

SEQ ID NO: 84959 - DNA, 2157 bp, Artificial Sequence
  Description of Artificial Sequence: Synthetic coding sequence
atgggcagccccctgagattcgacggcagagtggtgctggtgaccggcgccggcgccgtgaacgacctgggcggcgacttcaagggcgtgggcaagggcagcctggccgccgacaaggtggtggaggagatcagaagaagaggcggcaaggccgtggccaactacgacagcgtggaggagggcgagaaggtggtgaagaccgccctggacgccttcggcagaatcgacgtggtggtgaacaacgccggcatcctgagagacagaagcttcgccagaatcagcgacgaggactgggacatcatccacagagtgcacctgagaggcagcttccaggtgaccagagccgcctgggagcacatgaagaagcagaagtacggcagaatcatcatgaccagcagcgccagcggcatctacggcaacttcggccaggccaactacagcgccgccaagctgggcctgctgggcctggccaacagcctggccatcgagggcagaaagagcaacatccactgcaacaccatcgcccccaacgccggcagcagaatgacccagaccgtgatgcccgaggacctggtggaggccctgaagcccgagtacgtggcccccctggtgctgtggctgtgccacgagagctgcgaggagaacggcggcctgttcgaggtgggcgccggctggatcggcaagctgagatgggagagaaccctgggcgccatcgtgagacagaagaaccaccccatgacccccgaggccgtgaaggccaactggaagaagatctgcgacttcgagaacgccagcaagccccagagcatccaggagagcaccggcagcatcatcgaggtgctgagcaagatcgacagcgagggcggcgtgagcgccaaccacaccagcagagccaccagcaccgccaccagcggcttcgccggcgccatcggccagaagctgccccccttcagctacgcctacaccgagctggaggccatcatgtacgccctgggcgtgggcgccagcatcaaggaccccaaggacctgaagttcatctacgagggcagcagcgacttcagctgcctgcccaccttcggcgtgatcatcggccagaagagcatgatgggcggcggcctggccgagatccccggcctgagcatcaacttcgccaaggtgctgcacggcgagcagtacctggagctgtacaagcccctgcccagagccggcaagctgaagtgcgaggccgtggtggccgacgtgctggacaagggcagcggcgtggtgatcatcatggacgtgtacagctacagcgagaaggagctgatctgccacaaccagttcagcctgttcctggtgggcagcggcggcttcggcggcaagagaaccagcgacaaggtgaaggtggccgtggccatccccaacagaccccccgacgccgtgctgaccgacaccaccagcctgaaccaggccgccctgtacagactgagcggcgactggaaccccctgcacatcgaccccaacttcgccagcctggccggcttcgacaagcccatcctgcacggcctgtgcaccttcggcttcagcgccagaagagtgctgcagcagttcgccgacaacgacgtgagcagattcaaggccatcaaggccagattcgccaagcccgtgtaccccggccagaccctgcagaccgagatgtggaaggagggcaacagaatccacttccagaccaaggtgcaggagaccggcgacatcgtgatcagcaacgcctacgtggacctggcccccaccagcggcaccagcgccaagacccccagcgagggcggcaagctgcagagcaccttcgtgttcgaggagatcggcagaagactgaaggacatcggccccgaggtggtgaagaaggtgaacgccgtgttcgagtggcacatcaccaagggcggcaacatcggcgccaagtggaccatcgacctgaagagcggcagcggcaaggtgtaccagggccccgccaagggcgccgccgacaccaccatcatcctgagcgacgaggacttcatggaggtggtgctgggcaagctggacccccagaaggccttcttcagcggcagactgaaggccagaggcaacatcatgctgagccagaagctgcagatgatcctgaaggactacgccaagctgtag

SEQ ID NO: 84960 - DNA, 1026 bp, Artificial Sequence
  Description of Artificial Sequence: Synthetic coding sequence
atgagaaaggtggtgctgatcaccggcgccagcagcggcatcggcctggccctgtgcaagagactgctggccgaggacgacgagctgcacctgtgcctggcctgcagaaacatgagcaaggccgaggccgtgtgcgccgccctgctggccagccaccccaccgccgaggtgaccatcgtgcaggtggacgtgagcaacctgcagagcgtgttcagagccagcaaggagctgaagcagagattccagagactggactgcatctacctgaacgccggcatcatgcccaacccccagctgaacatcaaggccctgttcttcggcctgttcagcagaaaggtgatccacatgttcagcaccgccgagggcctgctgacccagggcgacaagatcaccgccgacggcctgcaggaggtgttcgagaccaacgtgttcggccacttcatcctgatcagagagctggagcccctgctgtgccacagcgacaaccccagccagctgatctggaccagcagcagaagcgccagaaagagcaacttcagcctggaggacttccagcacagcaagggcaaggagccctacagcagcagcaagtacgccaccgacctgctgagcgtggccctgaacagaaacttcaaccagcagggcctgtacagcaacgtggcctgccccggcaccgccctgaccaacctgacctacggcatcctgccccccttcatctggaccctgctgatgcccgccatcctgctgctgagattcttcgccaacgccttcaccctgaccccctacaacggcaccgaggccctggtgtggctgttccaccagaagcccgagagcctgaaccccctgatcaagtacctgagcgccaccaccggcttcggcagaaactacatcatgacccagaagatggacctggacgaggacaccgccgagaagttctaccagaagctgctggagctggagaagcacatcagagtgaccatccagaagaccgacaaccaggccagactgagcggcagctgcctgtag

SEQ ID NO: 84961 - DNA, 336 bp, Artificial Sequence
  Description of Artificial Sequence: Synthetic coding sequence
atgagaaaggtggtgctgatcaccggcgccagcagcggcatcggcctggccctgtgcaagagactgctggccgaggacgacgagctgcacctgtgcctggcctgcagaaacatgagcaaggccgaggccgtgtgcgccgccctgctggccagccaccccaccgccgaggtgaccatcgtgcaggtggacgtgagcaacctgcagagcgtgttcagagccagcaaggagctgaagcagagattccagagactggactgcatctacctgaacgccggcatcatgcccaacccccagctgaacatcaaggccctgttcttcggcctgttcagcagctag

SEQ ID NO: 84962 - DNA, 255 bp, Artificial Sequence
  Description of Artificial Sequence: Synthetic coding sequence
atgagaaaggtggtgctgatcaccggcgccagcagcggcatcggcctggccctgtgcaagagactgctggccgaggacgacgagctgcacctgtgcctggcctgcagaaacatgagcaaggccgaggccgtgtgcgccgccctgctggccagccaccccaccgccgaggtgaccatcgtgcaggtggacgtgagcaacctgcagagcgtgttcagagccagcaaggagctgaagcagagatacatcagctgctag

SEQ ID NO: 84963 - DNA, 921 bp, Artificial Sequence
  Description of Artificial Sequence: Synthetic coding sequence
atgagaaaggtggtgctgatcaccggcgccagcagcggcatcggcctggccctgtgcaagagactgctggccgaggacgacgagctgcacctgtgcctggcctgcagaaacatgagcaaggccgaggccgtgtgcgccgccctgctggccagccaccccaccgccgaggtgaccatcgtgcaggtggacgtgagcaacctgcagagcgtgttcagagccagcaaggagctgaagcagagattccagagactggactgcatctacctgaacgccggcatcatgcccaacccccagctgaacatcaaggccctgttcttcggcctgttcagcagaaaggtgatccacatgttcagcaccgccgagggcctgctgacccagggcgacaagatcaccgccgacggcctgcaggaggtgttcgagaccaacgtgttcggccacttcatcctgatcagagagctggagcccctgctgtgccacagcgacaaccccagccagctgatctggaccagcagcagaagcgccagaaagagcaacttcagcctggaggacttccagcacagcaagggcaaggagccctacagcagcagcaagtacgccaccgacctgctgagcgtggccctgaacagaaacttcaaccagcagctgagattcttcgccaacgccttcaccctgaccccctacaacggcaccgaggccctggtgtggctgttccaccagaagcccgagagcctgaaccccctgatcaagtacctgagcgccaccaccggcttcggcagaaactacatcatgacccagaagatggacctggacgaggacaccgccgagaagttctaccagaagctgctggagctggagaagcacatcagagtgaccatccagaagaccgacaaccaggccagactgagcggcagctgcctgtag

SEQ ID NO: 84964 - DNA, 360 bp, Artificial Sequence
  Description of Artificial Sequence: Synthetic coding sequence
gtggtgatcagagagctggagcccctgctgtgccacagcgacaaccccagccagctgatctggaccagcagcagaagcgccagaaagagcaacttcagcctggaggacttccagcacagcaagggcaaggagccctacagcagcagcaagtacgccaccgacctgctgagcgtggccctgaacagaaacttcaaccagcagctgagattcttcgccaacgccttcaccctgaccccctacaacggcaccgaggccctggtgtggctgttccaccagaagcccgagagcctgaaccccctgatcaagtacctgagcgccaccaccggcttcggcagaaactacatcatgacccagaagtag

SEQ ID NO: 84965 - DNA, 966 bp, Artificial Sequence
  Description of Artificial Sequence: Synthetic coding sequence
atggagagaaagaaccagaccgccatcaccgagttcatcatcctgggcttcagcaacctgaacgagtggcagttcctgctgttcaccatcttcttcctgacctacttctgcaccctgggcggcaacatcctgatcatcctgaccaccgtgaccgacccccacctgcacacccccatgtactacttcctgggcaacctggccttcatcgacatctgctacaccaccagcaacgtgccccagatgatggtgcacctgctgagcaagaagaagagcatcagctacgtgggctgcgtggtgcagctgttcgccttcgtgttcttcgtgggcagcgagtgcctgctgctggccgccatggcctacgacagatacatcgccatctgcaaccccctgagatacagcgtgatcctgagcaaggtgctgtgcaaccagctggccgccagctgctgggccgccggcttcctgaacagcgtggtgcacaccgtgctgaccttctgcctgcccttctgcggcaacaaccagatcaactacttcttctgcgacatcccccccctgctgatcctgagctgcggcaacaccagcgtgaacgagctggccctgctgagcaccggcgtgttcatcggctggacccccttcctgtgcatcgtgctgagctacatctgcatcatcagcaccatcctgagaatccagagcagcgagggcagaagaaaggccttcagcacctgcgccagccacctggccatcgtgttcctgttctacggcagcgccatcttcacctacgtgagacccatcagcacctacagcctgaagaaggacagactggtgagcgtgctgtacagcgtggtgacccccatgctgaaccccatcatctacaccctgagaaacaaggacatcaaggaggccgtgaagaccatcggcagcaagtggcagccccccatcagcagcctggacagcaagctgacctactag

SEQ ID NO: 84966 - DNA, 786 bp, Artificial Sequence
  Description of Artificial Sequence: Synthetic coding sequence
atggccagccagctgcagaacagactgagaagcgccctggccctggtgaccggcgccggcagcggcatcggcagagccgtgagcgtgagactggccggcgagggcgccaccgtggccgcctgcgacctggacagagccgccgcccaggagaccgtgagactgctgggcggccccggcagcaaggagggcccccccagaggcaaccacgccgccttccaggccgacgtgagcgaggccagagccgccagatgcctgctggagcaggtgcaggcctgcttcagcagaccccccagcgtggtggtgagctgcgccggcatcacccaggacgagttcctgctgcacatgagcgaggacgactgggacaaggtgatcgccgtgaacctgaagggcaccttcctggtgacccaggccgccgcccaggccctggtgagcaacggctgcagaggcagcatcatcaacatcagcagcatcgtgggcaaggtgggcaacgtgggccagaccaactacgccgccagcaaggccggcgtgatcggcctgacccagaccgccgccagagagctgggcagacacggcatcagatgcaacagcgtgctgcccggcttcatcgccacccccatgacccagaaggtgccccagaaggtggtggacaagatcaccgagatgatccccatgggccacctgggcgaccccgaggacgtggccgacgtggtggccttcctggccagcgaggacagcggctacatcaccggcaccagcgtggaggtgaccggcggcctgttcatgtag

SEQ ID NO: 84967 - DNA, 786 bp, Artificial Sequence; identical to SEQ ID NO: 84966
  Description of Artificial Sequence: Synthetic coding sequence

SEQ ID NO: 84968 - DNA, 786 bp, Artificial Sequence; identical to SEQ ID NO: 84966
  Description of Artificial Sequence: Synthetic coding sequence

SEQ ID NO: 84969 - DNA, 786 bp, Artificial Sequence; identical to SEQ ID NO: 84966
  Description of Artificial Sequence: Synthetic coding sequence

SEQ ID NO: 84970 - DNA, 786 bp, Artificial Sequence; identical to SEQ ID NO: 84966
  Description of Artificial Sequence: Synthetic coding sequence

SEQ ID NO: 84971 - DNA, 1848 bp, Artificial Sequence
  Description of Artificial Sequence: Synthetic coding sequence
atggtgagcggccccctggccctgagatggtgcgcctgggccggcagaggcgacatgggccccgacatggagctgcccagccacagcaagcagctgctgctgcagctgaaccagcagagaaccaagggcttcctgtgcgacgtgatcatcatggtggagaacagcatcttcagagcccacaagaacgtgctggccgccagcagcatctacttcaagagcctggtgctgcacgacaacctgatcaacctggacaccgacatggtgagcagcaccgtgttccagcagatcctggacttcatctacaccggcaagctgctgcccagcgaccagcccgccgagcccaacttcagcaccctgctgaccgccgccagctacctgcagctgcccgagctggccgccctgtgcagaagaaagctgaagagagccggcaagcccttcggcagcggcagagccggcagcaccggcatgggcagaccccccagaagccagagactgagcaccgccagcgtgatccaggccagataccagggcctggtggacggcagaaagggcgcccacgccccccaggagctgccccaggccaagggcagcgacgacgagctgttcctgggcggcagcaaccaggacagcgtgcagggcctgggcagagccgtgtgccccgccggcggcgaggccggcctgggcggctgcagcagcagcaccaacggcagcagcggcggctgcgagcaggagctgggcctggacctgagcaagaagagcccccccctgccccccgccacccccggcccccacctgacccccgacgacgccgcccagctgagcgacagccagcacggcagcccccccgccgccagcgccccccccgtggccaacagcgccagctacagcgagctgggcggcacccccgacgagcccatggacctggagggcgccgaggacaaccacctgagcctgctggaggcccccggcggccagcccagaaagagcctgagacacagcaccagaaagaaggagtggggcaagaaggagcccgtggccggcagccccttcgagagaagagaggccggccccaagggcccctgccccggcgaggagggcgagggcgtgggcgacagagtgcccaacggcatcctggccagcggcgccggccccagcggcccctacggcgagcccccctacccctgcaaggaggaggaggagaacggcaaggacgccagcgaggacagcgcccagagcggcagcgagggcggcagcggccacgccagcgcccactacatgtacagacaggagggctacgagaccgtgagctacggcgacaacctgtacgtgtgcatcccctgcgccaagggcttccccagcagcgagcagctgaacgcccacgtggagacccacaccgaggaggagctgttcatcaaggaggagggcgcctacgagaccggcagcggcggcgccgaggaggaggccgaggacctgagcgcccccagcgccgcctacaccgccgagcccagacccttcaagtgcagcgtgtgcgagaagacctacaaggaccccgccaccctgagacagcacgagaagacccactggctgaccagacccttcccctgcaacatctgcggcaagatgttcacccagagaggcaccatgaccagacacatgagaagccacctgggcctgaagcccttcgcctgcgacgagtgcggcatgagattcaccagacagtacagactgaccgagcacatgagagtgcacagcggcgagaagccctacgagtgccagctgtgcggcggcaagttcacccagcagagaaacctgatcagccacctgagaatgcacaccagccccagctag

SEQ ID NO: 84972 - DNA, 1848 bp, Artificial Sequence; identical to SEQ ID NO: 84971
  Description of Artificial Sequence: Synthetic coding sequence

SEQ ID NO: 84973 - DNA, 1848 bp, Artificial Sequence; identical to SEQ ID NO: 84971
  Description of Artificial Sequence: Synthetic coding sequence

SEQ ID NO: 84974 - DNA, 2670 bp, Artificial Sequence
  Description of Artificial Sequence: Synthetic coding sequence
atggacgccagaggcggcggcggcagacccggcgagagccccggcgccacccccgcccccggccccccccccccccccccccccgcccccccccagcagcagcccccccccccccccccccccgcccccccccccggccccggccccgcccccccccagcacccccccagagccgaggccctgccccccgaggccgccgacgagggcggccccagaggcagactgagaagcagagacagcagctgcggcagacccggcacccccggcgccgccagcaccgccaagggcagccccaacggcgagtgcggcagaggcgagccccagtgcagccccgccggccccgagggccccgccagaggccccaaggtgagcttcagctgcagaggcgccgccagcggccccgcccccggccccggccccgccgaggaggccggcagcgaggaggccggccccgccggcgagcccagaggcagccaggccagcttcatgcagagacagttcggcgccctgctgcagcccggcgtgaacaagttcagcctgagaatgttcggcagccagaaggccgtggagagagagcaggagagagtgaagagcgccggcgcctggatcatccacccctacagcgacttcagattctactgggacttcaccatgctgctgttcatggtgggcaacctgatcatcatccccgtgggcatcaccttcttcaaggacgagaccaccgccccctggatcgtgttcaacgtggtgagcgacaccttcttcctgatggacctggtgctgaacttcagaaccggcatcgtgatcgaggacaacaccgagatcatcctggaccccgagaagatcaagaagaagtacctgagaacctggttcgtggtggacttcgtgagcagcatccccgtggactacatcttcctgatcgtggagaagggcatcgacagcgaggtgtacaagaccgccagagccctgagaatcgtgagattcaccaagatcctgagcctgctgagactgctgagactgagcagactgatcagatacatccaccagtgggaggagatcttccacatgacctacgacctggccagcgccgtgatgagaatctgcaacctgatcagcatgatgctgctgctgtgccactgggacggctgcctgcagttcctggtgcccatgctgcaggacttccccagaaactgctgggtgagcatcaacggcatggtgaaccacagctggagcgagctgtacagcttcgccctgttcaaggccatgagccacatgctgtgcatcggctacggcagacaggcccccgagagcatgaccgacatctggctgaccatgctgagcatgatcgtgggcgccacctgctacgccatgttcatcggccacgccaccgccctgatccagagcctggacagcagcagaagacagtaccaggagaagtacaagcaggtggagcagtacatgagcttccacaagctgcccgccgacttcagacagaagatccacgactactacgagcacagataccagggcaagatgttcgacgaggacagcatcctgggcgagctgaacggccccctgagagaggagatcgtgaacttcaactgcagaaagctggtggccagcatgcccctgttcgccaacgccgaccccaacttcgtgaccgccatgctgaccaagctgaagttcgaggtgttccagcccggcgactacatcatcagagagggcaccatcggcaagaagatgtacttcatccagcacggcgtggtgagcgtgctgaccaagggcaacaaggagatgaagctgagcgacggcagctacttcggcgagatctgcctgctgaccagaggcagaagaaccgccagcgtgagagccgacacctactgcagactgtacagcctgagcgtggacaacttcaacgaggtgctggaggagtaccccatgatgagaagagccttcgagaccgtggccatcgacagactggacagaatcggcaagaagaacagcatcctgctgcacaaggtgcagcacgacctgaacagcggcgtgttcaacaaccaggagaacgccatcatccaggagatcgtgaagtacgacagagagatggtgcagcaggccgagctgggccagagagtgggcctgttcccccccccccccccccccccccaggtgaccagcgccatcgccaccctgcagcaggccgccgccatgagcttctgcccccaggtggccagacccctggtgggccccctggccctgggcagccccagactggtgagaagacccccccccggccccgcccccgccgccgccagccccggcccccccccccccgccagcccccccggcgcccccgccagccccagagcccccagaaccagcccctacggcggcctgcccgccgcccccctggccggccccgccctgcccgccagaagactgagcagagccagcagacccctgagcgccagccagcccagcctgccccacggcgcccccggccccgccgccagcaccagacccgccagcagcagcacccccagactgggccccacccccgccgccagagccgccgcccccagccccgacagaagagacagcgccagccccggcgccgccggcggcctggacccccaggacagcgccagaagcagactgagcagcaacctgtag

SEQ ID NO: 84975 - DNA, 2325 bp, Artificial Sequence
  Description of Artificial Sequence: Synthetic coding sequence
atggaggccgagcagagacccgccgccggcgccagcgagggcgccacccccggcctggaggccgtgccccccgtggcccccccccccgccaccgccgccagcggccccatccccaagagcggccccgagcccaagagaagacacctgggcaccctgctgcagcccaccgtgaacaagttcagcctgagagtgttcggcagccacaaggccgtggagatcgagcaggagagagtgaagagcgccggcgcctggatcatccacccctacagcgacttcagattctactgggacctgatcatgctgctgctgatggtgggcaacctgatcgtgctgcccgtgggcatcaccttcttcaaggaggagaacagccccccctggatcgtgttcaacgtgctgagcgacaccttcttcctgctggacctggtgctgaacttcagaaccggcatcgtggtggaggagggcgccgagatcctgctggcccccagagccatcagaaccagatacctgagaacctggttcctggtggacctgatcagcagcatccccgtggactacatcttcctggtggtggagctggagcccagactggacgccgaggtgtacaagaccgccagagccctgagaatcgtgagattcaccaagatcctgagcctgctgagactgctgagactgagcagactgatcagatacatccaccagtgggaggagatcttccacatgacctacgacctggccagcgccgtggtgagaatcttcaacctgatcggcatgatgctgctgctgtgccactgggacggctgcctgcagttcctggtgcccatgctgcaggacttcccccccgactgctgggtgagcatcaaccacatggtgaaccacagctggggcagacagtacagccacgccctgttcaaggccatgagccacatgctgtgcatcggctacggccagcaggcccccgtgggcatgcccgacgtgtggctgaccatgctgagcatgatcgtgggcgccacctgctacgccatgttcatcggccacgccaccgccctgatccagagcctggacagcagcagaagacagtaccaggagaagtacaagcaggtggagcagtacatgagcttccacaagctgcccgccgacaccagacagagaatccacgagtactacgagcacagataccagggcaagatgttcgacgaggagagcatcctgggcgagctgagcgagcccctgagagaggagatcatcaacttcacctgcagaggcctggtggcccacatgcccctgttcgcccacgccgaccccagcttcgtgaccgccgtgctgaccaagctgagattcgaggtgttccagcccggcgacctggtggtgagagagggcagcgtgggcagaaagatgtacttcatccagcacggcctgctgagcgtgctggccagaggcgccagagacaccagactgaccgacggcagctacttcggcgagatctgcctgctgaccagaggcagaagaaccgccagcgtgagagccgacacctactgcagactgtacagcctgagcgtggaccacttcaacgccgtgctggaggagttccccatgatgagaagagccttcgagaccgtggccatggacagactgctgagaatcggcaagaagaacagcatcctgcagagaaagagaagcgagcccagccccggcagcagcggcggcatcatggagcagcacctggtgcagcacgacagagacatggccagaggcgtgagaggcagagcccccagcaccggcgcccagctgagcggcaagcccgtgctgtgggagcccctggtgcacgcccccctgcaggccgccgccgtgaccagcaacgtggccatcgccctgacccaccagagaggccccctgcccctgagccccgacagccccgccaccctgctggccagaagcgcctggagaagcgccggcagccccgccagccccctggtgcccgtgagagccggcccctgggccagcaccagcagactgcccgccccccccgccagaaccctgcacgccagcctgagcagagccggcagaagccaggtgagcctgctgggccccccccccggcggcggcggcagaagactgggccccagaggcagacccctgagcgccagccagcccagcctgccccagagagccaccggcgacggcagccccggcagaaagggcagcggcagcgagagactgccccccagcggcctgctggccaagccccccagaaccgcccagccccccagaccccccgtgcccgagcccgccacccccagaggcctgcagctgagcgccaacatgtag

SEQ ID NO: 84976 - DNA, 3612 bp, Artificial Sequence
  Description of Artificial Sequence: Synthetic coding sequence
atggacaagctgccccccagcatgagaaagagactgtacagcctgccccagcaggtgggcgccaaggcctggatcatggacgaggaggaggacgccgaggaggagggcgccggcggcagacaggaccccagcagaagaagcatcagactgagacccctgcccagccccagccccagcgccgccgccggcggcaccgagagcagaagcagcgccctgggcgccgccgacagcgagggccccgccagaggcgccggcaagagcagcaccaacggcgactgcagaagattcagaggcagcctggccagcctgggcagcagaggcggcggcagcggcggcaccggcagcggcagcagccacggccacctgcacgacagcgccgaggagagaagactgatcgccgagggcgacgccagccccggcgaggacagaaccccccccggcctggccgccgagcccgagagacccggcgccagcgcccagcccgccgccagccccccccccccccagcagcccccccagcccgccagcgccagctgcgagcagcccagcgtggacaccgccatcaaggtggagggcggcgccgccgccggcgaccagatcctgcccgaggccgaggtgagactgggccaggccggcttcatgcagagacagttcggcgccatgctgcagcccggcgtgaacaagttcagcctgagaatgttcggcagccagaaggccgtggagagagagcaggagagagtgaagagcgccggcttctggatcatccacccctacagcgacttcagattctactgggacctgaccatgctgctgctgatggtgggcaacctgatcatcatccccgtgggcatcaccttcttcaaggacgagaacaccaccccctggatcgtgttcaacgtggtgagcgacaccttcttcctgatcgacctggtgctgaacttcagaaccggcatcgtggtggaggacaacaccgagatcatcctggacccccagagaatcaagatgaagtacctgaagagctggttcatggtggacttcatcagcagcatccccgtggactacatcttcctgatcgtggagaccagaatcgacagcgaggtgtacaagaccgccagagccctgagaatcgtgagattcaccaagatcctgagcctgctgagactgctgagactgagcagactgatcagatacatccaccagtgggaggagatcttccacatgacctacgacctggccagcgccgtggtgagaatcgtgaacctgatcggcatgatgctgctgctgtgccactgggacggctgcctgcagttcctggtgcccatgctgcaggacttccccgacgactgctgggtgagcatcaacaacatggtgaacaacagctggggcaagcagtacagctacgccctgttcaaggccatgagccacatgctgtgcatcggctacggcagacaggcccccgtgggcatgagcgacgtgtggctgaccatgctgagcatgatcgtgggcgccacctgctacgccatgttcatcggccacgccaccgccctgatccagagcctggacagcagcagaagacagtaccaggagaagtacaagcaggtggagcagtacatgagcttccacaagctgccccccgacaccagacagagaatccacgactactacgagcacagataccagggcaagatgttcgacgaggagagcatcctgggcgagctgagcgagcccctgagagaggagatcatcaacttcaactgcagaaagctggtggccagcatgcccctgttcgccaacgccgaccccaacttcgtgaccagcatgctgaccaagctgagattcgaggtgttccagcccggcgactacatcatcagagagggcaccatcggcaagaagatgtacttcatccagcacggcgtggtgagcgtgctgaccaagggcaacaaggagaccaagctggccgacggcagctacttcggcgagatctgcctgctgaccagaggcagaagaaccgccagcgtgagagccgacacctactgcagactgtacagcctgagcgtggacaacttcaacgaggtgctggaggagtaccccatgatgagaagagccttcgagaccgtggccctggacagactggacagaatcggcaagaagaacagcatcctgctgcacaaggtgcagcacgacctgaacagcggcgtgttcaactaccaggagaacgagatcatccagcagatcgtgcagcacgacagagagatggcccactgcgcccacagagtgcaggccgccgccagcgccacccccacccccacccccgtgatctggacccccctgatccaggcccccctgcaggccgccgccgccaccaccagcgtggccatcgccctgacccaccaccccagactgcccgccgccatcttcagacccccccccggcagcggcctgggcaacctgggcgccggccagacccccagacacctgaagagactgcagagcctgatccccagcgccctgggcagcgccagccccgccagcagccccagccaggtggacacccccagcagcagcagcttccacatccagcagctggccggcttcagcgcccccgccggcctgagccccctgctgcccagcagcagcagcagccccccccccggcgcctgcggcagccccagcgcccccacccccagcgccggcgtggccgccaccaccatcgccggcttcggccacttccacaaggccctgggcggcagcctgagcagcagcgacagccccctgctgacccccctgcagcccggcgccagaagcccccaggccgcccagcccagccccgccccccccggcgccagaggcggcctgggcctgcccgagcacttcctgccccccccccccagcagcagaagccccagcagcagccccggccagctgggccagccccccggcgagctgagcctgggcctggccaccggccccctgagcacccccgagaccccccccagacagcccgagccccccagcctggtggccggcgccagcggcggcgccagccccgtgggcttcacccccagaggcggcctgagcccccccggccacagccccggcccccccagaaccttccccagcgccccccccagagccagcggcagccacggcagcctgctgctgccccccgccagcagccccccccccccccaggtgccccagagaagaggcaccccccccctgacccccggcagactgacccaggacctgaagctgatcagcgccagccagcccgccctgccccaggacggcgcccagaccctgagaagagccagcccccacagcagcggcgagagcatggccgccttccccctgttccccagagccggcggcggcagcggcggcagcggcagcagcggcggcctgggcccccccggcagaccctacggcgccatccccggccagcacgtgaccctgcccagaaagaccagcagcggcagcctgcccccccccctgagcctgttcggcgccagagccaccagcagcggcggcccccccctgaccgccggcccccagagagagcccggcgccagacccgagcccgtgagaagcaagctgcccagcaacctgtag

SEQ ID NO: 84977 - DNA, 396 bp, Artificial Sequence
  Description of Artificial Sequence: Synthetic coding sequence
atgaacctgcccagcaccaaggtgagctgggccgccgtgaccctgctgctgctgctgctgctgctgccccccgccctgctgagcagcggcgccgccgcccagcccctgcccgactgctgcagacagaagacctgcagctgcagactgtacgagctgctgcacggcgccggcaaccacgccgccggcatcctgaccctgggcaagagaagaagcggcccccccggcctgcagggcagactgcagagactgctgcaggccagcggcaaccacgccgccggcatcctgaccatgggcagaagagccggcgccgagcccgcccccagaccctgcctgggcagaagatgcagcgcccccgccgccgccagcgtggcccccggcggccagagcggcatctag

SEQ ID NO: 84978 - DNA, 1050 bp, Artificial Sequence
  Description of Artificial Sequence: Synthetic coding sequence
atggccgccaccgccgccgaggccgtggccagcggcagcggcgagcccagagaggaggccggcgccctgggccccgcctgggacgagagccagctgagaagctacagcttccccaccagacccatccccagactgagccagagcgaccccagagccgaggagctgatcgagaacgaggagcccgtggtgctgaccgacaccaacctggtgtaccccgccctgaagtgggacctggagtacctgcaggagaacatcggcaacggcgacttcagcgtgtacagcgccagcacccacaagttcctgtactacgacgagaagaagatggccaacttccagaacttcaagcccagaagcaacagagaggagatgaagttccacgagttcgtggagaagctgcaggacatccagcagagaggcggcgaggagagactgtacctgcagcagaccctgaacgacaccgtgggcagaaagatcgtgatggacttcctgggcttcaactggaactggatcaacaagcagcagggcaagagaggctggggccagctgaccagcaacctgctgctgatcggcatggagggcaacgtgacccccgcccactacgacgagcagcagaacttcttcgcccagatcaagggctacaagagatgcatcctgttcccccccgaccagttcgagtgcctgtacccctaccccgtgcaccacccctgcgacagacagagccaggtggacttcgacaaccccgactacgagagattccccaacttccagaacgtggtgggctacgagaccgtggtgggccccggcgacgtgctgtacatccccatgtactggtggcaccacatcgagagcctgctgaacggcggcatcaccatcaccgtgaacttctggtacaagggcgcccccacccccaagagaatcgagtaccccctgaaggcccaccagaaggtggccatcatgagaaacatcgagaagatgctgggcgaggccctgggcaacccccaggaggtgggccccctgctgaacaccatgatcaagggcagatacaactag

SEQ ID NO: 84979 - DNA, 1149 bp, Artificial Sequence
  Description of Artificial Sequence: Synthetic coding sequence
atggtgagcgtgggctgcgtggtgttcctgttcttcttcttcggcgtgagaaacagaagaagcttcagattcagatggggccccagcctggccgccgagatggccgccaccgccgccgaggccgtggccagcggcagcggcgagcccagagaggaggccggcgccctgggccccgcctgggacgagagccagctgagaagctacagcttccccaccagacccatccccagactgagccagagcgaccccagagccgaggagctgatcgagaacgaggagcccgtggtgctgaccgacaccaacctggtgtaccccgccctgaagtgggacctggagtacctgcaggagaacatcggcaacggcgacttcagcgtgtacagcgccagcacccacaagttcctgtactacgacgagaagaagatggccaacttccagaacttcaagcccagaagcaacagagaggagatgaagttccacgagttcgtggagaagctgcaggacatccagcagagaggcggcgaggagagactgtacctgcagcagaccctgaacgacaccgtgggcagaaagatcgtgatggacttcctgggcttcaactggaactggatcaacaagcagcagggcaagagaggctggggccagctgaccagcaacctgctgctgatcggcatggagggcaacgtgacccccgcccactacgacgagcagcagaacttcttcgcccagatcaagggctacaagagatgcatcctgttcccccccgaccagttcgagtgcctgtacccctaccccgtgcaccacccctgcgacagacagagccaggtggacttcgacaaccccgactacgagagattccccaacttccagaacgtggtgggctacgagaccgtggtgggccccggcgacgtgctgtacatccccatgtactggtggcaccacatcgagagcctgctgaacggcggcatcaccatcaccgtgaacttctggtacaagggcgcccccacccccaagagaatcgagtaccccctgaaggcccaccagaaggtggccatcatgagaaacatcgagaagatgctgggcgaggccctgggcaacccccaggaggtgggccccctgctgaacaccatgatcaagggcagatacaactag

SEQ ID NO: 84980 - DNA, 579 bp, Artificial Sequence
  Description of Artificial Sequence: Synthetic coding sequence
atggccaacttccagaacttcaagcccagaagcaacagagaggagatgaagttccacgagttcgtggagaagctgcaggacatccagcagagaggcggcgaggagagactgtacctgcagcagaccctgaacgacaccgtgggcagaaagatcgtgatggacttcctgggcttcaactggaactggatcaacaagcagcagggcaagagaggctggggccagctgaccagcaacctgctgctgatcggcatggagggcaacgtgacccccgcccactacgacgagcagcagaacttcttcgcccagatcaagggctacaagagatgcatcctgttcccccccgaccagttcgagtgcctgtacccctaccccgtgcaccacccctgcgacagacagagccaggtggacttcgacaaccccgactacgagagattccccaacttccagaacgtggtgggctacgagaccgtggtgggccccggcgacgtgctgtacatccccatgtactggtggcaccacatcgagagcctgctgaacggcggcatcaccatcaccgtgaacttctggtacaagggctag

SEQ ID NO: 84981 - DNA, 1803 bp, Artificial Sequence
  Description of Artificial Sequence: Synthetic coding sequence
atgagacccgccgccggcgccgccagaagacccagatgctgcaccagctggctgaccagatgccccagccccgccgccagcgcccccacctggaccagacccctgagctgcgccagccccagcgccacctgcgcctgcaccgccagcgccccccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctgagcttcctgctgaccggcggccccgcccccggcagcctgcaggaccccagcacccccctgctgaacctgaacgagcccctgggcctgggccccagcctgctgagcccctacagcgacgaggacaccacccagcccggcggccccttccagcccagagccggcagcgcccaggccgactag

SEQ ID NO: 84982 - DNA, 1353 bp, Artificial Sequence
  Description of Artificial Sequence: Synthetic coding sequence
atgagacccgccgccggcgccgccagaagacccagatgctgcaccagctggctgaccagatgccccagccccgccgccagcgcccccacctggaccagacccctgagctgcgccagccccagcgccacctgcgcctgcaccgccagcgccccccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggaccccagcacccccctgctgaacctgaacgagcccctgggcttccacttcgtgacccagagcggcgtgcagtggcacaagcacagcagcccccagcccagaccccccggcctgaagtag

SEQ ID NO: 84983 - DNA, 1899 bp, Artificial Sequence
  Description of Artificial Sequence: Synthetic coding sequence
atggccctgggcctgcagagagccagaagcaccaccgagctgagaaaggagaagagcagagacgccgccagaagcagaagaagccaggagaccgaggtgctgtaccagctggcccacaccctgcccttcgccagaggcgtgagcgcccacctggacaaggccagcatcatgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctggtgtgctggggcatcaacggcatcctgtggcccagcctgcccagctggctgaagcccaccgtgctgtag

SEQ ID NO: 84984 - DNA, 1731 bp, Artificial Sequence
  Description of Artificial Sequence: Synthetic coding sequence
atgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctggtgtgctggggcatcaacggcatcctgtggcccagcctgcccagctggctgaagcccaccgtgctgtag

SEQ ID NO: 84985 - DNA, 2004 bp, Artificial Sequence
  Description of Artificial Sequence: Synthetic coding sequence
atggactggcaggaccacagaagcaccaccgagctgagaaaggagaagagcagagacgccgccagaagcagaagaagccaggagaccgaggtgctgtaccagctggcccacaccctgcccttcgccagaggcgtgagcgcccacctggacaaggccagcatcatgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctgagcttcctgctgaccggcggccccgcccccggcagcctgcaggaccccagcacccccctgctgaacctgaacgagcccctgggcctgggccccagcctgctgagcccctacagcgacgaggacaccacccagcccggcggccccttccagcccagagccggcagcgcccaggccgactag

SEQ ID NO: 84986 - DNA, 1842 bp, Artificial Sequence
  Description of Artificial Sequence: Synthetic coding sequence
atgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctgagcttcctgctgaccggcggccccgcccccggcagcctgcaggaccccagcacccccctgctgaacctgaacgagcccctgggcctgggccccagcctgctgagcccctacagcgacgaggacaccacccagcccggcggccccttccagcccagagccggcagcgcccaggccgactag

SEQ ID NO: 84987 - DNA, 2010 bp, Artificial Sequence
  Description of Artificial Sequence: Synthetic coding sequence
atggccctgggcctgcagagagccagaagcaccaccgagctgagaaaggagaagagcagagacgccgccagaagcagaagaagccaggagaccgaggtgctgtaccagctggcccacaccctgcccttcgccagaggcgtgagcgcccacctggacaaggccagcatcatgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctgagcttcctgctgaccggcggccccgcccccggcagcctgcaggaccccagcacccccctgctgaacctgaacgagcccctgggcctgggccccagcctgctgagcccctacagcgacgaggacaccacccagcccggcggccccttccagcccagagccggcagcgcccaggccgactag

SEQ ID NO: 84988 - DNA, 1092 bp, Artificial Sequence
  Description of Artificial Sequence: Synthetic coding sequence
atggccctgggcctgcagagagccagaagcaccaccgagctgagaaaggagaagagcagagacgccgccagaagcagaagaagccaggagaccgaggtgctgtaccagctggcccacaccctgcccttcgccagaggcgtgagcgcccacctggacaaggccagcatcatgagactgaccatcagctacctgagaatgcacagactgtgcgccgccggcgagtggaaccaggtgggcgccggcggcgagcccctggacgcctgctacctgaaggccctggagggcttcgtgatggtgctgaccgccgagggcgacatggcctacctgagcgagaacgtgagcaagcacctgggcctgagccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacacctgcatgtaccccatcagccccggcgccaagcccgccgccacctggccccccgccgacaccagaaccccccagctgcccatcccccaggacgccctgcccccccacctgaacaccagcagcctgctgcccaagccccagggcaccgtgagcttcctggcccccagctaccccgtgcccagatacttcagcccccacctgcccccctggtggccctag

SEQ ID NO: 84989 - DNA, 1839 bp, Artificial Sequence
  Description of Artificial Sequence: Synthetic coding sequence
atgctgcccatgcccagcggcagacccagaagctgcgccagaaagagccccggcatgagacccgccgccggcgccgccagaagacccagatgctgcaccagctggctgaccagatgccccagccccgccgccagcgcccccacctggaccagacccctgagctgcgccagccccagcgccacctgcgcctgcaccgccagcgccccccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccgacgacctgatcggctgcagcgcctacgagtacatccacgccctggacagcgacgccgtgagcaagagcatccacaccctgctgagcaagggccaggccgtgaccggccagtacagattcctggccagaagcggcggctacctgtggacccagacccaggccaccgtggtgagcggcggcagaggcccccagagcgagagcatcgtgtgcgtgcacttcctgatcagccaggtggaggagaccggcgtggtgctgagcctggagcagaccgagcagcacagcagaagacccatccagagaggcgcccccagccagaaggacacccccaaccccggcgacagcctggacacccccggccccagaatcctggccttcctgcacccccccagcctgagcgaggccgccctggccgccgaccccagaagattctgcagccccgacctgagaagactgctgggccccatcctggacggcgccagcgtggccgccacccccagcacccccctggccaccagacacccccagagccccctgagcgccgacctgcccgacgagctgcccgtgggcaccgagaacgtgcacagactgttcaccagcggcaaggacaccgaggccgtggagaccgacctggacatcgcccaggacgccgacgccctggacctggagatgctggccccctacatcagcatggacgacgacttccagctgaacgccagcgagcagctgcccagagcctaccacagacccctgggcgccgtgcccagacccagagccagaagcttccacggcctgagcccccccgccctggagcccagcctgctgcccagatggggcagcgaccccagactgagctgcagcagccccagcagaggcgaccccagcgccagcagccccatggccggcgccagaaagagaaccctggcccagagcagcgaggacgaggacgagggcgtggagctgctgggcgtgagaccccccaagagaagccccagccccgagcacgagaacttcctgctgttccccctgagcctgagcttcctgctgaccggcggccccgcccccggcagcctgcaggaccccagcacccccctgctgaacctgaacgagcccctgggcttccacttcgtgacccagagcggcgtgcagtggcacaagcacagcagcccccagcccagaccccccggcctgaagtag

SEQ ID NO: 84990 - DNA, 600 bp, Artificial Sequence
  Description of Artificial Sequence: Synthetic coding sequence
atgagacccgccgccggcgccgccagaagacccagatgctgcaccagctggctgaccagatgccccagccccgccgccagcgcccccacctggaccagacccctgagctgcgccagccccagcgccacctgcgcctgcaccgccagcgccccccagctggagctgatcggccacagcatcttcgacttcatccacccctgcgaccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagccccccctgggcagaggcgccttcctgagcagacacagcctggacatgaagttcacctactgcgacgacagaatcgccgaggtggccggctacagccccatgacctag

SEQ ID NO: 84991 - DNA, 714 bp, Artificial Sequence
  Description of Artificial Sequence: Synthetic coding sequence
atgagacccgccgccggcgccgccagaagacccagatgctgcaccagctggctgaccagatgccccagccccgccgccagcgcccccacctggaccagacccctgagctgcgccagccccagcgccacctgcgcctgcaccgccagcgccccccaggaggagctgcaggacgccctgaccccccagcagaccctgagcagaagaaaggtggaggcccccaccgagagatgcttcagcctgagaatgaagagcaccctgaccagcagaggcagaaccctgaacctgaaggccgccacctggaaggtgctgaactgcagcggccacatgagagcctacaagccccccgcccagaccagccccgccggcagccccgacagcgagccccccctgcagtgcctggtgctgatctgcgaggccatcccccaccccggcagcctggagagattcgtgcccgtgagcagcgccgccaccagcctgtgcctgcccagcctgagccccagcaaggtggccggctacagccccgacgacctgatcggctgcagcgcctacgagtacatccacgccctggacagcgacgccccccaggacgccctgcccccccacctgaacaccagcagcctgctgcccaagccccagggcaccgtgagcttcctggcccccagctaccccgtgcccagatacttcagcccccacctgcccccctggtggccctag

SEQ ID NO: 84992 - DNA, 1092 bp, Artificial Sequence; identical to SEQ ID NO: 84988
  Description of Artificial Sequence: Synthetic coding sequence

SEQ ID NO: 84993 - DNA, 2976 bp, Artificial Sequence
  Description of Artificial Sequence: Synthetic coding sequence
atggccgacaaggtgagaagacagagacccagaagaagagtgtgctgggccctggtggccgtgctgctggccgacctgctggccctgagcgacaccctggccgtgatgagcgtggacctgggcagcgagagcatgaaggtggccatcgtgctgaacaaggagagcagaagaaagacccccgtgatcgtgaccctgaaggagaacgagagattcttcggcgacagcgccgccagcatggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccgaggaggtgctgggcatggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcaggaggaggaggagagccccgccgagggcagcaaggacgagcccggcgagcaggtggagctgaaggaggaggccgaggcccccgtggaggacggcagccagccccccccccccgagcccaagggcgacgccacccccgagggcgagaaggccaccgagaaggagaacggcgacaagagcgaggcccagaagcccagcgagaaggccgaggccggccccgagggcgtggcccccgcccccgagggcgagaagaagcagaagcccgccagaaagagaagaatggtggaggagatcggcgtggagctggtggtgctggacctgcccgacctgcccgaggacaagctggcccagagcgtgcagaagctgcaggacctgaccctgagagacctggagaagcaggagagagagaaggccgccaacagcctggaggccttcatcttcgagacccaggacaagctgtaccagcccgagtaccaggaggtgagcaccgaggagcagagagaggagatcagcggcaagctgagcgccgccagcacctggctggaggacgagggcgtgggcgccaccaccgtgatgctgaaggagaagctggccgagctgagaaagctgtgccagggcctgttcttcagagtggaggagagaaagaagtggcccgagagactgagcgccctggacaacctgctgaaccacagcagcatgttcctgaagggcgccagactgatccccgagatggaccagatcttcaccgaggtggagatgaccaccctggagaaggtgatcaacgagacctgggcctggaagaacgccaccctggccgagcaggccaagctgcccgccaccgagaagcccgtgctgctgagcaaggacatcgaggccaagatgatggccctggacagagaggtgcagtacctgctgaacaaggccaagttcaccaagcccagacccagacccaaggacaagaacggcaccagagccgagccccccctgaacgccagcgccagcgaccagggcgagaaggtgatcccccccgccggccagaccgaggacgccgagcccatcagcgagcccgagaaggtggagaccgccggcagcgagcccggcgacaccgagcccctggagctgggcggccccggcgccgagcccgagcagaaggagcagagcaccggccagaagagacccctgaagaacgacgagctgtag

SEQ ID NO: 84994 - DNA, 3000 bp, Artificial Sequence
  Description of Artificial Sequence: Synthetic coding sequence
atggccgacaaggtgagaagacagagacccagaagaagagtgtgctgggccctggtggccgtgctgctggccgacctgctggccctgagcgacaccctggccgtgatgagcgtggacctgggcagcgagagcatgaaggtggccatcgtgaagcccggcgtgcccatggagatcgtgctgaacaaggagagcagaagaaagacccccgtgatcgtgaccctgaaggagaacgagagattcttcggcgacagcgccgccagcatggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccgaggaggtgctgggcatggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcaggaggaggaggagagccccgccgagggcagcaaggacgagcccggcgagcaggtggagctgaaggaggaggccgaggcccccgtggaggacggcagccagccccccccccccgagcccaagggcgacgccacccccgagggcgagaaggccaccgagaaggagaacggcgacaagagcgaggcccagaagcccagcgagaaggccgaggccggccccgagggcgtggcccccgcccccgagggcgagaagaagcagaagcccgccagaaagagaagaatggtggaggagatcggcgtggagctggtggtgctggacctgcccgacctgcccgaggacaagctggcccagagcgtgcagaagctgcaggacctgaccctgagagacctggagaagcaggagagagagaaggccgccaacagcctggaggccttcatcttcgagacccaggacaagctgtaccagcccgagtaccaggaggtgagcaccgaggagcagagagaggagatcagcggcaagctgagcgccgccagcacctggctggaggacgagggcgtgggcgccaccaccgtgatgctgaaggagaagctggccgagctgagaaagctgtgccagggcctgttcttcagagtggaggagagaaagaagtggcccgagagactgagcgccctggacaacctgctgaaccacagcagcatgttcctgaagggcgccagactgatccccgagatggaccagatcttcaccgaggtggagatgaccaccctggagaaggtgatcaacgagacctgggcctggaagaacgccaccctggccgagcaggccaagctgcccgccaccgagaagcccgtgctgctgagcaaggacatcgaggccaagatgatggccctggacagagaggtgcagtacctgctgaacaaggccaagttcaccaagcccagacccagacccaaggacaagaacggcaccagagccgagccccccctgaacgccagcgccagcgaccagggcgagaaggtgatcccccccgccggccagaccgaggacgccgagcccatcagcgagcccgagaaggtggagaccggcagcgagcccggcgacaccgagcccctggagctgggcggccccggcgccgagcccgagcagaaggagcagagcaccggccagaagagacccctgaagaacgacgagctgtag

SEQ ID NO: 84995 - DNA, 2547 bp, Artificial Sequence
  Description of Artificial Sequence: Synthetic coding sequence
atggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcaggaggaggaggagagccccgccgagggcagcaaggacgagcccggcgagcaggtggagctgaaggaggaggccgaggcccccgtggaggacggcagccagccccccccccccgagcccaagggcgacgccacccccgagggcgagaaggccaccgagaaggagaacggcgacaagagcgaggcccagaagcccagcgagaaggccgaggccggccccgagggcgtggcccccgcccccgagggcgagaagaagcagaagcccgccagaaagagaagaatggtggaggagatcggcgtggagctggtggtgctggacctgcccgacctgcccgaggacaagctggcccagagcgtgcagaagctgcaggacctgaccctgagagacctggagaagcaggagagagagaaggccgccaacagcctggaggccttcatcttcgagacccaggacaagctgtaccagcccgagtaccaggaggtgagcaccgaggagcagagagaggagatcagcggcaagctgagcgccgccagcacctggctggaggacgagggcgtgggcgccaccaccgtgatgctgaaggagaagctggccgagctgagaaagctgtgccagggcctgttcttcagagtggaggagagaaagaagtggcccgagagactgagcgccctggacaacctgctgaaccacagcagcatgttcctgaagggcgccagactgatccccgagatggaccagatcttcaccgaggtggagatgaccaccctggagaaggtgatcaacgagacctgggcctggaagaacgccaccctggccgagcaggccaagctgcccgccaccgagaagcccgtgctgctgagcaaggacatcgaggccaagatgatggccctggacagagaggtgcagtacctgctgaacaaggccaagttcaccaagcccagacccagacccaaggacaagaacggcaccagagccgagccccccctgaacgccagcgccagcgaccagggcgagaaggtgatcccccccgccggccagaccgaggacgccgagcccatcagcgagcccgagaaggtggagaccggcagcgagcccggcgacaccgagcccctggagctgggcggccccggcgccgagcccgagcagaaggagcagagcaccggccagaagagacccctgaagaacgacgagctgtag

SEQ ID NO: 84996 - DNA, 2040 bp, Artificial Sequence
  Description of Artificial Sequence: Synthetic coding sequence
atggccgacaaggtgagaagacagagacccagaagaagagtgtgctgggccctggtggccgtgctgctggccgacctgctggccctgagcgacaccctggccgtgatgagcgtggacctgggcagcgagagcatgaaggtggccatcgtgaagcccggcgtgcccatggagatcgtgctgaacaaggagagcagaagaaagacccccgtgatcgtgaccctgaaggagaacgagagattcttcggcgacagcgccgccagcatggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccgaggaggtgctgggcatggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcaggaggaggaggagagccccgccgagggcagcaaggacgagcccggcgagcaggtggagctgaaggaggaggccgaggcccccgtggaggacggcagccagccccccccccccgagcccaagggcgacgccacccccgagggcgagaaggccaccgagaaggagaacggcgacaagagcgaggcccagaagcccaccagcgtgtgcagagccagcgtgaccagattcggcttctag

SEQ ID NO: 84997 - DNA, 444 bp, Artificial Sequence
  Description of Artificial Sequence: Synthetic coding sequence
atggccgacaaggtgagaagacagagacccagaagaagagtgtgctgggccctggtggccgtgctgctggccgacctgctggccctgagcgacaccctggccgtgatgagcgtggacctgggcagcgagagcatgaaggtggccatcgtgaagcccggcgtgcccatggagatcgtgctgaacaaggagagcagaagaaagacccccgtgatcgtgaccctgaaggagaacgagagattcttcggcgacagcgccgccagcatggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccctgtag

SEQ ID NO: 84998 - DNA, 1680 bp, Artificial Sequence
  Description of Artificial Sequence: Synthetic coding sequence
atggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccgaggaggtgctgggcatggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcagatgctgttcctgtgccccgccagactgccccagagcaagcaggccatcgacagattccacaccgccgtgacctgcatggagcccccctggggcagaagatgcagagccagacccgcctggagactgtgcagctag

SEQ ID NO: 84999 - DNA, 2943 bp, Artificial Sequence
  Description of Artificial Sequence: Synthetic coding sequence
atgtggcagagcagaggccccatgctgttccacctgggcctgtgcgtgggcgccgccggcatgatcagagagtggttcgtgcccatcagaagagagaagggcagcagactgatctgccccggcggcaccatggccgacaaggtgagaagacagagacccagaagaagagtgtgctgggccctggtggccgtgctgctggccgacctgctggccctgagcgacaccctggccgtgatgagcgtggacctgggcagcgagagcatgaaggtggccatcgtgaagcccggcgtgcccatggagatcgtgctgaacaaggagagcagaagaaagacccccgtgatcgtgaccctgaaggagaacgagagattcttcggcgacagcgccgccagcatggccatcaagaaccccaaggccaccctgagatacttccagcacctgctgggcaagcaggccgacaacccccacgtggccctgtaccaggccagattccccgagcacgagctgaccttcgacccccagagacagaccgtgcacttccagatcagcagccagctgcagttcagccccgaggaggtgctgggcatggtgctgaactacagcagaagcctggccgaggacttcgccgagcagcccatcaaggacgccgtgatcaccgtgcccgtgttcttcaaccaggccgagagaagagccgtgctgcaggccgccagaatggccggcctgaaggtgctgcagctgatcaacgacaacaccgccaccgccctgagctacggcgtgttcagaagaaaggacatcaacaccaccgcccagaacatcatgttctacgacatgggcagcggcagcaccgtgtgcaccatcgtgacctaccagatggtgaagaccaaggaggccggcatgcagccccagctgcagatcagaggcgtgggcttcgacagaaccctgggcggcctggagatggagctgagactgagagagagactggccggcctgttcaacgagcagagaaagggccagagagccaaggacgtgagagagaaccccagagccatggccaagctgctgagagaggccaacagactgaagaccgtgctgagcgccaacgccgaccacatggcccagatcgagggcctgatggacgacgtggacttcaaggccaaggtgaccagagtggagttcgaggagctgtgcgccgacctgttcgagagagtgcccggccccgtgcagcaggccctgcagagcgccgagatgagcctggacgagatcgagcaggtgatcctggtgggcggcgccaccagagtgcccagagtgcaggaggtgctgctgaaggccgtgggcaaggaggagctgggcaagaacatcaacgccgacgaggccgccgccatgggcgccgtgtaccaggccgccgccctgagcaaggccttcaaggtgaagcccttcgtggtgagagacgccgtggtgtaccccatcctggtggagttcaccagagaggtggaggaggagcccggcatccacagcctgaagcacaacaagagagtgctgttcagcagaatgggcccctacccccagagaaaggtgatcaccttcaacagatacagccacgacttcaacttccacatcaactacggcgacctgggcttcctgggccccgaggacctgagagtgttcggcagccagaacctgaccaccgtgaagctgaagggcgtgggcgacagcttcaagaagtaccccgactacgagagcaagggcatcaaggcccacttcaacctggacgagagcggcgtgctgagcctggacagagtggagagcgtgttcgagaccctggtggaggacagcgccgaggaggagagcaccctgaccaagctgggcaacaccatcagcagcctgttcggcggcggcaccacccccgacgccaaggagaacggcaccgacaccgtgcagaagcccagcgagaaggccgaggccggccccgagggcgtggcccccgcccccgagggcgagaagaagcagaagcccgccagaaagagaagaatggtggaggagatcggcgtggagctggtggtgctggacctgcccgacctgcccgaggacaagctggcccagagcgtgcagaagctgcaggacctgaccctgagagacctggagaagcaggagagagagaaggccgccaacagcctggaggccttcatcttcgagacccaggacaagctgtaccagcccgagtaccaggaggtgagcaccgaggagcagagagaggagatcagcggcaagctgagcgccgccagcacctggctggaggacgagggcgtgggcgccaccaccgtgatgctgaaggagaagctggccgagctgagaaagctgtgccagggcctgttcttcagagtggaggagagaaagaagtggcccgagagactgagcgccctggacaacctgctgaaccacagcagcatgttcctgaagggcgccagactgatccccgagatggaccagatcttcaccgaggtggagatgaccaccctggagaaggtgatcaacgagacctgggcctggaagaacgccaccctggccgagcaggccaagctgcccgccaccgagaagcccgtgctgctgagcaaggacatcgaggccaagatgatggccctggacagagaggtgcagtacctgctgaacaaggccaagttcaccaagcccagacccagacccaaggacaagaacggcaccagagccgagccccccctgaacgccagcgccagcgaccagggcgagaaggtgatcccccccgccggccagaccgaggacgccgagcccatcagcgagcccgagaaggtggagaccggcagcgagcccggcgacaccgagcccctggagctgggcggccccggcgccgagcccgagcagaaggagcagagcaccggccagaagagacccctgaagaacgacgagctgtag

SEQ ID NO: 85000 - DNA, 333 bp, Artificial Sequence
  Description of Artificial Sequence: Synthetic coding sequence
atggcccccagaggctgcatcgtggccgtgttcgccatcttctgcatcagcagactgctgtgcagccacggcgcccccgtggcccccatgaccccctacctgatgctgtgccagccccacaagagatgcggcgacaagttctacgaccccctgcagcactgctgctacgacgacgccgtggtgcccctggccagaacccagacctgcggcaactgcaccttcagagtgtgcttcgagcagtgctgcccctggaccttcatggtgaagctgatcaaccagaactgcgacagcgccagaaccagcgacgacagactgtgcagaagcgtgagctag

SEQ ID NO: 85001 - DNA, 360 bp, Artificial Sequence
  Description of Artificial Sequence: Synthetic coding sequence
atggtgcccagaatcttcgcccccgcctacgtgagcgtgtgcctgctgctgctgtgccccagagaggtgatcgcccccgccggcagcgagccctggctgtgccagcccgcccccagatgcggcgacaagatctacaaccccctggagcagtgctgctacaacgacgccatcgtgagcctgagcgagaccagacagtgcggccccccctgcaccttctggccctgcttcgagctgtgctgcctggacagcttcggcctgaccaacgacttcgtggtgaagctgaaggtgcagggcgtgaacagccagtgccacagcagccccatcagcagcaagtgcgagagcagaagaagattcccctag

SEQ ID NO: 85002 - DNA, 393 bp, Artificial Sequence
  Description of Artificial Sequence: Synthetic coding sequence
atgagattcagcgtgagcggcatgagaaccgactaccccagaagcgtgctggcccccgcctacgtgagcgtgtgcctgctgctgctgtgccccagagaggtgatcgcccccgccggcagcgagccctggctgtgccagcccgcccccagatgcggcgacaagatctacaaccccctggagcagtgctgctacaacgacgccatcgtgagcctgagcgagaccagacagtgcggccccccctgcaccttctggccctgcttcgagctgtgctgcctggacagcttcggcctgaccaacgacttcgtggtgaagctgaaggtgcagggcgtgaacagccagtgccacagcagccccatcagcagcaagtgcgagagcagaagaagattcccctag

SEQ ID NO: 85003 - DNA, 378 bp, Artificial Sequence
  Description of Artificial Sequence: Synthetic coding sequence
atgagacccagatgctgcatcctggccctggtgtgctggatcaccgtgttcctgctgcagtgcagcaagggcaccaccgacgcccccgtgggcagcggcctgtggctgtgccagcccacccccagatgcggcaacaagatctacaaccccagcgagcagtgctgctacgacgacgccatcctgagcctgaaggagaccagaagatgcggcagcacctgcaccttctggccctgcttcgagctgtgctgccccgagagcttcggcccccagcagaagttcctggtgaagctgagagtgctgggcatgaagagccagtgccacctgagccccatcagcagaagctgcaccagaaacagaagacacgtgctgtacccctag

SEQ ID NO: 85004 - DNA, 375 bp, Artificial Sequence
  Description of Artificial Sequence: Synthetic coding sequence
atggtgcccagaatcagcgccgccatcttcatcttcgagctgctgggcagcaacagcgagggcgtgaccgacctgagactgtggctgtgccagcccgcccccagatgcggcgagtggacctacaaccccctggagcagtgctgcgacgacggcgtgatcctggacctgaaccagaccagactgtgcggcagcagctgcaccttctggccctgcttccagcactgctgcctggagagcctgggcagccagaaccagaccgtggtgagattcaaggtgcccggcatgaagcccgactgcaagagcagccccatcaccagaatctgcgcccaggagtaccaccccaagagccccgtgagcagaagcgacctgatctag

SEQ ID NO: 85005 - DNA, 1068 bp, Artificial Sequence
  Description of Artificial Sequence: Synthetic coding sequence
atgggccccggcagatgcctgctgaccgccctgctgctgctggccctggcccccccccccgaggccagccagtactgcggcagactggagtactggaaccccgacaacaagtgctgcagcagctgcctgcagagattcggcccccccccctgccccgactacgagttcagagagaactgcggcctgaacgaccacggcgacttcgtgaccccccccttcagaaagtgcagcagcggccagtgcaaccccgacggcgccgagctgtgcagcccctgcggcggcggcgccgtgacccccacccccgccgccggcggcggcagaaccccctggagatgcagagagagacccgtgcccgccaagggccactgccccctgacccccggcaaccccggcgcccccagcagccaggagagaagcagccccgccagcagcatcgcctggagaacccccgagcccgtgccccagcaggcctggcccaacttcctgcccctggtggtgctggtgctgctgctgaccctggccgtgatcgccatcctgctgttcatcctgctgtggcacctgtgctggcccaaggagaaggccgacccctacccctaccccggcctggtgtgcggcgtgcccaacacccacacccccagcagcagccacctgagcagccccggcgccctggagaccggcgacacctggaaggaggccagcctgctgcccctgctgagcagagagctgagcagcctggccagccagcccctgagcagactgctggacgagctggaggtgctggaggagctgatcgtgctgctggaccccgagcccggccccggcggcggcatggcccacggcaccaccagacacctggccgccagatacggcctgcccgccgcctggagcaccttcgcctacagcctgagacccagcagaagccccctgagagccctgatcgagatggtggtggccagagagcccagcgccagcctgggccagctgggcacccacctggcccagctgggcagagccgacgccctgagagtgctgagcaagctgggcagcagcggcgtgtgctgggcctag

SEQ ID NO: 85006 - DNA, 504 bp, Artificial Sequence
  Description of Artificial Sequence: Synthetic coding sequence
atgggccccggcagatgcctgctgaccgccctgctgctgctggccctggcccccccccccgaggccagccagtactgcggcagactggagtactggaaccccgacaacaagtgctgcagcagctgcctgcagagattcggcccccccccctgccccgagctgagcagcctggccagccagcccctgagcagactgctggacgagctggaggtgctggaggagctgatcgtgctgctggaccccgagcccggccccggcggcggcatggcccacggcaccaccagacacctggccgccagatacggcctgcccgccgcctggagcaccttcgcctacagcctgagacccagcagaagccccctgagagccctgatcgagatggtggtggccagagagcccagcgccagcctgggccagctgggcacccacctggcccagctgggcagagccgacgccctgagagtgctgagcaagctgggcagcagcggcgtgtgctgggcctag

SEQ ID NO: 85007 - DNA, 723 bp, Artificial Sequence
  Description of Artificial Sequence: Synthetic coding sequence
atgcccgagagagacagcgagcccttcagcaaccccctggcccccgacggccacgacgtggacgacccccacagcttccaccagagcaagctgaccaacgaggacttcagaaagctgctgatgacccccagagccgcccccaccagcgccccccccagcaagagcagacaccacgagatgcccagagagtacaacgaggacgaggaccccgccgccagaagaagaaagaagaagagctactacgccaagctgagacagcaggagatcgagagagagagagagctggccgagaagtacagagacagagccaaggagagaagagacggcgtgaacaaggactacgaggagaccgagctgatcagcaccaccgccaactacagagccgtgggccccaccgccgaggccgacaagagcgccgccgagaagagaagacagctgatccaggagagcaagttcctgggcggcgacatggagcacacccacctggtgaagggcctggacttcgccctgctgcagaaggtgagagccgagatcgccagcaaggagaaggaggaggaggagctgatggagaagccccagaaggagaccaagaaggacgaggaccccgagaacaagatcgagttcaagaccagactgggcagaaacgtgtacagaatgctgttcaagagcaaggcctacgagagaaacgagctgttcctgcccggcagaatggccatgtggtag

SEQ ID NO: 85008 - DNA, 1674 bp, Artificial Sequence
  Description of Artificial Sequence: Synthetic coding sequence
atgcccgagagagacagcgagcccttcagcaaccccctggcccccgacggccacgacgtggacgacccccacagcttccaccagagcaagctgaccaacgaggacttcagaaagctgctgatgacccccagagccgcccccaccagcgccccccccagcaagagcagacaccacgagatgcccagagagtacaacgaggacgaggaccccgccgccagaagaagaaagaagaagagctactacgccaagctgagacagcaggagatcgagagagagagagagctggccgagaagtacagagacagagccaaggagagaagagacggcgtgaacaaggactacgaggagaccgagctgatcagcaccaccgccaactacagagccgtgggccccaccgccgaggccgacaagagcgccgccgagaagagaagacagctgatccaggagagcaagttcctgggcggcgacatggagcacacccacctggtgaagggcctggacttcgccctgctgcagaaggtgagagccgagatcgccagcaaggagaaggaggaggaggagctgatggagaagccccagaaggagaccaagaaggacgaggaccccgagaacaagatcgagttcaagaccagactgggcagaaacgtgtacagaatgctgttcaagagcaaggcctacgagagaaacgagctgttcctgcccggcagaatggcctacgtggtggacctggacgacgagtacgccgacaccgacatccccaccaccctgatcagaagcaaggccgactgccccaccatggaggcccagaccaccctgaccaccaacgacatcgtgatcagcaagctgacccagatcctgagctacctgagacagggcaccagaaacaagaagctgaagaagaaggacaagggcaagctggaggagaagaagccccccgaggccgacatgaacatcttcgaggacatcggcgactacgtgcccagcaccaccaagacccccagagacaaggagagagagagatacagagagagagagagagacagagagagagacagagacagagacagagagagagagagagagagagacagagagagagagagagagagagacagagagagagaggaggagaagaagagacacagctacttcgagaagcccaaggtggacgacgagcccatggacgtggacaagggccccggcagcaccaaggagctgatcaagagcatcaacgagaagttcgccggcagcgccggctgggagggcaccgagagcctgaagaagcccgaggacaagaagcagctgggcgacttcttcggcatgagcaacagctacgccgagtgctaccccgccaccatggacgacatggccgtggacagcgacgaggaggtggactacagcaagatggaccagggcaacaagaagggccccctgggcagatgggacttcgacacccaggaggagtacagcgagtacatgaacaacaaggaggccctgcccaaggccgccttccagtacggcatcaagatgagcgagggcagaaagaccagaagattcaaggagaccaacgacaaggccgagctggacagacagtggaagaagatcagcgccatcatcgagaagagaaagaagatggaggccgacggcgtggaggtgaagagacccaagtactag

SEQ ID NO: 85009 - DNA, 1560 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtggccagcaacgtgaaggtggagacccagagcgacgaggagaacggcagagcctgcgagatgaacggcgaggagtgcgccgaggacctgagaatgctggacgccagcggcgagaagatgaacggcagccacagagaccagggcagcagcgccctgagcggcgtgggcggcatcagactgcccaacggcaagctgaagtgcgacatctgcggcatcatctgcatcggccccaacgtgctgatggtgcacaagagaagccacaccggcgagagacccttccagtgcaaccagtgcggcgccagcttcacccagaagggcaacctgctgagacacatcaagctgcacagcggcgagaagcccttcaagtgccacctgtgcaactacgcctgcagaagaagagacgccctgaccggccacctgagaacccacagcgtgggcaagccccacaagtgcggctactgcggcagaagctacaagcagagaagcagcctggaggagcacaaggagagatgccacaactacctggagagcatgggcctgcccggcaccctgtaccccgtgatcaaggaggagaccaaccacagcgagatggccgaggacctgtgcaagatcggcagcgagagaagcctggtgctggacagactggccagcaacgtggccaagagaaagagcagcatgccccagaagttcctgggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85010 - DNA, 1299 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtgggcgagagacccttccagtgcaaccagtgcggcgccagcttcacccagaagggcaacctgctgagacacatcaagctgcacagcggcgagaagcccttcaagtgccacctgtgcaactacgcctgcagaagaagagacgccctgaccggccacctgagaacccacagcgtgggcaagccccacaagtgcggctactgcggcagaagctacaagcagagaagcagcctggaggagcacaaggagagatgccacaactacctggagagcatgggcctgcccggcaccctgtaccccgtgatcaaggaggagaccaaccacagcgagatggccgaggacctgtgcaagatcggcagcgagagaagcctggtgctggacagactggccagcaacgtggccaagagaaagagcagcatgccccagaagttcctgggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85011 - DNA, 870 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtgggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85012 - DNA, 1131 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtggccagcaacgtgaaggtggagacccagagcgacgaggagaacggcagagcctgcgagatgaacggcgaggagtgcgccgaggacctgagaatgctggacgccagcggcgagaagatgaacggcagccacagagaccagggcagcagcgccctgagcggcgtgggcggcatcagactgcccaacggcaagctgaagtgcgacatctgcggcatcatctgcatcggccccaacgtgctgatggtgcacaagagaagccacaccggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85013 - DNA, 1299 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtggccagcaacgtgaaggtggagacccagagcgacgaggagaacggcagagcctgcgagatgaacggcgaggagtgcgccgaggacctgagaatgctggacgccagcggcgagaagatgaacggcagccacagagaccagggcagcagcgccctgagcggcgtgggcggcatcagactgcccaacggcaagctgaagtgcgacatctgcggcatcatctgcatcggccccaacgtgctgatggtgcacaagagaagccacaccggcgagagacccttccagtgcaaccagtgcggcgccagcttcacccagaagggcaacctgctgagacacatcaagctgcacagcggcgagaagcccttcaagtgccacctgtgcaactacgcctgcagaagaagagacgccctgaccggccacctgagaacccacagcggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85014 - DNA, 1434 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtggccagcaacgtgaaggtggagacccagagcgacgaggagaacggcagagcctgcgagatgaacggcgaggagtgcgccgaggacctgagaatgctggacgccagcggcgagaagatgaacggcagccacagagaccagggcagcagcgccctgagcggcgtgggcggcatcagactgcccaacggcaagctgaagtgcgacatctgcggcatcatctgcatcggccccaacgtgctgatggtgcacaagagaagccacaccggcgagagacccttccagtgcaaccagtgcggcgccagcttcacccagaagggcaacctgctgagacacatcaagctgcacagcggcgagaagcccttcaagtgccacctgtgcaactacgcctgcagaagaagagacgccctgaccggccacctgagaacccacagcgtgatcaaggaggagaccaaccacagcgagatggccgaggacctgtgcaagatcggcagcgagagaagcctggtgctggacagactggccagcaacgtggccaagagaaagagcagcatgccccagaagttcctgggcgacaagggcctgagcgacaccccctacgacagcagcgccagctacgagaaggagaacgagatgatgaagagccacgtgatggaccaggccatcaacaacgccatcaactacctgggcgccgagagcctgagacccctggtgcagaccccccccggcggcagcgaggtggtgcccgtgatcagccccatgtaccagctgcacaagcccctggccgagggcacccccagaagcaaccacagcgcccaggacagcgccgtggagaacctgctgctgctgagcaaggccaagctggtgcccagcgagagagaggccagccccagcaacagctgccaggacagcaccgacaccgagagcaacaacgaggagcagagaagcggcctgatctacctgaccaaccacatcgccccccacgccagaaacggcctgagcctgaaggaggagcacagagcctacgacctgctgagagccgccagcgagaacagccaggacgccctgagagtggtgagcaccagcggcgagcagatgaaggtgtacaagtgcgagcactgcagagtgctgttcctggaccacgtgatgtacaccatccacatgggctgccacggcttcagagaccccttcgagtgcaacatgtgcggctaccacagccaggacagatacgagttcagcagccacatcaccagaggcgagcacagattccacatgagctag

SEQ ID NO: 85015 - DNA, 1299 bp, Artificial Sequence; identical to SEQ ID NO: 85010
  Description of Artificial Sequence: Synthetic coding sequence

SEQ ID NO: 85016 - DNA, 1434 bp, Artificial Sequence; identical to SEQ ID NO: 85014
  Description of Artificial Sequence: Synthetic coding sequence

SEQ ID NO: 85017 - DNA, 681 bp, Artificial Sequence
  Description of Artificial Sequence: Synthetic coding sequence
atggacgccgacgagggccaggacatgagccaggtgagcggcaaggagagcccccccgtgagcgacacccccgacgagggcgacgagcccatgcccatccccgaggacctgagcaccaccagcggcggccagcagagcagcaagagcgacagagtggtggccagcaacgtgaaggtggagacccagagcgacgaggagaacggcagagcctgcgagatgaacggcgaggagtgcgccgaggacctgagaatgctggacgccagcggcgagaagatgaacggcagccacagagaccagggcagcagcgccctgagcggcgtgggcggcatcagactgcccaacggcaagctgaagtgcgacatctgcggcatcatctgcatcggccccaacgtgctgatggtgcacaagagaagccacaccggcgagagacccttccagtgcaaccagtgcggcgccagcttcacccagaagggcaacctgctgagacacatcaagctgcacagcggcgagaagcccttcaagtgccacctgtgcaactacgcctgcagaagaagagacgccctgaccggccacctgagaacccacagcgtgatcaaggaggagaccaaccacagcgagatggccgaggacctgtgcaagatcggcagcgagatcagcagagccggccagaccagcaagtag

SEQ ID NO: 85018 - DNA, 1758 bp, Artificial Sequence
  Description of Artificial Sequence: Synthetic coding sequence
atgcacaccccccccgccctgcccagaagattccagggcggcggcagagtgagaacccccggcagccacagacagggcaaggacaacctggagagagaccccagcggcggctgcgtgcccgacttcctgccccaggcccaggacagcaaccacttcatcatggagagcctgttctgcgagagcagcggcgacagcagcctggagaaggagttcctgggcgcccccgtgggccccagcgtgagcacccccaacagccagcacagcagccccagcagaagcctgagcgccaacagcatcaaggtggagatgtacagcgacgaggagagcagcagactgctgggccccgacgagagactgctggagaaggacgacagcgtgatcgtggaggacagcctgagcgagcccctgggctactgcgacggcagcggccccgagccccacagccccggcggcatcagactgcccaacggcaagctgaagtgcgacgtgtgcggcatggtgtgcatcggccccaacgtgctgatggtgcacaagagaagccacaccggcgagagacccttccactgcaaccagtgcggcgccagcttcacccagaagggcaacctgctgagacacatcaagctgcacagcggcgagaagcccttcaagtgccccttctgcaactacgcctgcagaagaagagacgccctgaccggccacctgagaacccacagcgtgagcagccccaccgtgggcaagccctacaagtgcaactactgcggcagaagctacaagcagcagagcaccctggaggagcacaaggagagatgccacaactacctgcagagcctgagcaccgaggcccaggccctggccggccagcccggcgacgagatcagagacctggagatggtgcccgacagcatgctgcacagcagcagcgagagacccaccttcatcgacagactggccaacagcctgaccaagagaaagagaagcaccccccagaagttcgtgggcgagaagcagatgagattcagcctgagcgacctgccctacgacgtgaacagcggcggctacgagaaggacgtggagctggtggcccaccacagcctggagcccggcttcggcagcagcctggccttcgtgggcgccgagcacctgagacccctgagactgccccccaccaactgcatcagcgagctgacccccgtgatcagcagcgtgtacacccagatgcagcccctgcccggcagactggagctgcccggcagcagagaggccggcgagggccccgaggacctggccgacggcggccccctgctgtacagacccagaggccccctgaccgaccccggcgccagccccagcaacggctgccaggacagcaccgacaccgagagcaaccacgaggacagagtggccggcgtggtgagcctgccccagggcccccccccccagcccccccccaccatcgtggtgggcagacacagccccgcctacgccaaggaggaccccaagccccaggagggcctgctgagaggcacccccggccccagcaaggaggtgctgagagtggtgggcgagagcggcgagcccgtgaaggccttcaagtgcgagcactgcagaatcctgttcctggaccacgtgatgttcaccatccacatgggctgccacggcttcagagaccccttcgagtgcaacatctgcggctaccacagccaggacagatacgagttcagcagccacatcgtgagaggcgagcacaaggtgggctag

SEQ ID NO: 85019 - DNA, 1452 bp, Artificial Sequence
  Description of Artificial Sequence: Synthetic coding sequence
atgtacagcgacgaggagagcagcagactgctgggccccgacgagagactgctggagaaggacgacagcgtgatcgtggaggacagcctgagcgagcccctgggctactgcgacggcagcggccccgagccccacagccccggcggcatcagactgcccaacggcaagctgaagtgcgacgtgtgcggcatggtgtgcatcggccccaacgtgctgatggtgcacaagagaagccacaccggcgagagacccttccactgcaaccagtgcggcgccagcttcacccagaagggcaacctgctgagacacatcaagctgcacagcggcgagaagcccttcaagtgccccttctgcaactacgcctgcagaagaagagacgccctgaccggccacctgagaacccacagcgtgagcagccccaccgtgggcaagccctacaagtgcaactactgcggcagaagctacaagcagcagagcaccctggaggagcacaaggagagatgccacaactacctgcagagcctgagcaccgaggcccaggccctggccggccagcccggcgacgagatcagagacctggagatggtgcccgacagcatgctgcacagcagcagcgagagacccaccttcatcgacagactggccaacagcctgaccaagagaaagagaagcaccccccagaagttcgtgggcgagaagcagatgagattcagcctgagcgacctgccctacgacgtgaacagcggcggctacgagaaggacgtggagctggtggcccaccacagcctggagcccggcttcggcagcagcctggccttcgtgggcgccgagcacctgagacccctgagactgccccccaccaactgcatcagcgagctgacccccgtgatcagcagcgtgtacacccagatgcagcccctgcccggcagactggagctgcccggcagcagagaggccggcgagggccccgaggacctggccgacggcggccccctgctgtacagacccagaggccccctgaccgaccccggcgccagccccagcaacggctgccaggacagcaccgacaccgagagcaaccacgaggacagagtggccggcgtggtgagcctgccccagggcccccccccccagcccccccccaccatcgtggtgggcagacacagccccgcctacgccaaggaggaccccaagccccaggagggcctgctgagaggcacccccggccccagcaaggaggtgctgagagtggtgggcgagagcggcgagcccgtgaaggccttcaagtgcgagcactgcagaatcctgttcctggaccacgtgatgttcaccatccacatgggctgccacggcttcagagaccccttcgagtgcaacatctgcggctaccacagccaggacagatacgagttcagcagccacatcgtgagaggcgagcacaaggtgggctag

SEQ ID NO: 85020 - DNA, 1758 bp, Artificial Sequence; identical to SEQ ID NO: 85018
  Description of Artificial Sequence: Synthetic coding sequence

SEQ ID NO: 85021 - DNA, 33 bp, Artificial Sequence
  Description of Artificial Sequence: Synthetic coding sequence
atgcacaccccccccgccctgcccagaagatag

SEQ ID NO: 85022 - DNA, 1863 bp, Artificial Sequence
  Description of Artificial Sequence: Synthetic coding sequence
atgaacaacttcatcctgctggaggagcagctgatcaagaagagccagcagaagagaagaaccagccccagcaacttcaaggtgagattcttcgtgctgaccaaggccagcctggcctacttcgaggacagacacggcaagaagagaaccctgaagggcagcatcgagctgagcagaatcaagtgcgtggagatcgtgaagagcgacatcagcatcccctgccactacaagtaccccttccaggtggtgcacgacaactacctgctgtacgtgttcgcccccgacagagagagcagacagagatgggtgctggccctgaaggaggagaccagaaacaacaacagcctggtgcccaagtaccaccccaacttctggatggacggcaagtggagatgctgcagccagctggagaagctggccaccggctgcgcccagtacgaccccaccaagaacgccagcaagaagcccctgccccccacccccgaggacaacagaagacccctgtgggagcccgaggagaccgtggtgatcgccctgtacgactaccagaccaacgacccccaggagctggccctgagaagaaacgaggagtactgcctgctggacagcagcgagatccactggtggagagtgcaggacagaaacggccacgagggctacgtgcccagcagctacctggtggagaagagccccaacaacctggagacctacgagtggtacaacaagagcatcagcagagacaaggccgagaagctgctgctggacaccggcaaggagggcgccttcatggtgagagacagcagaaccgccggcacctacaccgtgagcgtgttcaccaaggccgtggtgagcgagaacaacccctgcatcaagcactaccacatcaaggagaccaacgacaaccccaagagatactacgtggccgagaagtacgtgttcgacagcatccccctgctgatcaactaccaccagcacaacggcggcggcctggtgaccagactgagataccccgtgtgcttcggcagacagaaggcccccgtgaccgccggcctgagatacggcaagtgggtgatcgaccccagcgagctgaccttcgtgcaggagatcggcagcggccagttcggcctggtgcacctgggctactggctgaacaaggacaaggtggccatcaagaccatcagagagggcgccatgagcgaggaggacttcatcgaggaggccgaggtgatgatgaagctgagccaccccaagctggtgcagctgtacggcgtgtgcctggagcaggcccccatctgcctggtgttcgagttcatggagcacggctgcctgagcgactacctgagaacccagagaggcctgttcgccgccgagaccctgctgggcatgtgcctggacgtgtgcgagggcatggcctacctggaggaggcctgcgtgatccacagagacctggccgccagaaactgcctggtgggcgagaaccaggtgatcaaggtgagcgacttcggcatgaccagattcgtgctggacgaccagtacaccagcagcaccggcaccaagttccccgtgaagtgggccagccccgaggtgttcagcttcagcagatacagcagcaagagcgacgtgtggagcttcggcgtgctgatgtgggaggtgttcagcgagggcaagatcccctacgagaacagaagcaacagcgaggtggtggaggacatcagcaccggcttcagactgtacaagcccagactggccagcacccacgtgtaccagatcatgaaccactgctggaaggagagacccgaggacagacccgccttcagcagactgctgagacagctggccgagatcgccgagagcggcctgtag

SEQ ID NO: 85023 - DNA, 1899 bp, Artificial Sequence
  Description of Artificial Sequence: Synthetic coding sequence
atggagacccccgccgccgccgcccccgccggcagcctgttccccagcttcctgctgctggcctgcggcaccctggtggccgccctgctgggcgccgcccacagactgggcctgttctaccagctgctgcacaaggtggacaaggccagcgtgagacacggcggcgagaacgtggccgccgtgctgagagcccacggcgtgagattcatcttcaccctggtgggcggccacatcagccccctgctggtggcctgcgagaagctgggcatcagagtggtggacaccagacacgaggtgaccgccgtgttcgccgccgacgccatggccagactgagcggcaccgtgggcgtggccgccgtgaccgccggccccggcctgaccaacaccgtgaccgccgtgaagaacgcccagatggcccagagccccatcctgctgctgggcggcgccgccagcaccctgctgcagaacagaggcgccctgcaggccgtggaccagctgagcctgttcagacccctgtgcaagttctgcgtgagcgtgagaagagtgagagacatcgtgcccaccctgagagccgccatggccgccgcccagagcggcacccccggccccgtgttcgtggagctgcccgtggacgtgctgtacccctacttcatggtgcagaaggagatggtgcccgccaagccccccaagggcctggtgggcagagtggtgagctggtacctggagaactacctggccaacctgttcgccggcgcctgggagccccagcccgagggccccctgcccctggacatcccccaggccagcccccagcaggtgcagagatgcgtggagatcctgagcagagccaagagacccctgatggtgctgggcagccaggccctgctgacccccaccagcgccgacaagctgagagccgccgtggagaccctgggcgtgccctgcttcctgggcggcatggccagaggcctgctgggcagaaaccaccccctgcacatcagagagaacagaagcgccgccctgaagaaggccgacgtgatcgtgctggccggcaccgtgtgcgacttcagactgagctacggcagagtgctgagccacagcagcaagatcatcatcgtgaacagaaacagagaggagatgctgctgaacagcgacatcttctggaagccccaggaggccgtgcagggcgacgtgggcagcttcgtgctgaagctggtggagggcctgcagggccagacctgggcccccgactgggtggaggagctgagagaggccgacagacagaaggagcagaccttcagagagaaggccgccatgcccgtggcccagcacctgaaccccgtgcaggtgctgcagctggtggaggagaccctgcccgacaacagcatcctggtggtggacggcggcgacttcgtgggcaccgccgcccacctggtgcagcccagaggccccctgagatggctggaccccggcgccttcggcaccctgggcgtgggcgccggcttcgccctgggcgccaagctgtgcagacccgacgccgaggtgtggtgcctgttcggcgacggcgccttcggctacagcctgatcgagttcgacaccttcgtgagacacaagatccccgtgatggccctggtgggcaacgacgccggctggacccagatcagcagagagcaggtgcccagcctgggcagcaacgtggcctgcggcctggcctacaccgactaccacaaggccgccatgggcctgggcgccagaggcctgctgctgagcagagagaacgaggaccaggtggtgaaggtgctgcacgacgcccagcagcagtgcagagacggccaccccgtggtggtgaacatcctgatcggcagaaccgacttcagagacggcagcatcgccgtgtag

SEQ ID NO: 85024 - DNA, 678 bp, Artificial Sequence
  Description of Artificial Sequence: Synthetic coding sequence
atggagacccccgccgccgccgcccccgccggcagcctgttccccagcttcctgctgctggcctgcggcaccctggtggccgccctgctgggcgccgcccacagactgggcctgttctaccagctgctgcacaaggtggacaaggccagcgtgagacacggcggcgagaacgtggccgccgtgctgagagcccacggcgtgagattcatcttcaccctggtgggcggccacatcagccccctgctggtggcctgcgagaagctgggcatcagagtggtggacaccagacacgaggtgaccgccgtgttcgccgccgacgccatggccagactgagcggcaccgtgggcgtggccgccgtgaccgccggccccggcctgaccaacaccgtgaccgccgtgaagaacgcccagatggcccagagccccatcctgctgctgggcggcgccgccagcaccctgctgcagaacagaggcgccctgcaggccgtggaccagctgagcctgttcagacccccccccggctgcggccagcacccccactgggaggacggcctgcccagatggctgcactgctgcatcggcccctgcggcagcggcagactggccgccttcctgcccctggactgcgtgcagctggtgtggagcctgatcatcgcctgccccggccccatcccctag

SEQ ID NO: 85025 - DNA, 789 bp, Artificial Sequence
  Description of Artificial Sequence: Synthetic coding sequence
atggagacccccgccgccgccgcccccgccggcagcctgttccccagcttcctgctgctggcctgcggcaccctggtggccgccctgctgggcgccgcccacagactgggcctgttctaccagctgctgcacaaggtggacaaggccagcgtgagacacggcggcgagaacgtggccgccgtgctgagagcccacggcgtgagattcatcttcaccctggtgggcggccacatcagccccctgctggtggcctgcgagaagctgggcatcagagtggtggacaccagacacgaggtgaccgccgtgttcgccgccgacgccatggccagactgagcggcaccgtgggcgtggccgccgtgaccgccggccccggcctgaccaacaccgtgaccgccgtgaagaacgcccagatggcccagagccccatcctgctgctgggcggcgccgccagcaccctgctgcagaacagaggcgccctgcaggccgtggaccagctgagcctgttcagacccctgtgcaagttctgcgtgagcgtgagaagagtgagagacatcgtgcccaccctgagagccgccatggccgccgcccagagcggcacccccggccccgtgttcgtggagctgcccgtggacgtgctgtacccctacttcatggtgcagaaggagatggtgcccgccaagccccccaagggcctggtgggcagagtggtgagctggtacctggagaactacctggccaacctgttcgccggcgcctgggagccccagcccgagggccccctgccctag

SEQ ID NO: 85026 - DNA, 501 bp, Artificial Sequence
  Description of Artificial Sequence: Synthetic coding sequence
atggagacccccgccgccgccgcccccgccggcagcctgttccccagcttcctgctgctggcctgcggcaccctggtggccgccctgctgggcgccgcccacagactgggcctgttctaccagctgctgcacaaggtggacaaggccagcgtgagacacggcggcgagaacgtggccgccgtgctgagagcccacggcgtgagattcatcttcaccctggtgggcggccacatcagccccctgctggtggcctgcgagaagctgggcatcagagtggtggacaccagacacgaggtgaccgccgtgttcgccgccgacgccatggccagactgagcggcaccgtgggcgtggccgccgtgaccgccggccccggcctgaccaacaccgtgaccgccgtgaagaacgcccagatggcccagagccccatcctgctgctgggcggcgccgccagcaccctgctgcagaacagaggcgccctgcaggccgtggaccagctgtag

SEQ ID NO: 85027 - DNA, 621 bp, Artificial Sequence
  Description of Artificial Sequence: Synthetic coding sequence
atggccgccaccagatgcctgagatggggcctgagcagagccggcgtgtggctgctgcccccccccgccagatgccccagaagagccctgcacaagcagaaggacggcaccgagttcaagagcatctacagcctggacaagctgtaccccgagagccagggcagcgacaccgcctggagagtgcccaacggcgccaagcaggccgacagcgacatccccctggacagactgaccatcagctactgcagaagcagcggccccggcggccagaacgtgaacaaggtgaacagcaaggccgaggtgagattccacctggccaccgccgagtggatcgccgagcccgtgagacagaagatcgccatcacccacaagaacaagatcaacagactgggcgagctgatcctgaccagcgagagcagcagataccagttcagaaacctggccgactgcctgcagaagatcagagacatgatcaccgaggccagccagacccccaaggagcccaccaaggaggacgtgaagctgcacagaatcagaatcgagaacatgaacagagagagactgagacagaagagaatccacagcgccgtgaagaccagcagaagagtggacatggactag

SEQ ID NO: 85028 - DNA, 471 bp, Artificial Sequence
  Description of Artificial Sequence: Synthetic coding sequence
atgtgccacagcagaagctgccaccccaccatgaccatcctgcaggcccccacccccgcccccagcaccatccccggccccagaagaggcagcggccccgagatcttcaccttcgaccccctgcccgagcccgccgccgcccccgccggcagacccagcgccagcagaggccacagaaagagaagcagaagagtgctgtaccccagagtggtgagaagacagctgcccgtggaggagcccaaccccgccaagagactgctgttcctgctgctgaccatcgtgttctgccagatcctgatggccgaggagggcgtgcccgcccccctgccccccgaggacgcccccaacgccgccagcctggcccccacccccgtgagcgccgtgctggagcccttcaacctgaccagcgagcccagcgactacgccctggacctgagcaccttcctgcagcagcaccccgccgccttctag

SEQ ID NO: 85029 - DNA, 417 bp, Artificial Sequence
  Description of Artificial Sequence: Synthetic coding sequence
atgtgccacagcagaagctgccaccccaccatgaccatcctgcaggcccccacccccgcccccagcaccatccccggccccagaagaggcagcggccccgagatcttcaccttcgaccccctgcccgagcccgccgccgcccccgccggcagacccagcgccagcagaggccacagaaagagaagcagaagagtgctgtaccccagagtggtgagcatcgccgaggtgggcatcagaggcgtgagatgccccggcgtgaccggcgagagacccgacagcagaggcctggacctgacctgcctgctgttctgcctgcccctgggccccgcccccgccgccagcagaggcaccgagcccagccagaaggccagcctgagcgccgcccaccacagactgctgcccgaccccgacggctag

SEQ ID NO: 85030 - DNA, 579 bp, Artificial Sequence
  Description of Artificial Sequence: Synthetic coding sequence
atgtgccacagcagaagctgccaccccaccatgaccatcctgcaggcccccacccccgcccccagcaccatccccggccccagaagaggcagcggccccgagatcttcaccttcgaccccctgcccgagcccgccgccgcccccgccggcagacccagcgccagcagaggccacagaaagagaagcagaagagtgctgcccagcagcggcgagtacagaagaagcggccacagcagaggcgccctgccctggagccactggggcaccaccagactgcagggcctggacctgacctgcctgctgttctgcctgcccctggtgagaagacagctgcccgtggaggagcccaaccccgccaagagactgctgttcctgctgctgaccatcgtgttctgccagatcctgatggccgaggagggcgtgcccgcccccctgccccccgaggacgcccccaacgccgccagcctggcccccacccccgtgagcgccgtgctggagcccttcaacctgaccagcgagcccagcgactacgccctggacctgagcaccttcctgcagcagcaccccgccgccttctag

SEQ ID NO: 85031 - DNA, 471 bp, Artificial Sequence
  Description of Artificial Sequence: Synthetic coding sequence
atgtgccacagcagaagctgccaccccaccatgaccatcctgcaggcccccacccccgcccccagcaccatccccggccccagaagaggcagcggccccgagatcttcaccttcgaccccctgcccgagcccgccgccgcccccgccggcagacccagcgccagcagaggccacagaaagagaagcagaagagtgctgtaccccagagtggtgagaagacagctgcccgtggaggagcccaaccccgccaagagactgctgttcctgctgctgaccatcgtgttctgccagatcctgatggccgaggagggcgtgcccgcccccctgccccccgaggacgcccccaacgccgccagcctggcccccacccccgtgagccccgtgctggagcccttcaacctgaccagcgagcccagcgactacgccctggacctgagcaccttcctgcagcagcaccccgccgccttctag

SEQ ID NO: 85032 - DNA, 417 bp, Artificial Sequence; identical to SEQ ID NO: 85029
  Description of Artificial Sequence: Synthetic coding sequence

SEQ ID NO: 85033 - DNA, 417 bp, Artificial Sequence; identical to SEQ ID NO: 85029
  Description of Artificial Sequence: Synthetic coding sequence

SEQ ID NO: 85034 - DNA, 471 bp, Artificial Sequence; identical to SEQ ID NO: 85031
  Description of Artificial Sequence: Synthetic coding sequence

SEQ ID NO: 85035 - DNA, 417 bp, Artificial Sequence; identical to SEQ ID NO: 85029
  Description of Artificial Sequence: Synthetic coding sequence

SEQ ID NO: 85036 - DNA, 471 bp, Artificial Sequence; identical to SEQ ID NO: 85031
  Description of Artificial Sequence: Synthetic coding sequence

SEQ ID NO: 85037 - DNA, 417 bp, Artificial Sequence; identical to SEQ ID NO: 85029
  Description of Artificial Sequence: Synthetic coding sequence

SEQ ID NO: 85038 - DNA, 471 bp, Artificial Sequence; identical to SEQ ID NO: 85031
  Description of Artificial Sequence: Synthetic coding sequence

SEQ ID NO: 85039 - DNA, 417 bp, Artificial Sequence; identical to SEQ ID NO: 85029
  Description of Artificial Sequence: Synthetic coding sequence

SEQ ID NO: 85040 - DNA, 471 bp, Artificial Sequence; identical to SEQ ID NO: 85031
  Description of Artificial Sequence: Synthetic coding sequence

SEQ ID NO: 85041 - DNA, 249 bp, Artificial Sequence
  Description of Artificial Sequence: Synthetic coding sequence
atggccttcaccctgtacagcctgctgcaggccgccctgctgtgcgtgaacgccatcgccgtgctgcacgaggagagattcctgaagaacatcggctggggcaccgaccagggcatcggcggcttcggcgaggagcccggcatcaagagccagctgatgaacctgatcagaagcgtgagaaccgtgatgagagtgcccctgatcatcgtgaacagcatcgccatcgtgctgctgctgctgttcggctag

SEQ ID NO: 85042 - DNA, 984 bp, Artificial Sequence
  Description of Artificial Sequence: Synthetic coding sequence
atggagttcaagctggaggcccacagaatcgtgagcatcagcctgggcaagatctacaacagcagagtgcagagaggcggcatcaagctgcacaagaacctgctggtgagcctggtgctgagaagcgccagacaggtgtacctgagcgacccctgccccggcctgtacctggccggccccgccggcacccccgccccccccccccagcagcagcccggcgagcccgccgccggcccccccgccggctggggcgagccccccccccccgccgccagagccagctggcccgagaccgagccccagcccgagagaagcagcgtgagcgacgcccccagagtgggcgacgaggtgcccgtggccaccgtgaccggcgtgggcgacgtgttccagggcggcgaggccgacgccaccgaggccgcctggagcagagtggagggccccagacaggccgccgccagagaggccgagggcaccgccggcggctggggcgtgttccccgaggtgagcagagccgccagaagaccctgcggctgccccctgggcggcgaggacccccccggcacccccgccgccacccccagagccgcctgctgctgcgccccccagcccgccgaggacgagccccccgccccccccgccgtgtgccccagaaagagatgcgccgccggcgtgggcggcggccccgccggctgccccgcccccggcagcacccccctgaagaagcccagaagaaacctggagcagccccccagcggcggcgaggacgacgacgccgaggagatggagaccggcaacgtggccaacctgatcagcatcttcggcagcagcttcagcggcctgctgagaaagagccccggcggcggcagagaggaggaggagggcgaggagagcggccccgaggccgccgagcccggccagatctgctgcgacaagcccgtgctgagagacatgaacccctggagcaccgccatcgtggccttctag

SEQ ID NO: 85043 - DNA, 420 bp, Artificial Sequence
  Description of Artificial Sequence: Synthetic coding sequence
atggagttcaagctggaggcccacagaatcgtgagcatcagcctgggcaagatctacaacagcagagtgcagagaggcggcatcaagctgcacaagaacctgctggtgagcctggtgctgagaagcgccagacaggtgtacctgagcgacccctgccccggcctgtacctggccggccccgccggcacccccgccccccccccccagcagcagcccggcgagcccgccgccggcccccccgccggctggggcgagccccccccccccgccgccagagccagctggcccgagaccgagccccagcccgagagaagcagcgtgagcgacgcccccagagtgggcgacgaggtgcccgtggccaccgtgaccggcgtgggcgacgtgttccagggcagaagcgccgccatcagcagatgctag

SEQ ID NO: 85044 - DNA, 546 bp, Artificial Sequence
  Description of Artificial Sequence: Synthetic coding sequence
atggaggccatgaacgtggagaaggccagcgccgacggcaacctgcccgaggtgatcagcaacatcaaggagaccctgaagatcgtgagcagaacccccgtgaacatcaccatggccggcgacagcggcaacggcatgagcaccttcatcagcgccctgagaaacaccggccacgagggcaaggccagcccccccaccgagctggtgaaggccacccagagatgcgccagctacttcagcagccacttcagcaacgtggtgctgtgggacctgcccggcaccggcagcgccaccaccaccctggagaactacctgatggagatgcagttcaacagatacgacttcatcatggtggccagcgcccagttcagcatgaaccacgtgatgctggccaagaccgccgaggacatgggcaagaagttctacatcgtgtggaccaagctggacatggacctgagcaccggcgccctgcccgaggtgcagctgctgcagatcagagagaacgtgctggagaacctgcagaaggagagagtgtgcgagtactag

SEQ ID NO: 85045 - DNA, 1020 bp, Artificial Sequence
  Description of Artificial Sequence: Synthetic coding sequence
atggccgccgaggacgagctgcagctgcccagactgcccgagctgttcgagaccggcagacagctgctggacgaggtggaggtggccaccgagcccgccggcagcagaatcgtgcaggagaaggtgttcaagggcctggacctgctggagaaggccgccgagatgctgagccagctggacctgttcagcagaaacgaggacctggaggagatcgccagcaccgacctgaagtacctgctggtgcccgccttccagggcgccctgaccatgaagcaggtgaaccccagcaagagactggaccacctgcagagagccagagagcacttcatcaactacctgacccagtgccactgctaccacgtggccgagttcgagctgcccaagaccatgaacaacagcgccgagaaccacaccgccaacagcagcatggcctaccccagcctggtggccatggccagccagagacaggccaagatccagagatacaagcagaagaaggagctggagcacagactgagcgccatgaagagcgccgtggagagcggccaggccgacgacgagagagtgagagagtactacctgctgcacctgcagagatggatcgacatcagcctggaggagatcgagagcatcgaccaggagatcaagatcctgagagagagagacagcagcagagaggccagcaccagcaacagcagcagacaggagagaccccccgtgaagcccttcatcctgaccagaaacatggcccaggccaaggtgttcggcgccggctaccccagcctgcccaccatgaccgtgagcgactggtacgagcagcacagaaagtacggcgccctgcccgaccagggcatcgccaaggccgcccccgaggagttcagaaaggccgcccagcagcaggaggagcaggaggagaaggaggaggaggacgacgagcagaccctgcacagagccagagagtgggacgactggaaggacacccaccccagaggctacggcaacagacagaacatgggctag

SEQ ID NO: 85046 - DNA, 1020 bp, Artificial Sequence; identical to SEQ ID NO: 85045
  Description of Artificial Sequence: Synthetic coding sequence

SEQ ID NO: 85047 - DNA, 480 bp, Artificial Sequence
  Description of Artificial Sequence: Synthetic coding sequence
atgaagaaccacctgctgttctggggcgtgctggccgtgttcatcaaggccgtgcacgtgaaggcccaggaggacgagagaatcgtgctggtggacaacaagtgcaagtgcgccagaatcaccagcagaatcatcagaagcagcgaggaccccaacgaggacatcgtggagagaaacatcagaatcatcgtgcccctgaacaacagagagaacatcagcgaccccaccagccccctgagaaccagattcgtgtaccacctgagcgacctgtgcaagaagtgcgaccccaccgaggtggagctggacaaccagatcgtgaccgccacccagagcaacatctgcgacgaggacagcgccaccgagacctgctacacctacgacagaaacaagtgctacaccgccgtggtgcccctggtgtacggcggcgagaccaagatggtggagaccgccctgacccccgacgcctgctaccccgactag

SEQ ID NO: 85048 - DNA, 213 bp, Artificial Sequence
  Description of Artificial Sequence: Synthetic coding sequence
atgaagaaccacctgctgttctggggcgtgctggccgtgttcatcaaggccgtgcacgtgaaggcccaggaggacgagagaatcgtgctggtggacaacaagtgcaagtgcgccagaatcaccagcagaatcatcagaagcagcgaggaccccaacgaggacatcgtggagagaaacatcagaatcatcgtgcccctgaacaacagagagtag

SEQ ID NO: 85049 - DNA, 480 bp, Artificial Sequence; identical to SEQ ID NO: 85047
  Description of Artificial Sequence: Synthetic coding sequence

SEQ ID NO: 85050 - DNA, 528 bp, Artificial Sequence
  Description of Artificial Sequence: Synthetic coding sequence
atgaagaaccacctgctgttctggggcgtgctggccgtgttcatcaaggccgtgcacgtgaagggcagcagagacagcagcgccagcgccagcagagtggccggcatcaccgcccaggaggacgagagaatcgtgctggtggacaacaagtgcaagtgcgccagaatcaccagcagaatcatcagaagcagcgaggaccccaacgaggacatcgtggagagaaacatcagaatcatcgtgcccctgaacaacagagagaacatcagcgaccccaccagccccctgagaaccagattcgtgtaccacctgagcgacctgtgcaagaagtgcgaccccaccgaggtggagctggacaaccagatcgtgaccgccacccagagcaacatctgcgacgaggacagcgccaccgagacctgctacacctacgacagaaacaagtgctacaccgccgtggtgcccctggtgtacggcggcgagaccaagatggtggagaccgccctgacccccgacgcctgctaccccgactag

SEQ ID NO: 85051 - DNA, 642 bp, Artificial Sequence
  Description of Artificial Sequence: Synthetic coding sequence
atgagacccggcaccggccagggcggcctggaggcccccggcgagcccggccccaacctgagacagagatggcccctgctgctgctgggcctggccgtggtgacccacggcctgctgagacccaccgccgccagccagagcagagccctgggccccggcgcccccggcggcagcagcagaagcagcctgagaagcagatggggcagattcctgctgcagagaggcagctggaccggccccagatgctggcccagaggcttccagagcaagcacaacagcgtgacccacgtgttcggcagcggcacccagctgaccgtgctgagccagcccaaggccacccccagcgtgaccctgttcccccccagcagcgaggagctgcaggccaacaaggccaccctggtgtgcctgatgaacgacttctaccccggcatcctgaccgtgacctggaaggccgacggcacccccatcacccagggcgtggagatgaccacccccagcaagcagagcaacaacaagtacgccgccagcagctacctgagcctgacccccgagcagtggagaagcagaagaagctacagctgccaggtgatgcacgagggcagcaccgtggagaagaccgtggcccccgccgagtgcagctag

SEQ ID NO: 85052 - DNA, 255 bp, Artificial Sequence
  Description of Artificial Sequence: Synthetic coding sequence
atgagacccggcaccggccagggcggcctggaggcccccggcgagcccggccccaacctgagacagagatggcccctgctgctgctgggcctggccgtggtgacccacggcctgctgagacccaccgccgccagccagagcagagccctgggccccggcgcccccggcggcagcagcagaagcagcctgagaagcagatggggcagaagcgcccagggccaccccctgggccacagcgtgcccgccgtgctgtag

SEQ ID NO: 85053 - DNA, 2982 bp, Artificial Sequence
  Description of Artificial Sequence: Synthetic coding sequence
atggccagcgccgccgtggagagcttcgtgaccaagcagctggacctgctggagctggagagagacgccgaggtggaggagagaagaagctggcaggagaacatcagcctgaaggagctgcagagcagaggcgtgtgcctgctgaagctgcaggtgagcagccagagaaccggcctgtacggcagactgctggtgaccttcgagcccagaagatacggcagcgccgccgccctgcccagcaacagcttcaccagcggcgacatcgtgggcctgtacgacgccgccaacgagggcagccagctggccaccggcatcctgaccagagtgacccagaagagcgtgaccgtggccttcgacgagagccacgacttccagctgagcctggacagagagaacagctacagactgctgaagctggccaacgacgtgacctacagaagactgaagaaggccctgatcgccctgaagaagtaccacagcggccccgccagcagcctgatcgaggtgctgttcggcagaagcgcccccagccccgccagcgagatccaccccctgaccttcttcaacacctgcctggacaccagccagaaggaggccgtgctgttcgccctgagccagaaggagctggccatcatccacggcccccccggcaccggcaagaccaccaccgtggtggagatcatcctgcaggccgtgaagcagggcctgaaggtgctgtgctgcgcccccagcaacatcgccgtggacaacctggtggagagactggccctgtgcaagcagagaatcctgagactgggccaccccgccagactgctggagagcatccagcagcacagcctggacgccgtgctggccagaagcgacagcgcccagatcgtggccgacatcagaaaggacatcgaccaggtgttcgtgaagaacaagaagacccaggacaagagagagaagagcaacttcagaaacgagatcaagctgctgagaaaggagctgaaggagagagaggaggccgccatgctggagagcctgaccagcgccaacgtggtgctggccaccaacaccggcgccagcgccgacggccccctgaagctgctgcccgagagctacttcgacgtggtggtgatcgacgagtgcgcccaggccctggaggccagctgctggatccccctgctgaaggccagaaagtgcatcctggccggcgaccacaagcagctgccccccaccaccgtgagccacaaggccgccctggccggcctgagcctgagcctgatggagagactggccgaggagtacggcgccagagtggtgagaaccctgaccgtgcagtacagaatgcaccaggccatcatgagatgggccagcgacaccatgtacctgggccagctgaccgcccacagcagcgtggccagacacctgctgagagacctgcccggcgtggccgccaccgaggagaccggcgtgcccctgctgctggtggacaccgccggctgcggcctgttcgagctggaggaggaggacgagcagagcaagggcaaccccggcgaggtgagactggtgagcctgcacatccaggccctggtggacgccggcgtgcccgccagagacatcgccgtggtgagcccctacaacctgcaggtggacctgctgagacagagcctggtgcacagacaccccgagctggagatcaagagcgtggacggcttccagggcagagagaaggaggccgtgatcctgagcttcgtgagaagcaacagaaagggcgaggtgggcttcctggccgaggacagaagaatcaacgtggccgtgaccagagccagaagacacgtggccgtgatctgcgacagcagaaccgtgaacaaccacgccttcctgaagaccctggtggagtacttcacccagcacggcgaggtgagaaccgccttcgagtacctggacgacatcgtgcccgagaactacagccacgagaacagccagggcagcagccacgccgccaccaagccccagggccccgccaccagcaccagaaccggcagccagagacaggagggcggccaggaggccgccgcccccgccagacagggcagaaagaagcccgccggcaagagcctggccagcgaggcccccagccagcccagcctgaacggcggcagccccgagggcgtggagagccaggacggcgtggaccacttcagagccatgatcgtggagttcatggccagcaagaagatgcagctggagttcccccccagcctgaacagccacgacagactgagagtgcaccagatcgccgaggagcacggcctgagacacgacagcagcggcgagggcaagagaagattcatcaccgtgagcaagagagcccccagacccagagccgccctgggcccccccgccggcaccggcggccccgcccccctgcagcccgtgccccccacccccgcccagaccgagcagccccccagagagcagagaggccccgaccagcccgacctgagaaccctgcacctggagagactgcagagagtgagaagcgcccagggccagcccgccagcaaggagcagcaggccagcggccagcagaagctgcccgagaagaagaagaagaaggccaagggccaccccgccaccgacctgcccaccgaggaggacttcgaggccctggtgagcgccgccgtgaaggccgacaacacctgcggcttcgccaagtgcaccgccggcgtgaccaccctgggccagttctgccagctgtgcagcagaagatactgcctgagccaccacctgcccgagatccacggctgcggcgagagagccagagcccacgccagacagagaatcagcagagagggcgtgctgtacgccggcagcggcaccaagaacggcagcctggaccccgccaagagagcccagctgcagagaagactggacaagaagctgagcgagctgagcaaccagagaaccagcagaagaaaggagagaggcacctag

SEQ ID NO: 85054 - DNA, 1287 bp, Artificial Sequence
  Description of Artificial Sequence: Synthetic coding sequence
atgcaggagctgcacctgctgtggtgggccctgctgctgggcctggcccaggcctgccccgagccctgcgactgcggcgagaagtacggcttccagatcgccgactgcgcctacagagacctggagagcgtgccccccggcttccccgccaacgtgaccaccctgagcctgagcgccaacagactgcccggcctgcccgagggcgccttcagagaggtgcccctgctgcagagcctgtggctggcccacaacgagatcagaaccgtggccgccggcgccctggccagcctgagccacctgaagagcctggacctgagccacaacctgatcagcgacttcgcctggagcgacctgcacaacctgagcgccctgcagctgctgaagatggacagcaacgagctgaccttcatccccagagacgccttcagaagcctgagagccctgagaagcctgcagctgaaccacaacagactgcacaccctggccgagggcaccttcacccccctgaccgccctgagccacctgcagatcaacgagaaccccttcgactgcacctgcggcatcgtgtggctgaagacctgggccctgaccaccgccgtgagcatccccgagcaggacaacatcgcctgcaccagcccccacgtgctgaagggcacccccctgagcagactgccccccctgccctgcagcgcccccagcgtgcagctgagctaccagcccagccaggacggcgccgagctgagacccggcttcgtgctggccctgcactgcgacgtggacggccagcccgccccccagctgcactggcacatccagatccccagcggcatcgtggagatcaccagccccaacgtgggcaccgacggcagagccctgcccggcacccccgtggccagcagccagcccagattccaggccttcgccaacggcagcctgctgatccccgacttcggcaagctggaggagggcacctacagctgcctggccaccaacgagctgggcagcgccgagagcagcgtggacgtggccctggccacccccggcgagggcggcgaggacaccctgggcagaagattccacggcaaggccgtggagggcaagggctgctacaccgtggacaacgaggtgcagcccagcggccccgaggacaacgtggtgatcatctacctgagcagagccggcaaccccgaggccgccgtggccgagggcgtgcccggccagctgccccccggcctgctgctgctgggccagagcctgctgctgttcttcttcctgaccagcttctag

SEQ ID NO: 85055 - DNA, 1287 bp, Artificial Sequence; identical to SEQ ID NO: 85054
  Description of Artificial Sequence: Synthetic coding sequence

SEQ ID NO: 85056 - DNA, 444 bp, Artificial Sequence
  Description of Artificial Sequence: Synthetic coding sequence
atgcaggagctgcacctgctgtggtgggccctgctgctgggcctggcccaggcctgccccgagccctgcgactgcggcgagaagtacggcttccagatcgccgactgcgcctacagagacctggagagcgtgccccccggcttccccgccaacgtgaccaccctgagcctgagcgccaacagactgcccggcctgcccgagggcgccttcagagaggtgcccctgctgcagagcctgtggctggcccacaacgagatcagaaccgtggccgccggcgccctggccagcctgagccacctgaagagcctggacctgagccacaacctgatcagcgacttcgcctggagcgacctgcacaacctgagcgccctgcagctgctgaagatggacagcaacgagctgaccttcatccccagagacgccttcagaagcctgagagcctag

SEQ ID NO: 85057 - DNA, 552 bp, Artificial Sequence
  Description of Artificial Sequence: Synthetic coding sequence
atgcaggagctgcacctgctgtggtgggccctgctgctgggcctggcccaggcctgccccgagccctgcgactgcggcgagaagtacggcttccagatcgccgactgcgcctacagagacctggagagcgtgccccccggcttccccgccaacgtgaccaccctgagcctgagcgccaacagactgcccggcctgcccgagggcgccttcagagaggtgcccctgctgcagagcctgtggctggcccacaacgagatcagaaccgtggccgccggcgccctggccagcctgagccacctgaagagcctggacctgagccacaacctgatcagcgacttcgcctggagcgacctgcacaacctgagcgccctgcagctgctgaagatggacagcaacgagctgaccttcatccccagagacgccttcagaagcctgagagccctgagaagcctgcagctgaaccacaacagactgcacaccctggccgagggcaccttcacccccctgaccgccctgagccacctgcagatcaacgagaaccccttcgactag

SEQ ID NO: 85058 - DNA, 2238 bp, Artificial Sequence
  Description of Artificial Sequence: Synthetic coding sequence
atgttccccctgagagccctgtggctggtgtgggccctgctgggcgtggccggcagctgccccgagccctgcgcctgcgtggacaagtacgcccaccagttcgccgactgcgcctacaaggagctgagagaggtgcccgagggcctgcccgccaacgtgaccaccctgagcctgagcgccaacaagatcaccgtgctgagaagaggcgccttcgccgacgtgacccaggtgaccagcctgtggctggcccacaacgaggtgagaaccgtggagcccggcgccctggccgtgctgagccagctgaagaacctggacctgagccacaacttcatcagcagcttcccctggagcgacctgagaaacctgagcgccctgcagctgctgaagatgaaccacaacagactgggcagcctgcccagagacgccctgggcgccctgcccgacctgagaagcctgagaatcaacaacaacagactgagaaccctggcccccggcaccttcgacgccctgagcgccctgagccacctgcagctgtaccacaaccccttccactgcggctgcggcctggtgtggctgcaggcctgggccgccagcaccagagtgagcctgcccgagcccgacagcatcgcctgcgccagcccccccgccctgcagggcgtgcccgtgtacagactgcccgccctgccctgcgccccccccagcgtgcacctgagcgccgagccccccctggaggcccccggcacccccctgagagccggcctggccttcgtgctgcactgcatcgccgacggccaccccacccccagactgcagtggcagctgcagatccccggcggcaccgtggtgctggagccccccgtgctgagcggcgaggacgacggcgtgggcgccgaggagggcgagggcgagggcgacggcgacctgctgacccagacccaggcccagacccccacccccgcccccgcctggcccgccccccccgccacccccagattcctggccctggccaacggcagcctgctggtgcccctgctgagcgccaaggaggccggcgtgtacacctgcagagcccacaacgagctgggcgccaacagcaccagcatcagagtggccgtggccgccaccggcccccccaagcacgcccccggcgccggcggcgagcccgacggccaggcccccaccagcgagagaaagagcaccgccaagggcagaggcaacagcgtgctgcccagcaagcccgagggcaagatcaagggccagggcctggccaaggtgagcatcctgggcgagaccgagaccgagcccgaggaggacaccagcgagggcgaggaggccgaggaccagatcctggccgaccccgccgaggagcagagatgcggcaacggcgaccccagcagatacgtgagcaaccacgccttcaaccagagcgccgagctgaagccccacgtgttcgagctgggcgtgatcgccctggacgtggccgagagagaggccagagtgcagctgacccccctggccgccagatggggccccggccccggcggcgccggcggcgcccccagacccggcagaagacccctgagactgctgtacctgtgccccgccggcggcggcgccgccgtgcagtggagcagagtggaggagggcgtgaacgcctactggttcagaggcctgagacccggcaccaactacagcgtgtgcctggccctggccggcgaggcctgccacgtgcaggtggtgttcagcaccaagaaggagctgcccagcctgctggtgatcgtggccgtgagcgtgttcctgctggtgctggccaccgtgcccctgctgggcgccgcctgctgccacctgctggccaagcaccccggcaagccctacagactgatcctgagaccccaggcccccgaccccatggagaagagaatcgccgccgacttcgaccccagagccagctacctggagagcgagaagagctaccccgccggcggcgaggccggcggcgaggagcccgaggacgtgcagggcgagggcctggacgaggacgccgagcagggcgaccccagcggcgacctgcagagagaggagagcctggccgcctgcagcctggtggagagccagagcaaggccaaccaggaggagttcgaggccggcagcgagtacagcgacagactgcccctgggcgccgaggccgtgaacatcgcccaggagatcaacggcaactacagacagaccgccggctag

SEQ ID NO: 85059 - DNA, 1005 bp, Artificial Sequence
  Description of Artificial Sequence: Synthetic coding sequence
atgttccccctgagagccctgtggctggtgtgggccctgctgggcgtggccggcagctgccccgagccctgcgcctgcgtggacaagtacgcccaccagttcgccgactgcgcctacaaggagctgagagaggtgcccgagggcctgcccgccaacgtgaccaccctgagcctgagcgccaacaagatcaccgtgctgagaagaggcgccttcgccgacgtgacccaggtgaccagcctgtggctggcccacaacgaggtgagaaccgtggagcccggcgccctggccgtgctgagccagctgaagaacctggacctgagccacaacttcatcagcagcttcccctggagcgacctgagaaacctgagcgccctgcagctgctgaagatgaaccacaacagactgggcagcctgcccagagacgccctgggcgccctgcccgacctgagaagcctgagaatcaacaacaacagactggccggcgaggcctgccacgtgcaggtggtgttcagcaccaagaaggagctgcccagcctgctggtgatcgtggccgtgagcgtgttcctgctggtgctggccaccgtgcccctgctgggcgccgcctgctgccacctgctggccaagcaccccggcaagccctacagactgatcctgagaccccaggcccccgaccccatggagaagagaatcgccgccgacttcgaccccagagccagctacctggagagcgagaagagctaccccgccggcggcgaggccggcggcgaggagcccgaggacgtgcagggcgagggcctggacgaggacgccgagcagggcgaccccagcggcgacctgcagagagaggagagcctggccgcctgcagcctggtggagagccagagcaaggccaaccaggaggagttcgaggccggcagcgagtacagcgacagactgcccctgggcgccgaggccgtgaacatcgcccaggagatcaacggcaactacagacagaccgccggctag

SEQ ID NO: 85060 - DNA, 2238 bp, Artificial Sequence; identical to SEQ ID NO: 85058
  Description of Artificial Sequence: Synthetic coding sequence

SEQ ID NO: 85061 - DNA, 2238 bp, Artificial Sequence; identical to SEQ ID NO: 85058
  Description of Artificial Sequence: Synthetic coding sequence

SEQ ID NO: 85062 - DNA, 2238 bp, Artificial Sequence; identical to SEQ ID NO: 85058
  Description of Artificial Sequence: Synthetic coding sequence

SEQ ID NO: 85063 - DNA, 2238 bp, Artificial Sequence; identical to SEQ ID NO: 85058
  Description of Artificial Sequence: Synthetic coding sequence

SEQ ID NO: 85064 - DNA, 4011 bp, Artificial Sequence
  Description of Artificial Sequence: Synthetic coding sequence
atgaccctggacagacccggcgagggcgccaccatgctgaagaccttcaccgtgctgctgttctgcatcagaatgagcctgggcatgaccagcatcgtgatggacccccagcccgagctgtggatcgagagcaactacccccaggccccctgggagaacatcaccctgtggtgcagaagccccagcagaatcagcagcaagttcctgctgctgaaggacaagacccagatgacctggatcagacccagccacaagaccttccaggtgagcttcctgatcggcgccctgaccgagagcaacgccggcctgtacagatgctgctactggaaggagaccggctggagcaagcccagcaaggtgctggagctggaggcccccggccagctgcccaagcccatcttctggatccaggccgagacccccgccctgcccggctgcaacgtgaacatcctgtgccacggctggctgcaggacctggtgttcatgctgttcaaggagggctacgccgagcccgtggactaccaggtgcccaccggcaccatggccatcttcagcatcgacaacctgacccccgaggacgagggcgtgtacatctgcagaacccacatccagatgctgcccaccctgtggagcgagcccagcaaccccctgaagctggtggtggccggcctgtaccccaagcccaccctgaccgcccaccccggccccatcatggcccccggcgagagcctgaacctgagatgccagggccccatctacggcatgaccttcgccctgatgagagtggaggacctggagaagagcttctaccacaagaagaccatcaagaacgaggccaacttcttcttccagagcctgaagatccaggacaccggccactacctgtgcttctactacgacgccagctacagaggcagcctgctgagcgacgtgctgaagatctgggtgaccgacaccttccccaagacctggctgctggccagacccagcgccgtggtgcagatgggccagaacgtgagcctgagatgcagaggccccgtggacggcgtgggcctggccctgtacaagaagggcgaggacaagcccctgcagttcctggacgccaccagcatcgacgacaacaccagcttcttcctgaacaacgtgacctacagcgacaccggcatctacagctgccactacctgctgacctggaagaccagcatcagaatgcccagccacaacaccgtggagctgatggtggtggacaagccccccaagcccagcctgagcgcctggcccagcaccgtgttcaagctgggcaaggccatcaccctgcagtgcagagtgagccaccccgtgctggagttcagcctggagtgggaggagagagagaccttccagaagttcagcgtgaacggcgacttcatcatcagcaacgtggacggcaagggcaccggcacctacagctgcagctacagagtggagacccaccccaacatctggagccacagaagcgagcccctgaagctgatgggccccgccggctacctgacctggaactacgtgctgaacgaggccatcagactgagcctgatcatgcagctggtggccctgctgctggtggtgctgtggatcagatggaagtgcagaagactgagaatcagagaggcctggctgctgggcaccgcccagggcgtgaccatgctgttcatcgtgaccgccctgctgtgctgcggcctgtgcaacggcgtgctgatcgaggagaccgagatcgtgatgcccacccccaagcccgagctgtgggccgagaccaacttccccctggccccctggaagaacctgaccctgtggtgcagaagccccagcggcagcaccaaggagttcgtgctgctgaaggacggcaccggctggatcgccaccagacccgccagcgagcaggtgagagccgccttccccctgggcgccctgacccagagccacaccggcagctaccactgccacagctgggaggagatggccgtgagcgagcccagcgaggccctggagctggtgggcaccgacatcctgcccaagcccgtgatcagcgccagccccaccatcagaggccaggagctgcagctgagatgcaagggctggctggccggcatgggcttcgccctgtacaaggagggcgagcaggagcccgtgcagcagctgggcgccgtgggcagagaggccttcttcaccatccagagaatggaggacaaggacgagggcaactacagctgcagaacccacaccgagaagagacccttcaagtggagcgagcccagcgagcccctggagctggtgatcaaggagatgtaccccaagcccttcttcaagacctgggccagccccgtggtgacccccggcgccagagtgaccttcaactgcagcaccccccaccagcacatgagcttcatcctgtacaaggacggcagcgagatcgccagcagcgacagaagctgggccagccccggcgccagcgccgcccacttcctgatcatcagcgtgggcatcggcgacggcggcaactacagctgcagatactacgacttcagcatctggagcgagcccagcgaccccgtggagctggtggtgaccgagttctaccccaagcccaccctgctggcccagcccggccccgtggtgttccccggcaagagcgtgatcctgagatgccagggcaccttccagggcatgagattcgccctgctgcaggagggcgcccacgtgcccctgcagttcagaagcgtgagcggcaacagcgccgacttcctgctgcacaccgtgggcgccgaggacagcggcaactacagctgcatctactacgagaccaccatgagcaacagaggcagctacctgagcatgcccctgatgatctgggtgaccgacaccttccccaagccctggctgttcgccgagcccagcagcgtggtgcccatgggccagaacgtgaccctgtggtgcagaggccccgtgcacggcgtgggctacatcctgcacaaggagggcgaggccaccagcatgcagctgtggggcagcaccagcaacgacggcgccttccccatcaccaacatcagcggcaccagcatgggcagatacagctgctgctaccaccccgactggaccagcagcatcaagatccagcccagcaacaccctggagctgctggtgaccggcctgctgcccaagcccagcctgctggcccagcccggccccatggtggcccccggcgagaacatgaccctgcagtgccagggcgagctgcccgacagcaccttcgtgctgctgaaggagggcgcccaggagcccctggagcagcagagacccagcggctacagagccgacttctggatgcccgccgtgagaggcgaggacagcggcatctacagctgcgtgtactacctggacagcacccccttcgccgccagcaaccacagcgacagcctggagatctgggtgaccgacaagccccccaagcccagcctgagcgcctggcccagcaccatgttcaagctgggcaaggacatcaccctgcagtgcagaggccccctgcccggcgtggagttcgtgctggagcacgacggcgaggaggccccccagcagttcagcgaggacggcgacttcgtgatcaacaacgtggagggcaagggcatcggcaactacagctgcagctacagactgcaggcctaccccgacatctggagcgagcccagcgaccccctggagctggtgggcgccgccggccccgtggcccaggagtgcaccgtgggcaacatcgtgagaagcagcctgatcgtggtggtggtggtggccctgggcgtggtgctggccatcgagtggaagaagtggcccagactgagaaccagaggcagcgagaccgacggcagagaccagaccatcgccctggaggagtgcaaccaggagggcgagcccggcacccccgccaacagccccagcagcaccagccagagaatcagcgtggagctgcccgtgcccatctag

SEQ ID NO: 85065 - DNA, 729 bp, Artificial Sequence
  Description of Artificial Sequence: Synthetic coding sequence
atgaccctggacagacccggcgagggcgccaccatgctgaagaccttcaccgtgctgctgttctgcatcagaatgagcctgggcatgaccagcatcgtgatggacccccagcccgagctgtggatcgagagcaactacccccaggccccctgggagaacatcaccctgtggtgcagaagccccagcagaatcagcagcaagttcctgctgctgaaggacaagacccagatgacctggatcagacccagccacaagaccttccaggtgagcttcctgatcggcgccctgaccgagagcaacgccggcctgtacagatgctgctactggaaggagaccggctggagcaagcccagcaaggtgctggagctggaggcccccggccagctgcccaagcccatcttctggatccaggccgagacccccgccctgcccggctgcaacgtgaacatcctgtgccacggctggctgcaggacctggtgttcatgctgttcaaggagggctacgccgagcccgtggactaccaggtgcccaccggcaccatggccatcttcagcatcgacaacctgacccccgaggacgagggcgtgtacatctgcagaacccacatccagatgctgcccaccctgtggagcgagcccagcaaccccctgaagctggtggtggccggcggctgcggctacggctgctggcacctggccatcgtggtgcccggcatcatggccggctag

SEQ ID NO: 85066 - DNA, 729 bp, Artificial Sequence; identical to SEQ ID NO: 85065
  Description of Artificial Sequence: Synthetic coding sequence

SEQ ID NO: 85067 - DNA, 4026 bp, Artificial Sequence
  Description of Artificial Sequence: Synthetic coding sequence
atgaccctggacagacccggcgagggcgccaccatgctgaagaccttcaccgtgctgctgttctgcatcagaatgagcctgggcatgaccagcatcgtgatggacccccagcccgagctgtggatcgagagcaactacccccaggccccctgggagaacatcaccctgtggtgcagaagccccagcagaatcagcagcaagttcctgctgctgaaggacaagacccagatgacctggatcagacccagccacaagaccttccaggtgagcttcctgatcggcgccctgaccgagagcaacgccggcctgtacagatgctgctactggaaggagaccggctggagcaagcccagcaaggtgctggagctggaggcccccggccagctgcccaagcccatcttctggatccaggccgagacccccgccctgcccggctgcaacgtgaacatcctgtgccacggctggctgcaggacctggtgttcatgctgttcaaggagggctacgccgagcccgtggactaccaggtgcccaccggcaccatggccatcttcagcatcgacaacctgacccccgaggacgagggcgtgtacatctgcagaacccacatccagatgctgcccaccctgtggagcgagcccagcaaccccctgaagctggtggtggccggcctgtaccccaagcccaccctgaccgcccaccccggccccatcatggcccccggcgagagcctgaacctgagatgccagggccccatctacggcatgaccttcgccctgatgagagtggaggacctggagaagagcttctaccacaagaagaccatcaagaacgaggccaacttcttcttccagagcctgaagatccaggacaccggccactacctgtgcttctactacgacgccagctacagaggcagcctgctgagcgacgtgctgaagatctgggtgaccgacaccttccccaagacctggctgctggccagacccagcgccgtggtgcagatgggccagaacgtgagcctgagatgcagaggccccgtggacggcgtgggcctggccctgtacaagaagggcgaggacaagcccctgcagttcctggacgccaccagcatcgacgacaacaccagcttcttcctgaacaacgtgacctacagcgacaccggcatctacagctgccactacctgctgacctggaagaccagcatcagaatgcccagccacaacaccgtggagctgatggtggtggacaagccccccaagcccagcctgagcgcctggcccagcaccgtgttcaagctgggcaaggccatcaccctgcagtgcagagtgagccaccccgtgctggagttcagcctggagtgggaggagagagagaccttccagaagttcagcgtgaacggcgacttcatcatcagcaacgtggacggcaagggcaccggcacctacagctgcagctacagagtggagacccaccccaacatctggagccacagaagcgagcccctgaagctgatgggccccgccggctacctgacctggaactacgtgctgaacgaggccatcagactgagcctgatcatgcagctggtggccctgctgctggtggtgctgtggatcagatggaagtgcagaagactgagaatcagagaggcctggctgctgggcaccgcccagggcgtgaccatgctgttcatcgtgaccgccctgctgtgctgcgccatcagcttcgccggcctgtgcaacggcgtgctgatcgaggagaccgagatcgtgatgcccacccccaagcccgagctgtgggccgagaccaacttccccctggccccctggaagaacctgaccctgtggtgcagaagccccagcggcagcaccaaggagttcgtgctgctgaaggacggcaccggctggatcgccaccagacccgccagcgagcaggtgagagccgccttccccctgggcgccctgacccagagccacaccggcagctaccactgccacagctgggaggagatggccgtgagcgagcccagcgaggccctggagctggtgggcaccgacatcctgcccaagcccgtgatcagcgccagccccaccatcagaggccaggagctgcagctgagatgcaagggctggctggccggcatgggcttcgccctgtacaaggagggcgagcaggagcccgtgcagcagctgggcgccgtgggcagagaggccttcttcaccatccagagaatggaggacaaggacgagggcaactacagctgcagaacccacaccgagaagagacccttcaagtggagcgagcccagcgagcccctggagctggtgatcaaggagatgtaccccaagcccttcttcaagacctgggccagccccgtggtgacccccggcgccagagtgaccttcaactgcagcaccccccaccagcacatgagcttcatcctgtacaaggacggcagcgagatcgccagcagcgacagaagctgggccagccccggcgccagcgccgcccacttcctgatcatcagcgtgggcatcggcgacggcggcaactacagctgcagatactacgacttcagcatctggagcgagcccagcgaccccgtggagctggtggtgaccgagttctaccccaagcccaccctgctggcccagcccggccccgtggtgttccccggcaagagcgtgatcctgagatgccagggcaccttccagggcatgagattcgccctgctgcaggagggcgcccacgtgcccctgcagttcagaagcgtgagcggcaacagcgccgacttcctgctgcacaccgtgggcgccgaggacagcggcaactacagctgcatctactacgagaccaccatgagcaacagaggcagctacctgagcatgcccctgatgatctgggtgaccgacaccttccccaagccctggctgttcgccgagcccagcagcgtggtgcccatgggccagaacgtgaccctgtggtgcagaggccccgtgcacggcgtgggctacatcctgcacaaggagggcgaggccaccagcatgcagctgtggggcagcaccagcaacgacggcgccttccccatcaccaacatcagcggcaccagcatgggcagatacagctgctgctaccaccccgactggaccagcagcatcaagatccagcccagcaacaccctggagctgctggtgaccggcctgctgcccaagcccagcctgctggcccagcccggccccatggtggcccccggcgagaacatgaccctgcagtgccagggcgagctgcccgacagcaccttcgtgctgctgaaggagggcgcccaggagcccctggagcagcagagacccagcggctacagagccgacttctggatgcccgccgtgagaggcgaggacagcggcatctacagctgcgtgtactacctggacagcacccccttcgccgccagcaaccacagcgacagcctggagatctgggtgaccgacaagccccccaagcccagcctgagcgcctggcccagcaccatgttcaagctgggcaaggacatcaccctgcagtgcagaggccccctgcccggcgtggagttcgtgctggagcacgacggcgaggaggccccccagcagttcagcgaggacggcgacttcgtgatcaacaacgtggagggcaagggcatcggcaactacagctgcagctacagactgcaggcctaccccgacatctggagcgagcccagcgaccccctggagctggtgggcgccgccggccccgtggcccaggagtgcaccgtgggcaacatcgtgagaagcagcctgatcgtggtggtggtggtggccctgggcgtggtgctggccatcgagtggaagaagtggcccagactgagaaccagaggcagcgagaccgacggcagagaccagaccatcgccctggaggagtgcaaccaggagggcgagcccggcacccccgccaacagccccagcagcaccagccagagaatcagcgtggagctgcccgtgcccatctag

SEQ ID NO: 85068 - DNA, 3984 bp, Artificial Sequence
  Description of Artificial Sequence: Synthetic coding sequence
atgaccctggacagacccggcgagggcgccaccatgctgaagaccttcaccgtgctgctgttctgcatcctgatggacccccagcccgagctgtggatcgagagcaactacccccaggccccctgggagaacatcaccctgtggtgcagaagccccagcagaatcagcagcaagttcctgctgctgaaggacaagacccagatgacctggatcagacccagccacaagaccttccaggtgagcttcctgatcggcgccctgaccgagagcaacgccggcctgtacagatgctgctactggaaggagaccggctggagcaagcccagcaaggtgctggagctggaggcccccggccagctgcccaagcccatcttctggatccaggccgagacccccgccctgcccggctgcaacgtgaacatcctgtgccacggctggctgcaggacctggtgttcatgctgttcaaggagggctacgccgagcccgtggactaccaggtgcccaccggcaccatggccatcttcagcatcgacaacctgacccccgaggacgagggcgtgtacatctgcagaacccacatccagatgctgcccaccctgtggagcgagcccagcaaccccctgaagctggtggtggccggcctgtaccccaagcccaccctgaccgcccaccccggccccatcatggcccccggcgagagcctgaacctgagatgccagggccccatctacggcatgaccttcgccctgatgagagtggaggacctggagaagagcttctaccacaagaagaccatcaagaacgaggccaacttcttcttccagagcctgaagatccaggacaccggccactacctgtgcttctactacgacgccagctacagaggcagcctgctgagcgacgtgctgaagatctgggtgaccgacaccttccccaagacctggctgctggccagacccagcgccgtggtgcagatgggccagaacgtgagcctgagatgcagaggccccgtggacggcgtgggcctggccctgtacaagaagggcgaggacaagcccctgcagttcctggacgccaccagcatcgacgacaacaccagcttcttcctgaacaacgtgacctacagcgacaccggcatctacagctgccactacctgctgacctggaagaccagcatcagaatgcccagccacaacaccgtggagctgatggtggtggacaagccccccaagcccagcctgagcgcctggcccagcaccgtgttcaagctgggcaaggccatcaccctgcagtgcagagtgagccaccccgtgctggagttcagcctggagtgggaggagagagagaccttccagaagttcagcgtgaacggcgacttcatcatcagcaacgtggacggcaagggcaccggcacctacagctgcagctacagagtggagacccaccccaacatctggagccacagaagcgagcccctgaagctgatgggccccgccggctacctgacctggaactacgtgctgaacgaggccatcagactgagcctgatcatgcagctggtggccctgctgctggtggtgctgtggatcagatggaagtgcagaagactgagaatcagagaggcctggctgctgggcaccgcccagggcgtgaccatgctgttcatcgtgaccgccctgctgtgctgcggcctgtgcaacggcgtgctgatcgaggagaccgagatcgtgatgcccacccccaagcccgagctgtgggccgagaccaacttccccctggccccctggaagaacctgaccctgtggtgcagaagccccagcggcagcaccaaggagttcgtgctgctgaaggacggcaccggctggatcgccaccagacccgccagcgagcaggtgagagccgccttccccctgggcgccctgacccagagccacaccggcagctaccactgccacagctgggaggagatggccgtgagcgagcccagcgaggccctggagctggtgggcaccgacatcctgcccaagcccgtgatcagcgccagccccaccatcagaggccaggagctgcagctgagatgcaagggctggctggccggcatgggcttcgccctgtacaaggagggcgagcaggagcccgtgcagcagctgggcgccgtgggcagagaggccttcttcaccatccagagaatggaggacaaggacgagggcaactacagctgcagaacccacaccgagaagagacccttcaagtggagcgagcccagcgagcccctggagctggtgatcaaggagatgtaccccaagcccttcttcaagacctgggccagccccgtggtgacccccggcgccagagtgaccttcaactgcagcaccccccaccagcacatgagcttcatcctgtacaaggacggcagcgagatcgccagcagcgacagaagctgggccagccccggcgccagcgccgcccacttcctgatcatcagcgtgggcatcggcgacggcggcaactacagctgcagatactacgacttcagcatctggagcgagcccagcgaccccgtggagctggtggtgaccgagttctaccccaagcccaccctgctggcccagcccggccccgtggtgttccccggcaagagcgtgatcctgagatgccagggcaccttccagggcatgagattcgccctgctgcaggagggcgcccacgtgcccctgcagttcagaagcgtgagcggcaacagcgccgacttcctgctgcacaccgtgggcgccgaggacagcggcaactacagctgcatctactacgagaccaccatgagcaacagaggcagctacctgagcatgcccctgatgatctgggtgaccgacaccttccccaagccctggctgttcgccgagcccagcagcgtggtgcccatgggccagaacgtgaccctgtggtgcagaggccccgtgcacggcgtgggctacatcctgcacaaggagggcgaggccaccagcatgcagctgtggggcagcaccagcaacgacggcgccttccccatcaccaacatcagcggcaccagcatgggcagatacagctgctgctaccaccccgactggaccagcagcatcaagatccagcccagcaacaccctggagctgctggtgaccggcctgctgcccaagcccagcctgctggcccagcccggccccatggtggcccccggcgagaacatgaccctgcagtgccagggcgagctgcccgacagcaccttcgtgctgctgaaggagggcgcccaggagcccctggagcagcagagacccagcggctacagagccgacttctggatgcccgccgtgagaggcgaggacagcggcatctacagctgcgtgtactacctggacagcacccccttcgccgccagcaaccacagcgacagcctggagatctgggtgaccgacaagccccccaagcccagcctgagcgcctggcccagcaccatgttcaagctgggcaaggacatcaccctgcagtgcagaggccccctgcccggcgtggagttcgtgctggagcacgacggcgaggaggccccccagcagttcagcgaggacggcgacttcgtgatcaacaacgtggagggcaagggcatcggcaactacagctgcagctacagactgcaggcctaccccgacatctggagcgagcccagcgaccccctggagctggtgggcgccgccggccccgtggcccaggagtgcaccgtgggcaacatcgtgagaagcagcctgatcgtggtggtggtggtggccctgggcgtggtgctggccatcgagtggaagaagtggcccagactgagaaccagaggcagcgagaccgacggcagagaccagaccatcgccctggaggagtgcaaccaggagggcgagcccggcacccccgccaacagccccagcagcaccagccagagaatcagcgtggagctgcccgtgcccatctag

SEQ ID NO: 85069 - DNA, 3984 bp, Artificial Sequence; identical to SEQ ID NO: 85068
  Description of Artificial Sequence: Synthetic coding sequence

SEQ ID NO: 85070 - DNA, 3645 bp, Artificial Sequence
  Description of Artificial Sequence: Synthetic coding sequence
atgaagtgcttcttccccgtgctgagctgcctggccgtgctgggcgtggtgagcgcccagagacaggtgaccgtgcaggagggccccctgtacagaaccgagggcagccacatcaccatctggtgcaacgtgagcggctaccagggccccagcgagcagaacttccagtggagcatctacctgcccagcagccccgagagagaggtgcagatcgtgagcaccatggacagcagcttcccctacgccatctacacccagagagtgagaggcggcaagatcttcatcgagagagtgcagggcaacagcaccctgctgcacatcaccgacctgcaggccagagacgccggcgagtacgagtgccacacccccagcaccgacaagcagtacttcggcagctacagcgccaagatgaacctggtggtgatccccgacagcctgcagaccaccgccatgccccagaccctgcacagagtggagcaggaccccctggagctgacctgcgaggtggccagcgagaccatccagcacagccacctgagcgtggcctggctgagacagaaggtgggcgagaagcccgtggaggtgatcagcctgagcagagacttcatgctgcacagcagcagcgagtacgcccagagacagagcctgggcgaggtgagactggacaagctgggcagaaccaccttcagactgaccatcttccacctgcagcccagcgaccagggcgagttctactgcgaggccgccgagtggatccaggaccccgacggcagctggtacgccatgaccagaaagagaagcgagggcgccgtggtgaacgtgcagcccaccgacaaggagttcaccgtgagactggagaccgagaagagactgcacaccgtgggcgagcccgtggagttcagatgcatcctggaggcccagaacgtgcccgacagatacttcgccgtgagctgggccttcaacagcagcctgatcgccaccatgggccccaacgccgtgcccgtgctgaacagcgagttcgcccacagagaggccagaggccagctgaaggtggccaaggagagcgacagcgtgttcgtgctgaagatctaccacctgagacaggaggacagcggcaagtacaactgcagagtgaccgagagagagaagaccgtgaccggcgagttcatcgacaaggagagcaagagacccaagaacatccccatcatcgtgctgcccctgaccgacaactgggtggtgaaggtgccccagcaccaccagctgctgagccagggccacctggagagcagcatcagcgtggaggtggccagcaacgccagcgtgatcctggagggcgaggacctgagattcagctgcagcgtgagaaccgccggcagaccccagggcagattcagcgtgatctggcagctggtggacagacagaacagaagaagcaacatcatgtggctggacagagacggcaccgtgcagcccggcagcagctactgggagagaagcagcttcggcggcgtgcagatggagcaggtgcagcccaacagcttcagcctgggcatcttcaacagcagaaaggaggacgagggccagtacgagtgccacgtgaccgagtgggtgagagccgtggacggcgagtggcagatcgtgggcgagagaagagccagcacccccatcagcatcaccgccctggagatgggcttcgccgtgaccgccatcagcagaacccccggcgtgacctacagcgacagcttcgacctgcagtgcatcatcaagccccactaccccgcctgggtgcccgtgagcgtgacctggagattccagcccgtgggcaccgtggagttccacgacctggtgaccttcaccagagacggcggcgtgcagtggggcgacagaagcagcagcttcagaaccagaaccgccatcgagaaggccgagagcagcaacaacgtgagactgagcatcagcagagccagcgacaccgaggccggcaagtaccagtgcgtggccgagctgtggagaaagaactacaacaacacctggaccagactggccgagagaaccagcaacctgctggagatcagagtgctgcagcccgtgaccaagctgcaggtgagcaagagcaagagaaccctgaccctggtggagaacaagcccatccagctgaactgcagcgtgaagagccagaccagccagaacagccacttcgccgtgctgtggtacgtgcacaagcccagcgacgccgacggcaagctgatcctgaagaccacccacaacagcgccttcgagtacggcacctacgccgaggaggagggcctgagagccagactgcagttcgagagacacgtgagcggcggcctgttcagcctgaccgtgcagagagccgaggtgagcgacagcggcagctactactgccacgtggaggagtggctgctgagccccaactacgcctggtacaagctggccgaggaggtgagcggcagaaccgaggtgaccgtgaagcagcccgacagcagactgagactgagccaggcccagggcaacctgagcgtgctggagaccagacaggtgcagctggagtgcgtggtgctgaacagaaccagcatcaccagccagctgatggtggagtggttcgtgtggaagcccaaccaccccgagagagagaccgtggccagactgagcagagacgccaccttccactacggcgagcaggccgccaagaacaacctgaagggcagactgcacctggagagccccagccccggcgtgtacagactgttcatccagaacgtggccgtgcaggacagcggcacctacagctgccacgtggaggagtggctgcccagccccagcggcatgtggtacaagagagccgaggacaccgccggccagaccgccctgaccgtgatgagacccgacgccagcctgcaggtggacaccgtggtgcccaacgccaccgtgagcgagaaggccgccttccagctggactgcagcatcgtgagcagaagcagccaggacagcagattcgccgtggcctggtacagcctgagaaccaaggccggcggcaagagaagcagccccggcctggaggagcaggaggaggagagagaggaggaggaggaggaggacgacgacgacgacgacgaccccaccgagagaaccgccctgctgagcgtgggccccgacgccgtgttcggccccgagggcagcccctgggagggcagactgagattccagagactgagccccgtgctgtacagactgaccgtgctgcaggccagcccccaggacaccggcaactacagctgccacgtggaggagtggctgcccagcccccagaaggagtggtacagactgaccgaggaggagagcgcccccatcggcatcagagtgctggacaccagccccaccctgcagagcatcatctgcagcaacgacgccctgttctacttcgtgttcttctaccccttccccatcttcggcatcctgatcatcaccatcctgctggtgagattcaagagcagaaacagcagcaagaacagcgacggcaagaacggcgtgcccctgctgtggatcaaggagccccacctgaactacagccccacctgcctggagccccccgtgctgagcatccaccccggcgccatcgactag

SEQ ID NO: 85071 - DNA, 3645 bp, Artificial Sequence; identical to SEQ ID NO: 85070
  Description of Artificial Sequence: Synthetic coding sequence

SEQ ID NO: 85072 - DNA, 3585 bp, Artificial Sequence
  Description of Artificial Sequence: Synthetic coding sequence
atgaagtgcttcttccccgtgctgagctgcctggccgtgctgggcgtggtgagcgcccagagacaggtgaccgtgcaggagggccccctgtacagaaccgagggcagccacatcaccatctggtgcaacgtgagcggctaccagggccccagcgagcagaacttccagtggagcatctacctgcccagcagccccgagagagaggtgcagatcgtgagcaccatggacagcagcttcccctacgccatctacacccagagagtgagaggcggcaagatcttcatcgagagagtgcagggcaacagcaccctgctgcacatcaccgacctgcaggccagagacgccggcgagtacgagtgccacacccccagcaccgacaagcagtacttcggcagctacagcgccaagatgaacctggtggtgatccccgacagcctgcagaccaccgccatgccccagaccctgcacagagtggagcaggaccccctggagctgacctgcgaggtggccagcgagaccatccagcacagccacctgagcgtggcctggctgagacagaaggtgggcgagaagcccgtggaggtgatcagcctgagcagagacttcatgctgcacagcagcagcgagtacgcccagagacagagcctgggcgaggtgagactggacaagctgggcagaaccaccttcagactgaccatcttccacctgcagcccagcgaccagggcgagttctactgcgaggccgccgagtggatccaggaccccgacggcagctggtacgccatgaccagaaagagaagcgagggcgccgtggtgaacgtgcagcccaccgacaaggagttcaccgtgagactggagaccgagaagagactgcacaccgtgggcgagcccgtggagttcagatgcatcctggaggcccagaacgtgcccgacagatacttcgccgtgagctgggccttcaacagcagcctgatcgccaccatgggccccaacgccgtgcccgtgctgaacagcgagttcgcccacagagaggccagaggccagctgaaggtggccaaggagagcgacagcgtgttcgtgctgaagatctaccacctgagacaggaggacagcggcaagtacaactgcagagtgaccgagagagagaagaccgtgaccggcgagttcatcgacaaggagagcaagagacccaagaacatccccatcatcgtgctgcccctgaagagcagcatcagcgtggaggtggccagcaacgccagcgtgatcctggagggcgaggacctgagattcagctgcagcgtgagaaccgccggcagaccccagggcagattcagcgtgatctggcagctggtggacagacagaacagaagaagcaacatcatgtggctggacagagacggcaccgtgcagcccggcagcagctactgggagagaagcagcttcggcggcgtgcagatggagcaggtgcagcccaacagcttcagcctgggcatcttcaacagcagaaaggaggacgagggccagtacgagtgccacgtgaccgagtgggtgagagccgtggacggcgagtggcagatcgtgggcgagagaagagccagcacccccatcagcatcaccgccctggagatgggcttcgccgtgaccgccatcagcagaacccccggcgtgacctacagcgacagcttcgacctgcagtgcatcatcaagccccactaccccgcctgggtgcccgtgagcgtgacctggagattccagcccgtgggcaccgtggagttccacgacctggtgaccttcaccagagacggcggcgtgcagtggggcgacagaagcagcagcttcagaaccagaaccgccatcgagaaggccgagagcagcaacaacgtgagactgagcatcagcagagccagcgacaccgaggccggcaagtaccagtgcgtggccgagctgtggagaaagaactacaacaacacctggaccagactggccgagagaaccagcaacctgctggagatcagagtgctgcagcccgtgaccaagctgcaggtgagcaagagcaagagaaccctgaccctggtggagaacaagcccatccagctgaactgcagcgtgaagagccagaccagccagaacagccacttcgccgtgctgtggtacgtgcacaagcccagcgacgccgacggcaagctgatcctgaagaccacccacaacagcgccttcgagtacggcacctacgccgaggaggagggcctgagagccagactgcagttcgagagacacgtgagcggcggcctgttcagcctgaccgtgcagagagccgaggtgagcgacagcggcagctactactgccacgtggaggagtggctgctgagccccaactacgcctggtacaagctggccgaggaggtgagcggcagaaccgaggtgaccgtgaagcagcccgacagcagactgagactgagccaggcccagggcaacctgagcgtgctggagaccagacaggtgcagctggagtgcgtggtgctgaacagaaccagcatcaccagccagctgatggtggagtggttcgtgtggaagcccaaccaccccgagagagagaccgtggccagactgagcagagacgccaccttccactacggcgagcaggccgccaagaacaacctgaagggcagactgcacctggagagccccagccccggcgtgtacagactgttcatccagaacgtggccgtgcaggacagcggcacctacagctgccacgtggaggagtggctgcccagccccagcggcatgtggtacaagagagccgaggacaccgccggccagaccgccctgaccgtgatgagacccgacgccagcctgcaggtggacaccgtggtgcccaacgccaccgtgagcgagaaggccgccttccagctggactgcagcatcgtgagcagaagcagccaggacagcagattcgccgtggcctggtacagcctgagaaccaaggccggcggcaagagaagcagccccggcctggaggagcaggaggaggagagagaggaggaggaggaggaggacgacgacgacgacgacgaccccaccgagagaaccgccctgctgagcgtgggccccgacgccgtgttcggccccgagggcagcccctgggagggcagactgagattccagagactgagccccgtgctgtacagactgaccgtgctgcaggccagcccccaggacaccggcaactacagctgccacgtggaggagtggctgcccagcccccagaaggagtggtacagactgaccgaggaggagagcgcccccatcggcatcagagtgctggacaccagccccaccctgcagagcatcatctgcagcaacgacgccctgttctacttcgtgttcttctaccccttccccatcttcggcatcctgatcatcaccatcctgctggtgagattcaagagcagaaacagcagcaagaacagcgacggcaagaacggcgtgcccctgctgtggatcaaggagccccacctgaactacagccccacctgcctggagccccccgtgctgagcatccaccccggcgccatcgactag

SEQ ID NO: 85073 - DNA, 726 bp, Artificial Sequence
  Description of Artificial Sequence: Synthetic coding sequence
atgggcaccgccagcagaagcaacatcgccagacacctgcagaccaacctgatcctgttctgcgtgggcgccgtgggcgcctgcaccctgagcgtgacccagccctggtacctggaggtggactacacccacgaggccgtgaccatcaagtgcaccttcagcgccaccggctgccccagcgagcagcccacctgcctgtggttcagatacggcgcccaccagcccgagaacctgtgcctggacggctgcaagagcgaggccgacaagttcaccgtgagagaggccctgaaggagaaccaggtgagcctgaccgtgaacagagtgaccagcaacgacagcgccatctacatctgcggcatcgccttccccagcgtgcccgaggccagagccaagcagaccggcggcggcaccaccctggtggtgagagagatcaagctgctgagcaaggagctgagaagcttcctgaccgccctggtgagcctgctgagcgtgtacgtgaccggcgtgtgcgtggccttcatcctgctgagcaagagcaagagcaaccccctgagaaacaaggagatcaaggaggacagccagaagaagaagagcgccagaagaatcttccaggagatcgcccaggagctgtaccacaagagacacgtggagaccaaccagcagagcgagaaggacaacaacacctacgagaacagaagagtgctgagcaactacgagagaccctag

SEQ ID NO: 85074 - DNA, 1842 bp, Artificial Sequence
  Description of Artificial Sequence: Synthetic coding sequence
atgggcgccctgagacccaccctgctgccccccagcctgcccctgctgctgctgctgatgctgggcatgggctgctgggccagagaggtgctggtgcccgagggccccctgtacagagtggccggcaccgccgtgagcatcagctgcaacgtgaccggctacgagggccccgcccagcagaacttcgagtggttcctgtacagacccgaggcccccgacaccgccctgggcatcgtgagcaccaaggacacccagttcagctacgccgtgttcaagagcagagtggtggccggcgaggtgcaggtgcagagactgcagggcgacgccgtggtgctgaagatcgccagactgcaggcccaggacgccggcatctacgagtgccacacccccagcaccgacaccagatacctgggcagctacagcggcaaggtggagctgagagtgctgcccgacgtgctgcaggtgagcgccgccccccccggccccagaggcagacaggcccccaccagcccccccagaatgaccgtgcacgagggccaggagctggccctgggctgcctggccagaaccagcacccagaagcacacccacctggccgtgagcttcggcagaagcgtgcccgaggcccccgtgggcagaagcaccctgcaggaggtggtgggcatcagaagcgacctggccgtggaggccggcgccccctacgccgagagactggccgccggcgagctgagactgggcaaggagggcaccgacagatacagaatggtggtgggcggcgcccaggccggcgacgccggcacctaccactgcaccgccgccgagtggatccaggaccccgacggcagctgggcccagatcgccgagaagagagccgtgctggcccacgtggacgtgcagaccctgagcagccagctggccgtgaccgtgggccccggcgagagaagaatcggccccggcgagcccctggagctgctgtgcaacgtgagcggcgccctgccccccgccggcagacacgccgcctacagcgtgggctgggagatggcccccgccggcgcccccggccccggcagactggtggcccagctggacaccgagggcgtgggcagcctgggccccggctacgagggcagacacatcgccatggagaaggtggccagcagaacctacagactgagactggaggccgccagacccggcgacgccggcacctacagatgcctggccaaggcctacgtgagaggcagcggcaccagactgagagaggccgccagcgccagaagcagacccctgcccgtgcacgtgagagaggagggcgtggtgctggaggccgtggcctggctggccggcggcaccgtgtacagaggcgagaccgccagcctgctgtgcaacatcagcgtgagaggcggcccccccggcctgagactggccgccagctggtgggtggagagacccgaggacggcgagctgagcagcgtgcccgcccagctggtgggcggcgtgggccaggacggcgtggccgagctgggcgtgagacccggcggcggccccgtgagcgtggagctggtgggccccagaagccacagactgagactgcacagcctgggccccgaggacgagggcgtgtaccactgcgcccccagcgcctgggtgcagcacgccgactacagctggtaccaggccggcagcgccagaagcggccccgtgaccgtgtacccctacatgcacgccctggacaccctgttcgtgcccctgctggtgggcaccggcgtggccctggtgaccggcgccaccgtgctgggcaccatcacctgctgcttcatgaagagactgagaaagagatag

SEQ ID NO: 85075 - DNA, 1581 bp, Artificial Sequence
  Description of Artificial Sequence: Synthetic coding sequence
atgggcgccctgagacccaccctgctgccccccagcctgcccctgctgctgctgctgatgctgggcatgggctgctgggccagagaggtgctggtgcccgagggccccctgtacagagtggccggcaccgccgtgagcatcagctgcaacgtgaccggctacgagggccccgcccagcagaacttcgagtggttcctgtacagacccgaggcccccgacaccgccctgggcatcgtgagcaccaaggacacccagttcagctacgccgtgttcaagagcagagtggtggccggcgaggtgcaggtgcagagactgcagggcgacgccgtggtgctgaagatcgccagactgcaggcccaggacgccggcatctacgagtgccacacccccagcaccgacaccagatacctgggcagctacagcggcaaggtggagctgagagtgctgcccgacgtgctgcaggtgagcgccgccccccccggccccagaggcagacaggcccccaccagcccccccagaatgaccgtgcacgagggccaggagctggccctgggctgcctggccagaaccagcacccagaagcacacccacctggccgtgagcttcggcagaagcgtgcccgaggcccccgtgggcagaagcaccctgcaggaggtggtgggcatcagaagcgacctggccgtggaggccggcgccccctacgccgagagactggccgccggcgagctgagactgggcaaggagggcaccgacagatacagaatggtggtgggcggcgcccaggccggcgacgccggcacctaccactgcaccgccgccgagtggatccaggaccccgacggcagctgggcccagatcgccgagaagagagccgtgctggcccacgtggacgtgcagaccctgagcagccagctggccgtgaccgtgggccccggcgagagaagaatcggccccggcgagcccctggagctgctgtgcaacgtgagcggcgccctgccccccgccggcagacacgccgcctacagcgtgggctgggagatggcccccgccggcgcccccggccccggcagactggtggcccagctggacaccgagggcgtgggcagcctgggccccggctacgagggcagacacatcgccatggagaaggtggccagcagaacctacagactgagactggaggccgccagacccggcgacgccggcacctacagatgcctggccaaggcctacgtgagaggcagcggcaccagactgagagaggccgccagcgccagaagcagacccctgcccgtgcacgtgagagaggagggcgtggtgctggaggccgtggcctggctggccggcggcaccgtgtacagaggcgagaccgccagcctgctgtgcaacatcagcgtgagaggcggcccccccggcctgagaagcgccagaagcggccccgtgaccgtgtacccctacatgcacgccctggacaccctgttcgtgcccctgctggtgggcaccggcgtggccctggtgaccggcgccaccgtgctgggcaccatcacctgctgcttcatgaagagactgagaaagagatag

SEQ ID NO: 85076 - DNA, 1842 bp, Artificial Sequence; identical to SEQ ID NO: 85074
  Description of Artificial Sequence: Synthetic coding sequence

SEQ ID NO: 85077 - DNA, 906 bp, Artificial Sequence
  Description of Artificial Sequence: Synthetic coding sequence
atgggcgccctgagacccaccctgctgccccccagcctgcccctgctgctgctgctgatgctgggcatgggctgctgggccagagaggtgctggtgcccgagggccccctgtacagagtggccggcaccgccgtgagcatcagctgcaacgtgaccggctacgagggccccgcccagcagaacttcgagtggttcctgtacagacccgaggcccccgacaccgccctgggcatcgtgagcaccaaggacacccagttcagctacgccgtgttcaagagcagagtggtggccggcgaggtgcaggtgcagagactgcagggcgacgccgtggtgctgaagatcgccagactgcaggcccaggacgccggcatctacgagtgccacacccccagcaccgacaccagatacctgggcagctacagcggcaaggtggagctgagagtgctgcccgacgtgctgcaggtgagcgccgccccccccggccccagaggcagacaggcccccaccagcccccccagaatgaccgtgcacgagggccaggagctggccctgggctgcctggccagaaccagcacccagaagcacacccacctggccgtgagcttcggcagaagcgtgcccgaggcccccgtgggcagaagcaccctgcaggaggtggtgggcatcagaagcgacctggccgtggaggccggcgccccctacgccgagagactggccgccggcgagctgagactgggcaaggagggcaccgacagatacagaatggtggtgggcggcgcccaggccggcgacgccggcacctaccactgcaccgccgccgagtggatccaggaccccgacggcagctgggcccagatcgccgagaagagagccgtgctggcccacgtggacgtgcagaccctgtag

SEQ ID NO: 85078 - DNA, 2154 bp, Artificial Sequence
  Description of Artificial Sequence: Synthetic coding sequence
atggtgtggtgcctgggcctggccgtgctgagcctggtgatcagccagggcgccgacggcagaggcaagcccgaggtggtgagcgtggtgggcagagccggcgagagcgtggtgctgggctgcgacctgctgccccccgccggcagaccccccctgcacgtgatcgagtggctgagattcggcttcctgctgcccatcttcatccagttcggcctgtacagccccagaatcgaccccgactacgtgggcagagtgagactgcagaagggcgccagcctgcagatcgagggcctgagagtggaggaccagggctggtacgagtgcagagtgttcttcctggaccagcacatccccgaggacgacttcgccaacggcagctgggtgcacctgaccgtgaacagccccccccagttccaggagaccccccccgccgtgctggaggtgcaggagctggagcccgtgaccctgagatgcgtggccagaggcagccccctgccccacgtgacctggaagctgagaggcaaggacctgggccagggccagggccaggtgcaggtgcagaacggcaccctgagaatcagaagagtggagagaggcagcagcggcgtgtacacctgccaggccagcagcaccgagggcagcgccacccacgccacccagctgctggtgctgggcccccccgtgatcgtggtgccccccaagaacagcaccgtgaacgccagccaggacgtgagcctggcctgccacgccgaggcctaccccgccaacctgacctacagctggttccaggacaacatcaacgtgttccacatcagcagactgcagcccagagtgagaatcctggtggacggcagcctgagactgctggccacccagcccgacgacgccggctgctacacctgcgtgcccagcaacggcctgctgcacccccccagcgccagcgcctacctgaccgtgctgtaccccgcccaggtgaccgccatgccccccgagacccccctgcccatcggcatgcccggcgtgatcagatgccccgtgagagccaacccccccctgctgttcgtgagctggaccaaggacggcaaggccctgcagctggacaagttccccggctggagccagggcaccgagggcagcctgatcatcgccctgggcaacgaggacgccctgggcgagtacagctgcaccccctacaacagcctgggcaccgccggccccagccccgtgaccagagtgctgctgaaggccccccccgccttcatcgagagacccaaggaggagtacttccaggaggtgggcagagagctgctgatcccctgcagcgcccagggcgaccccccccccgccgccccccccagccccctgcccggccccggccccctgctgcagtacctgagcctgcccttcttcagagagatgaacgtggacggcgactggccccccctggaggagcccagccccgccgccccccccgactacatggacaccagaagatgccccaccagcagcttcctgagaagccccgagaccccccccgtgagccccagagagagcctgcccggcgccgtggtgggcgccggcgccaccgccgagcccccctacaccgccctggccgactggaccctgagagagagactgctgcccggcctgctgcccgccgcccccagaggcagcctgaccagccagagcagcggcagaggcagcgccagcttcctgagaccccccagcaccgcccccagcgccggcggcagctacctgagccccgcccccggcgacaccagcagctgggccagcggccccgagagatggcccagaagagagcacgtggtgaccgtgagcaagagaagaaacaccagcgtggacgagaactacgagtgggacagcgagttccccggcgacatggagctgctggagaccctgcacctgggcctggccagcagcagactgagacccgaggccgagcccgagctgggcgtgaagacccccgaggagggctgcctgctgaacaccgcccacgtgaccggccccgaggccagatgcgccgccctgagagaggagttcctggccttcagaagaagaagagacgccaccagagccagactgcccgcctacagacagcccgtgccccaccccgagcaggccaccctgctgtag

SEQ ID NO: 85079 - DNA, 3492 bp, Artificial Sequence
  Description of Artificial Sequence: Synthetic coding sequence
atggtgtggtgcctgggcctggccgtgctgagcctggtgatcagccagggcgccgacggcagaggcaagcccgaggtggtgagcgtggtgggcagagccggcgagagcgtggtgctgggctgcgacctgctgccccccgccggcagaccccccctgcacgtgatcgagtggctgagattcggcttcctgctgcccatcttcatccagttcggcctgtacagccccagaatcgaccccgactacgtgggcagagtgagactgcagaagggcgccagcctgcagatcgagggcctgagagtggaggaccagggctggtacgagtgcagagtgttcttcctggaccagcacatccccgaggacgacttcgccaacggcagctgggtgcacctgaccgtgaacagccccccccagttccaggagaccccccccgccgtgctggaggtgcaggagctggagcccgtgaccctgagatgcgtggccagaggcagccccctgccccacgtgacctggaagctgagaggcaaggacctgggccagggccagggccaggtgcaggtgcagaacggcaccctgagaatcagaagagtggagagaggcagcagcggcgtgtacacctgccaggccagcagcaccgagggcagcgccacccacgccacccagctgctggtgctgggcccccccgtgatcgtggtgccccccaagaacagcaccgtgaacgccagccaggacgtgagcctggcctgccacgccgaggcctaccccgccaacctgacctacagctggttccaggacaacatcaacgtgttccacatcagcagactgcagcccagagtgagaatcctggtggacggcagcctgagactgctggccacccagcccgacgacgccggctgctacacctgcgtgcccagcaacggcctgctgcacccccccagcgccagcgcctacctgaccgtgctgtgcatgcccggcgtgatcagatgccccgtgagagccaacccccccctgctgttcgtgagctggaccaaggacggcaaggccctgcagctggacaagttccccggctggagccagggcaccgagggcagcctgatcatcgccctgggcaacgaggacgccctgggcgagtacagctgcaccccctacaacagcctgggcaccgccggccccagccccgtgaccagagtgctgctgaaggccccccccgccttcatcgagagacccaaggaggagtacttccaggaggtgggcagagagctgctgatcccctgcagcgcccagggcgaccccccccccgtggtgagctggaccaaggtgggcagaggcctgcagggccaggcccaggtggacagcaacagcagcctgatcctgagacccctgaccaaggaggcccacggccactgggagtgcagcgccagcaacgccgtggccagagtggccaccagcaccaacgtgtacgtgctgggcaccagcccccacgtggtgaccaacgtgagcgtggtggccctgcccaagggcgccaacgtgagctgggagcccggcttcgacggcggctacctgcagagattcagcgtgtggtacacccccctggccaagagacccgacagaatgcaccacgactgggtgagcctggccgtgcccgtgggcgccgcccacctgctggtgcccggcctgcagccccacacccagtaccagttcagcgtgctggcccagaacaagctgggcagcggccccttcagcgagatcgtgctgagcgcccccgagggcctgcccaccacccccgccgcccccggcctgccccccaccgagatccccccccccctgagcccccccagaggcctggtggccgtgagaacccccagaggcgtgctgctgcactgggacccccccgagctggtgcccaagagactggacggctacgtgctggagggcagacagggcagccagggctgggaggtgctggaccccgccgtggccggcaccgagaccgagctgctggtgcccggcctgatcaaggacgtgctgtacgagttcagactggtggccttcgccggcagcttcgtgagcgaccccagcaacaccgccaacgtgagcaccagcggcctggaggtgtaccccagcagaacccagctgcccggcctgctgccccagcccgtgctggccggcgtggtgggcggcgtgtgcttcctgggcgtggccgtgctggtgagcatcctggccggctgcctgctgaacagaagaagagccgccagaagaagaagaaagagactgagacaggacccccccctgatcttcagccccaccggcaagagcgccgcccccagcgccctgggcagcggcagccccgacagcgtggccaagctgaagctgcagggcagccccgtgcccagcctgagacagagcctgctgtggggcgaccccgccggcacccccagcccccaccccgacccccccagcagcagaggccccctgcccctggagcccatctgcagaggccccgacggcagattcgtgatgggccccaccgtggccgccccccaggagagaagcggcagagagcaggccgagcccagaacccccgcccagagactggccagaagcttcgactgcagcagcagcagccccagcggcgccccccagcccctgtgcatcgaggacatcagccccgtggcccccccccccgccgccccccccagccccctgcccggccccggccccctgctgcagtacctgagcctgcccttcttcagagagatgaacgtggacggcgactggccccccctggaggagcccagccccgccgccccccccgactacatggacaccagaagatgccccaccagcagcttcctgagaagccccgagaccccccccgtgagccccagagagagcctgcccggcgccgtggtgggcgccggcgccaccgccgagcccccctacaccgccctggccgactggaccctgagagagagactgctgcccggcctgctgcccgccgcccccagaggcagcctgaccagccagagcagcggcagaggcagcgccagcttcctgagaccccccagcaccgcccccagcgccggcggcagctacctgagccccgcccccggcgacaccagcagctgggccagcggccccgagagatggcccagaagagagcacgtggtgaccgtgagcaagagaagaaacaccagcgtggacgagaactacgagtgggacagcgagttccccggcgacatggagctgctggagaccctgcacctgggcctggccagcagcagactgagacccgaggccgagcccgagctgggcgtgaagacccccgaggagggctgcctgctgaacaccgcccacgtgaccggccccgaggccagatgcgccgccctgagagaggagttcctggccttcagaagaagaagagacgccaccagagccagactgcccgcctacagacagcccgtgccccaccccgagcaggccaccctgctgtag

SEQ ID NO: 85080 - DNA, 3540 bp, Artificial Sequence
  Description of Artificial Sequence: Synthetic coding sequence
atggtgtggtgcctgggcctggccgtgctgagcctggtgatcagccagggcgccgacggcagaggcaagcccgaggtggtgagcgtggtgggcagagccggcgagagcgtggtgctgggctgcgacctgctgccccccgccggcagaccccccctgcacgtgatcgagtggctgagattcggcttcctgctgcccatcttcatccagttcggcctgtacagccccagaatcgaccccgactacgtgggcagagtgagactgcagaagggcgccagcctgcagatcgagggcctgagagtggaggaccagggctggtacgagtgcagagtgttcttcctggaccagcacatccccgaggacgacttcgccaacggcagctgggtgcacctgaccgtgaacagccccccccagttccaggagaccccccccgccgtgctggaggtgcaggagctggagcccgtgaccctgagatgcgtggccagaggcagccccctgccccacgtgacctggaagctgagaggcaaggacctgggccagggccagggccaggtgcaggtgcagaacggcaccctgagaatcagaagagtggagagaggcagcagcggcgtgtacacctgccaggccagcagcaccgagggcagcgccacccacgccacccagctgctggtgctgggcccccccgtgatcgtggtgccccccaagaacagcaccgtgaacgccagccaggacgtgagcctggcctgccacgccgaggcctaccccgccaacctgacctacagctggttccaggacaacatcaacgtgttccacatcagcagactgcagcccagagtgagaatcctggtggacggcagcctgagactgctggccacccagcccgacgacgccggctgctacacctgcgtgcccagcaacggcctgctgcacccccccagcgccagcgcctacctgaccgtgctgtaccccgcccaggtgaccgccatgccccccgagacccccctgcccatcggcatgcccggcgtgatcagatgccccgtgagagccaacccccccctgctgttcgtgagctggaccaaggacggcaaggccctgcagctggacaagttccccggctggagccagggcaccgagggcagcctgatcatcgccctgggcaacgaggacgccctgggcgagtacagctgcaccccctacaacagcctgggcaccgccggccccagccccgtgaccagagtgctgctgaaggccccccccgccttcatcgagagacccaaggaggagtacttccaggaggtgggcagagagctgctgatcccctgcagcgcccagggcgaccccccccccgtggtgagctggaccaaggtgggcagaggcctgcagggccaggcccaggtggacagcaacagcagcctgatcctgagacccctgaccaaggaggcccacggccactgggagtgcagcgccagcaacgccgtggccagagtggccaccagcaccaacgtgtacgtgctgggcaccagcccccacgtggtgaccaacgtgagcgtggtggccctgcccaagggcgccaacgtgagctgggagcccggcttcgacggcggctacctgcagagattcagcgtgtggtacacccccctggccaagagacccgacagaatgcaccacgactgggtgagcctggccgtgcccgtgggcgccgcccacctgctggtgcccggcctgcagccccacacccagtaccagttcagcgtgctggcccagaacaagctgggcagcggccccttcagcgagatcgtgctgagcgcccccgagggcctgcccaccacccccgccgcccccggcctgccccccaccgagatccccccccccctgagcccccccagaggcctggtggccgtgagaacccccagaggcgtgctgctgcactgggacccccccgagctggtgcccaagagactggacggctacgtgctggagggcagacagggcagccagggctgggaggtgctggaccccgccgtggccggcaccgagaccgagctgctggtgcccggcctgatcaaggacgtgctgtacgagttcagactggtggccttcgccggcagcttcgtgagcgaccccagcaacaccgccaacgtgagcaccagcggcctggaggtgtaccccagcagaacccagctgcccggcctgctgccccagcccgtgctggccggcgtggtgggcggcgtgtgcttcctgggcgtggccgtgctggtgagcatcctggccggctgcctgctgaacagaagaagagccgccagaagaagaagaaagagactgagacaggacccccccctgatcttcagccccaccggcaagagcgccgcccccagcgccctgggcagcggcagccccgacagcgtggccaagctgaagctgcagggcagccccgtgcccagcctgagacagagcctgctgtggggcgaccccgccggcacccccagcccccaccccgacccccccagcagcagaggccccctgcccctggagcccatctgcagaggccccgacggcagattcgtgatgggccccaccgtggccgccccccaggagagaagcggcagagagcaggccgagcccagaacccccgcccagagactggccagaagcttcgactgcagcagcagcagccccagcggcgccccccagcccctgtgcatcgaggacatcagccccgtggcccccccccccgccgccccccccagccccctgcccggccccggccccctgctgcagtacctgagcctgcccttcttcagagagatgaacgtggacggcgactggccccccctggaggagcccagccccgccgccccccccgactacatggacaccagaagatgccccaccagcagcttcctgagaagccccgagaccccccccgtgagccccagagagagcctgcccggcgccgtggtgggcgccggcgccaccgccgagcccccctacaccgccctggccgactggaccctgagagagagactgctgcccggcctgctgcccgccgcccccagaggcagcctgaccagccagagcagcggcagaggcagcgccagcttcctgagaccccccagcaccgcccccagcgccggcggcagctacctgagccccgcccccggcgacaccagcagctgggccagcggccccgagagatggcccagaagagagcacgtggtgaccgtgagcaagagaagaaacaccagcgtggacgagaactacgagtgggacagcgagttccccggcgacatggagctgctggagaccctgcacctgggcctggccagcagcagactgagacccgaggccgagcccgagctgggcgtgaagacccccgaggagggctgcctgctgaacaccgcccacgtgaccggccccgaggccagatgcgccgccctgagagaggagttcctggccttcagaagaagaagagacgccaccagagccagactgcccgcctacagacagcccgtgccccaccccgagcaggccaccctgctgtag

SEQ ID NO: 85081 - DNA, 4050 bp, Artificial Sequence
  Description of Artificial Sequence: Synthetic coding sequence
atgatctggtacgtggccaccttcatcgccagcgtgatcggcaccagaggcctggccgccgagggcgcccacggcctgagagaggagcccgagttcgtgaccgccagagccggcgagagcgtggtgctgagatgcgacgtgatccaccccgtgaccggccagccccccccctacgtggtggagtggttcaagttcggcgtgcccatccccatcttcatcaagttcggctactaccccccccacgtggaccccgagtacgccggcagagccagcctgcacgacaaggccagcctgagactggagcaggtgagaagcgaggaccagggctggtacgagtgcaaggtgctgatgctggaccagcagtacgacaccttccacaacggcagctgggtgcacctgaccatcaacgccccccccaccttcaccgagacccccccccagtacatcgaggccaaggagggcggcagcatcaccatgacctgcaccgccttcggcaaccccaagcccatcgtgacctggctgaaggagggcaccctgctgggcgccagcggcaagtaccaggtgagcgacggcagcctgaccgtgaccagcgtgagcagagaggacagaggcgcctacacctgcagagcctacagcatccagggcgaggccgtgcacaccacccacctgctggtgcagggcccccccttcatcgtgagcccccccgagaacatcaccgtgaacatcagccaggacgccctgctgacctgcagagccgaggcctaccccggcaacctgacctacacctggtactggcaggacgagaacgtgtacttccagaacgacctgaagctgagagtgagaatcctgatcgacggcaccctgatcatcttcagagtgaagcccgaggacagcggcaagtacacctgcgtgcccagcaacagcctgggcagaagccccagcgccagcgcctacctgaccgtgcagtaccccgccagagtgctgaacatgccccccgtgatctacgtgcccgtgggcatccacggctacatcagatgccccgtggacgccgagccccccgccaccgtggtgaagtggaacaaggacggcagacccctgcaggtggagaagaacctgggctggaccctgatggaggacggcagcatcagaatcgaggaggccaccgaggaggccctgggcacctacacctgcgtgccctacaacaccctgggcaccatgggccagagcgcccccgccagactggtgctgaaggaccccccctacttcaccgtgctgcccggctgggagtacagacaggaggccggcagagagctgctgatcccctgcgccgccgccggcgaccccttccccgtgatcacctggagaaaggtgggcaagcccagcagaagcaagcacagcgccctgcccagcggcagcctgcagttcagagccctgagcaaggaggaccacggcgagtgggagtgcgtggccaccaacgtggtgaccagcatcaccgccagcacccacctgaccgtgatcggcaccagcccccacgcccccggcagcgtgagagtgcaggtgagcatgaccaccgccaacgtgagctgggagcccggctacgacggcggctacgagcagaccttcagcgtgtggatgaagagagcccagttcggcccccacgactggctgagcctgcccgtgccccccggccccagctggctgctggtggacaccctggagcccgagaccgcctaccagttcagcgtgctggcccagaacaagctgggcaccagcgccttcagcgaggtggtgaccgtgaacaccctggccttccccatcaccacccccgagcccctggtgctggtgaccccccccagatgcctgatcgccaacagaacccagcagggcgtgctgctgagctggctgccccccgccaaccacagcttccccatcgacagatacatcatggagttcagagtggccgagagatgggagctgctggacgacggcatccccggcaccgagggcgagttcttcgccaaggacctgagccaggacacctggtacgagttcagagtgctggccgtgatgcaggacctgatcagcgagcccagcaacatcgccggcgtgagcagcaccgacatcttcccccagcccgacctgaccgaggacggcctggccagacccgtgctggccggcatcgtggccaccatctgcttcctggccgccgccatcctgttcagcaccctggccgcctgcttcgtgaacaagcagagaaagagaaagctgaagagaaagaaggacccccccctgagcatcacccactgcagaaagagcctggagagccccctgagcagcggcaaggtgagccccgagagcatcagaaccctgagagcccccagcgagagcagcgacgaccagggccagcccgccgccaagagaatgctgagccccaccagagagaaggagctgagcctgtacaagaagaccaagagagccatcagcagcaagaagtacagcgtggccaaggccgaggccgaggccgaggccaccacccccatcgagctgatcagcagaggccccgacggcagattcgtgatggaccccgccgagatggagcccagcctgaagagcagaagaatcgagggcttccccttcgccgaggagaccgacatgtaccccgagttcagacagagcgacgaggagaacgaggaccccctggtgcccaccagcgtggccgccctgaagagccagctgacccccctgagcagcagccaggagagctacctgcccccccccgcctacagccccagattccagcccagaggcctggagggccccggcggcctggagggcagactgcaggccaccggccaggccagaccccccgcccccagacccttccaccacggccagtactacggctacctgagcagcagcagccccggcgaggtggagcccccccccttctacgtgcccgaggtgggcagccccctgagcagcgtgatgagcagcccccccctgcccaccgagggccccttcggccaccccaccatccccgaggagaacggcgagaacgccagcaacagcaccctgcccctgacccagacccccaccggcggcagaagccccgagccctggggcagacccgagttccccttcggcggcctggagacccccgccatgatgttcccccaccagctgcccccctgcgacgtgcccgagagcctgcagcccaaggccggcctgcccagaggcctgccccccaccagcctgcaggtgcccgccgcctaccccggcatcctgagcctggaggcccccaagggctgggccggcaagagccccggcagaggccccgtgcccgccccccccgccgccaagtggcaggacagacccatgcagcccctggtgagccagggccagctgagacacaccagccagggcatgggcatccccgtgctgccctaccccgagcccgccgagcccggcgcccacggcggccccagcaccttcggcctggacaccagatggtacgagccccagcccagacccagacccagccccagacaggccagaagagccgagcccagcctgcaccaggtggtgctgcagcccagcagactgagccccctgacccagagccccctgagcagcagaaccggcagccccgagctggccgccagagccagacccagacccggcctgctgcagcaggccgagatgagcgagatcaccctgcagccccccgccgccgtgagcttcagcagaaagagcacccccagcaccggcagccccagccagagcagcagaagcggcagccccagctacagacccgccatgggcttcaccaccctggccaccggctaccccagccccccccccggccccgcccccgccggccccggcgacagcctggacgtgttcggccagacccccagccccagaagaaccggcgaggagctgctgagacccgagacccccccccccaccctgcccaccagcggcaagctgcagagagacagacccgcccccgccaccagcccccccgagagagccctgagcaagctgtag

SEQ ID NO: 85082 - DNA, 1509 bp, Artificial Sequence
  Description of Artificial Sequence: Synthetic coding sequence
atggcctggcccaagctgcccgccccctggctgctgctgtgcacctggctgcccgccggctgcctgagcctgctggtgaccgtgcagcacaccgagagatacgtgaccctgttcgccagcatcatcctgaagtgcgactacaccaccagcgcccagctgcaggacgtggtggtgacctggagattcaagagcttctgcaaggaccccatcttcgactactacagcgccagctaccaggccgccctgagcctgggccaggaccccagcaacgactgcaacgacaaccagagagaggtgagaatcgtggcccagagaagaggccagaacgagcccgtgctgggcgtggactacagacagagaaagatcaccatccagaacagagccgacctggtgatcaacgaggtgatgtggtgggaccacggcgtgtactactgcaccatcgaggcccccggcgacaccagcggcgaccccgacaaggaggtgaagctgatcgtgctgcactggctgaccgtgatcttcatcatcctgggcgccctgctgctgctgctgctgatcggcgtgtgctggtgccagtgctgcccccagtactgctgctgctacatcagatgcccctgctgccccgcccactgctgctgccccgaggaggacctgagcctgcccagcagcctgccccagatgcccatgacccagaccaccaaccagccccccatcgccaacggcgtgctggagtacctggagaaggagctgagaaacctgaacctggcccagcccctgccccccgacctgaagggcagattcggccacccctgcagcatgctgagcagcctgggcagcgaggtggtggagagaagaatcatccacctgccccccctgatcagagacctgagcagcagcagaagaaccagcgacagcctgcaccagcagtggctgacccccatccccagcagaccctgggacctgagagagggcagaagccaccaccactaccccgacttccaccaggagctgcaggacagaggccccaagagctgggccctggagagaagagagctggaccccagctggagcggcagacacagaagcagcagactgaacggcagccccatccactggagcgacagagacagcctgagcgacgtgcccagcagcagcgaggccagatggagacccagccacccccccttcagaagcagatgccaggagagacccagaagacccagccccagagagagcacccagagacacggcagaagaagaagacacagaagctacagcccccccctgcccagcggcctgagcagctggagcagcgaggaggacaaggagagacagccccagagctggagagcccacagaagaggcagccacagcccccactggcccgaggagaagccccccagctacagaagcctggacatcacccccggcaagaacagcagaaagaagggcagcgtggagagaagaagcgagaaggacagcagccacagcggcagaagcgtggtgatctag

SEQ ID NO: 85083 - DNA, 1641 bp, Artificial Sequence
  Description of Artificial Sequence: Synthetic coding sequence
atggcctggcccaagctgcccgccccctggctgctgctgtgcacctggctgcccgccggctgcctgagcctgctggtgaccgtgcagcacaccgagagatacgtgaccctgttcgccagcatcatcctgaagtgcgactacaccaccagcgcccagctgcaggacgtggtggtgacctggagattcaagagcttctgcaaggaccccatcttcgactactacagcgccagctaccaggccgccctgagcctgggccaggaccccagcaacgactgcaacgacaaccagagagaggtgagaatcgtggcccagagaagaggccagaacgagcccgtgctgggcgtggactacagacagagaaagatcaccatccagaacagagccgacctggtgatcaacgaggtgatgtggtgggaccacggcgtgtactactgcaccatcgaggcccccggcgacaccagcggcgaccccgacaaggaggtgaagctgatcgtgctgcactggctgaccgtgatcttcatcatcctgggcgccctgctgctgctgctgctgatcggcgtgtgctggtgccagtgctgcccccagtactgctgctgctacatcagatgcccctgctgccccgcccactgctgctgccccgaggaggccctggccagacacagatacatgaagcaggcccaggccctgggcccccagatgatgggcaagcccctgtactggggcgccgacagaagcagccaggtgagcagctaccccatgcaccccctgctgcagagagacctgagcctgcccagcagcctgccccagatgcccatgacccagaccaccaaccagccccccatcgccaacggcgtgctggagtacctggagaaggagctgagaaacctgaacctggcccagcccctgccccccgacctgaagggcagattcggccacccctgcagcatgctgagcagcctgggcagcgaggtggtggagagaagaatcatccacctgccccccctgatcagagacctgagcagcagcagaagaaccagcgacagcctgcaccagcagtggctgacccccatccccagcagaccctgggacctgagagagggcagaagccaccaccactaccccgacttccaccaggagctgcaggacagaggccccaagagctgggccctggagagaagagagctggaccccagctggagcggcagacacagaagcagcagactgaacggcagccccatccactggagcgacagagacagcctgagcgacgtgcccagcagcagcgaggccagatggagacccagccacccccccttcagaagcagatgccaggagagacccagaagacccagccccagagagagcacccagagacacggcagaagaagaagacacagaagctacagcccccccctgcccagcggcctgagcagctggagcagcgaggaggacaaggagagacagccccagagctggagagcccacagaagaggcagccacagcccccactggcccgaggagaagccccccagctacagaagcctggacatcacccccggcaagaacagcagaaagaagggcagcgtggagagaagaagcgagaaggacagcagccacagcggcagaagcgtggtgatctag

SEQ ID NO: 85084 - DNA, 639 bp, Artificial Sequence
  Description of Artificial Sequence: Synthetic coding sequence
atggcctggcccaagctgcccgccccctggctgctgctgtgcacctggctgcccgccggctgcctgagcctgctggtgaccgtgcagcacaccgagagatacgtgaccctgttcgccagcatcatcctgaagtgcgactacaccaccagcgcccagctgcaggacgtggtggtgacctggagattcaagagcttctgcaaggaccccatcttcgactactacagcgccagctaccaggccgccctgagcctgggccaggaccccagcaacgactgctgctgctgccccgaggaggccctggccagacacagatacatgaagcaggcccaggccctgggcccccagatgatgggcaagcccctgtactggggcgccgacagaagcagccaggtgagcagctaccccatgcaccccctgctgcagagagacctgagcctgcccagcagcctgccccagatgcccatgacccagaccaccaaccagccccccatcgccaacggcgtgctggagtacctggagaaggagctgagaaacctgaacctggcccagcccctgccccccgacctgaagggcagattcggccacccctgcagcatgctgagcagcctgggcagcgagaaccagatcgaggagttctag

SEQ ID NO: 85085 - DNA, 1374 bp, Artificial Sequence
  Description of Artificial Sequence: Synthetic coding sequence
atggcctggcccaagctgcccgccccctggctgctgctgtgcacctggctgcccgccggctgcctgagcctgctggtgaccgtgcagcacaccgagagatacgtgaccctgttcgccagcatcatcctgaagtgcgactacaccaccagcgcccagctgcaggacgtggtggtgacctggagattcaagagcttctgcaaggaccccatcttcgactactacagcgccagctaccaggccgccctgagcctgggccaggaccccagcaacgactgcaacgacaaccagagagaggtgagaatcgtggcccagagaagaggccagaacgagcccgtgctgggcgtggactacagacagagaaagatcaccatccagaaccccctggccagacacagatacatgaagcaggcccaggccctgggcccccagatgatgggcaagcccctgtactggggcgccgacagaagcagccaggtgagcagctaccccatgcaccccctgctgcagagagacctgagcctgcccagcagcctgccccagatgcccatgacccagaccaccaaccagccccccatcgccaacggcgtgctggagtacctggagaaggagctgagaaacctgaacctggcccagcccctgccccccgacctgaagggcagattcggccacccctgcagcatgctgagcagcctgggcagcgaggtggtggagagaagaatcatccacctgccccccctgatcagagacctgagcagcagcagaagaaccagcgacagcctgcaccagcagtggctgacccccatccccagcagaccctgggacctgagagagggcagaagccaccaccactaccccgacttccaccaggagctgcaggacagaggccccaagagctgggccctggagagaagagagctggaccccagctggagcggcagacacagaagcagcagactgaacggcagccccatccactggagcgacagagacagcctgagcgacgtgcccagcagcagcgaggccagatggagacccagccacccccccttcagaagcagatgccaggagagacccagaagacccagccccagagagagcacccagagacacggcagaagaagaagacacagaagctacagcccccccctgcccagcggcctgagcagctggagcagcgaggaggacaaggagagacagccccagagctggagagcccacagaagaggcagccacagcccccactggcccgaggagaagccccccagctacagaagcctggacatcacccccggcaagaacagcagaaagaagggcagcgtggagagaagaagcgagaaggacagcagccacagcggcagaagcgtggtgatctag

SEQ ID NO: 85086 - DNA, 1545 bp, Artificial Sequence
  Description of Artificial Sequence: Synthetic coding sequence
atggccggcaacatcttctgccccttcgccctgttcttcctgcccatgagcagagtgggccacctgcagcacttcctgctgctgctggccctgggctgcctgagcctgctggtgaccgtgcagcacaccgagagatacgtgaccctgttcgccagcatcatcctgaagtgcgactacaccaccagcgcccagctgcaggacgtggtggtgacctggagattcaagagcttctgcaaggaccccatcttcgactactacagcgccagctaccaggccgccctgagcctgggccaggaccccagcaacgactgcaacgacaaccagagagaggtgagaatcgtggcccagagaagaggccagaacgagcccgtgctgggcgtggactacagacagagaaagatcaccatccagaacagagccgacctggtgatcaacgaggtgatgtggtgggaccacggcgtgtactactgcaccatcgaggcccccggcgacaccagcggcgaccccgacaaggaggtgaagctgatcgtgctgcactggctgaccgtgatcttcatcatcctgggcgccctgctgctgctgctgctgatcggcgtgtgctggtgccagtgctgcccccagtactgctgctgctacatcagatgcccctgctgccccgcccactgctgctgccccgaggaggacctgagcctgcccagcagcctgccccagatgcccatgacccagaccaccaaccagccccccatcgccaacggcgtgctggagtacctggagaaggagctgagaaacctgaacctggcccagcccctgccccccgacctgaagggcagattcggccacccctgcagcatgctgagcagcctgggcagcgaggtggtggagagaagaatcatccacctgccccccctgatcagagacctgagcagcagcagaagaaccagcgacagcctgcaccagcagtggctgacccccatccccagcagaccctgggacctgagagagggcagaagccaccaccactaccccgacttccaccaggagctgcaggacagaggccccaagagctgggccctggagagaagagagctggaccccagctggagcggcagacacagaagcagcagactgaacggcagccccatccactggagcgacagagacagcctgagcgacgtgcccagcagcagcgaggccagatggagacccagccacccccccttcagaagcagatgccaggagagacccagaagacccagccccagagagagcacccagagacacggcagaagaagaagacacagaagctacagcccccccctgcccagcggcctgagcagctggagcagcgaggaggacaaggagagacagccccagagctggagagcccacagaagaggcagccacagcccccactggcccgaggagaagccccccagctacagaagcctggacatcacccccggcaagaacagcagaaagaagggcagcgtggagagaagaagcgagaaggacagcagccacagcggcagaagcgtggtgatctag

SEQ ID NO: 85087 - DNA, 1800 bp, Artificial Sequence
  Description of Artificial Sequence: Synthetic coding sequence
atggagggccccctgacccccccccccctgcagggcggcggcgccgccgccgtgcccgagcccggcgccagacagcaccccggccacgagaccgccgcccagagatacagcgccagactgctgcaggccggctacgagcccgagagccccagactggacctggccacccaccccaccacccccagaagcgagctgagcagcgtggtgctgctggccggcgtgggcgtgcagatggacagactgagaagagccagcatggccgactacctgatcagcggcggcaccggctacgtgcccgaggacggcctgaccgcccagcagctgttcgccagcgccgacggcctgacctacaacgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgaggtgagaaaggtgaagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85088 - DNA, 1470 bp, Artificial Sequence
  Description of Artificial Sequence: Synthetic coding sequence
atggccgactacctgatcagcggcggcaccggctacgtgcccgaggacggcctgaccgcccagcagctgttcgccagcgccgacggcctgacctacaacgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85089 - DNA, 1692 bp, Artificial Sequence
  Description of Artificial Sequence: Synthetic coding sequence
atggagggccccctgacccccccccccctgcagggcggcggcgccgccgccgtgcccgagcccggcgccagacagcaccccggccacgagaccgccgcccagagatacagcgccagactgctgcaggccggctacgagcccgagagcatggccgactacctgatcagcggcggcaccggctacgtgcccgaggacggcctgaccgcccagcagctgttcgccagcgccgacggcctgacctacaacgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgaggtgagaaaggtgaagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85090 - DNA, 1770 bp, Artificial Sequence
  Description of Artificial Sequence: Synthetic coding sequence
atggagggccccctgacccccccccccctgcagggcggcggcgccgccgccgtgcccgagcccggcgccagacagcaccccggccacgagaccgccgcccagagatacagcgccagactgctgcaggccggctacgagcccgagagctgcttcctgctggagctgagcagcgtggtgctgctggccggcgtgggcgtgcagatggacagactgagaagagccagcatggccgactacctgatcagcggcggcaccggctacgtgcccgaggacggcctgaccgcccagcagctgttcgccagcgccgacggcctgacctacaacgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgaggtgagaaaggtgaagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85091 - DNA, 1593 bp, Artificial Sequence
  Description of Artificial Sequence: Synthetic coding sequence
atggagggccccctgacccccccccccctgcagggcggcggcgccgccgccgtgcccgagcccggcgccagacagcaccccggccacgagaccgccgcccagagatacagcgccagactgctgcaggccggctacgagcccgagagcgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgaggtgagaaaggtgaagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85092 - DNA, 1701 bp, Artificial Sequence
  Description of Artificial Sequence: Synthetic coding sequence
atggagggccccctgacccccccccccctgcagggcggcggcgccgccgccgtgcccgagcccggcgccagacagcaccccggccacgagaccgccgcccagagatacagcgccagactgctgcaggccggctacgagcccgagagccccagactggacctggccacccaccccaccacccccagaagcgagctgagcagcgtggtgctgctggccggcgtgggcgtgcagatggacagactgagaagagccagcgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgaggtgagaaaggtgaagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85093 - DNA, 1530 bp, Artificial Sequence
  Description of Artificial Sequence: Synthetic coding sequence
atggccgactacctgatcagcggcggcaccggctacgtgcccgaggacggcctgaccgcccagcagctgttcgccagcgccgacggcctgacctacaacgacttcctgatcctgcccggcttcatcgacttcatcgccgacgaggtggacctgaccagcgccctgaccagaaagatcaccctgaagacccccctgatcagcagccccatggacaccgtgaccgaggccgacatggccatcgccatggccctgatgggcggcatcggcttcatccaccacaactgcacccccgagttccaggccaacgagaagttcgagcagggcttcatcaccgaccccgtggtgctgagccccagccacaccgtgggcgacgtgctggaggccaagatgagacacggcttcagcggcatccccatcaccgagaccggcaccatgggcagcaagctggtgggcatcgtgaccagcagagacatcgacttcctggccgagaaggaccacaccaccctgctgagcgaggtgatgacccccagaatcgagctggtggtggcccccgccggcgtgaccctgaaggaggccaacgagatcctgcagagaagcaagaagggcaagctgcccatcgtgaacgactgcgacgagctggtggccatcatcgccagaaccgacctgaagaagaacagagactaccccctggccagcaaggacagccagaagcagctgctgtgcggcgccgccgtgggcaccagagaggacgacaagtacagactggacctgctgacccaggccggcgtggacgtgatcgtgctggacagcagccagggcaacagcgtgtaccagatcgccatggtgcactacatcaagcagaagtacccccacctgcaggtgatcggcggcaacgtggtgaccgccgcccaggccaagaacctgatcgacgccggcgtggacggcctgagagtgggcatgggctgcggcagcatctgcatcacccaggaggtgatggcctgcggcagaccccagggcaccgccgtgtacaaggtggccgagtacgccagaagattcggcgtgcccatcatcgccgacggcggcatccagaccgtgggccacgtggtgaaggccctggccctgggcgccagcaccgtgatgatgggcagcctgctggccgccaccaccgaggcccccggcgagtacttcttcagcgacggcgtgagactgaagaagtacagaggcatgggcagcctggacgccatggagaagagcagcagcagccagaagagatacttcagcgagggcgacaaggtgaagatcgcccagggcgtgagcggcagcatccaggacaagggcagcatccagaagttcgtgccctacctgatcgccggcatccagcacggctgccaggacatcggcgccagaagcctgagcgtgctgagaagcatgatgtacagcggcgagctgaagttcgagaagagaaccatgagcgcccagatcgagggcggcgtgcacggcctgcacagctacgagaagagactgtactag

SEQ ID NO: 85094 - DNA, 1470 bp, Artificial Sequence; identical to SEQ ID NO: 85088
  Description of Artificial Sequence: Synthetic coding sequence

SEQ ID NO: 85095 - DNA, 1545 bp, Artificial Sequence
  Description of Artificial Sequence: Synthetic coding sequence
atggccgactacctgatcagcggcggcaccagctacgtgcccgacgacggcctgaccgcccagcagctgttcaactgcggcgacggcctgacctacaacgacttcctgatcctgcccggctacatcgacttcaccgccgaccaggtggacctgaccagcgccctgaccaagaagatcaccctgaagacccccctggtgagcagccccatggacaccgtgaccgaggccggcatggccatcgccatggccctgaccggcggcatcggcttcatccaccacaactgcacccccgagttccaggccaacgaggtgagaaaggtgaagaagtacgagcagggcttcatcaccgaccccgtggtgctgagccccaaggacagagtgagagacgtgttcgaggccaaggccagacacggcttctgcggcatccccatcaccgacaccggcagaatgggcagcagactggtgggcatcatcagcagcagagacatcgacttcctgaaggaggaggagcacgactgcttcctggaggagatcatgaccaagagagaggacctggtggtggcccccgccggcatcaccctgaaggaggccaacgagatcctgcagagaagcaagaagggcaagctgcccatcgtgaacgaggacgacgagctggtggccatcatcgccagaaccgacctgaagaagaacagagactaccccctggccagcaaggacgccaagaagcagctgctgtgcggcgccgccatcggcacccacgaggacgacaagtacagactggacctgctggcccaggccggcgtggacgtggtggtgctggacagcagccagggcaacagcatcttccagatcaacatgatcaagtacatcaaggacaagtaccccaacctgcaggtgatcggcggcaacgtggtgaccgccgcccaggccaagaacctgatcgacgccggcgtggacgccctgagagtgggcatgggcagcggcagcatctgcatcacccaggaggtgctggcctgcggcagaccccaggccaccgccgtgtacaaggtgagcgagtacgccagaagattcggcgtgcccgtgatcgccgacggcggcatccagaacgtgggccacatcgccaaggccctggccctgggcgccagcaccgtgatgatgggcagcctgctggccgccaccaccgaggcccccggcgagtacttcttcagcgacggcatcagactgaagaagtacagaggcatgggcagcctggacgccatggacaagcacctgagcagccagaacagatacttcagcgaggccgacaagatcaaggtggcccagggcgtgagcggcgccgtgcaggacaagggcagcatccacaagttcgtgccctacctgatcgccggcatccagcacagctgccaggacatcggcgccaagagcctgacccaggtgagagccatgatgtacagcggcgagctgaagttcgagaagagaaccagcagcgcccaggtggagggcggcgtgcacagcctgcacagctacgagaagagactgttctag

SEQ ID NO: 85096 - DNA, 1074 bp, Artificial Sequence
  Description of Artificial Sequence: Synthetic coding sequence
atggccgactacctgatcagcggcggcaccagctacgtgcccgacgacggcctgaccgcccagcagctgttcaactgcggcgacggcctgacctacaacgacttcctgatcctgcccggctacatcgacttcaccgccgaccaggtggacctgaccagcgccctgaccaagaagatcaccctgaagacccccctggtgagcagccccatggacaccgtgaccgaggccggcatggccatcgccatggccctgaccggcggcatcggcttcatccaccacaactgcacccccgagttccaggccaacgaggtgagaaaggtgaagaagtacgagcagggcttcatcaccgaccccgtggtgctgagccccaaggacagagtgagagacgtgttcgaggccaaggccagacacggcttctgcggcatccccatcaccgacaccggcagaatgggcagcagactggtgggcatcatcagcagcagagacatcgacttcctgaaggaggaggagcacgactgcttcctggaggagatcatgaccaagagagaggacctggtggtggcccccgccggcatcaccctgaaggaggccaacgagatcctgcagagaagcaagaagggcaagctgcccatcgtgaacgaggacgacgagctggtggccatcatcgccagaaccgacctgaagaagaacagagactaccccctggccagcaaggacgccaagaagcagctgctgtgcggcgccgccatcggcacccacgaggacgacaagtacagactggacctgctggcccaggccggcgtggacgtggtggtgctggacagcagccagggcaacagcatcttccagatcaacatgatcaagtacatcaaggacaagtaccccaacctgcaggtgatcggcggcaacgtggtgaccgccgcccaggccaagaacctgatcgacgccggcgtggacgccctgagagtgggcatgggcagcggcagcatctgcatcacccaggaggtgctggcctgcggcagaccccaggccaccgccgtgtgcacccagaagcagcacccccacttccagtag

SEQ ID NO: 85097 - DNA, 501 bp, Artificial Sequence
  Description of Artificial Sequence: Synthetic coding sequence
atgctgagaggcgtgctgggcaagaccttcagactggtgggctacaccatccagtacggctgcatcgcccactgcgccttcgagtacgtgggcggcgtggtgatgtgcagcggccccagcatggagcccaccatccagaacagcgacatcgtgttcgccgagaacctgagcagacacttctacggcatccagagaggcgacatcgtgatcgccaagagccccagcgaccccaagagcaacatctgcaagagagtgatcggcctggagggcgacaagatcctgaccaccagccccagcgacttcttcaagagccacagctacgtgcccatgggccacgtgtggctggagggcgacaacctgcagaacagcaccgacagcagatgctacggccccatcccctacggcctgatcagaggcagaatcttcttcaagatctggcccctgagcgacttcggcttcctgagagccagccccaacggccacagattcagcgacgactag

SEQ ID NO: 85098 - DNA, 324 bp, Artificial Sequence
  Description of Artificial Sequence: Synthetic coding sequence
atgctgagaggcgtgctgggcaagaccttcagactggtgggctacaccatccagtacggctgcatcgcccactgcgccttcgagtacgtgggcggcgtggtgatgtgcagcggccccagcatggagcccaccatccagaacagcgacatcgtgttcgccgagaacctgagcagacacttctacggcatccagagaggcgacatcgtgatcgccaagagccccagcgaccccaagagcaacatctgcaagagagtgatcggcctggagggcgacaagatcctgaccaccagccccagcgacttcttcaagagccacagctactag

SEQ ID NO: 85099 - DNA, 291 bp, Artificial Sequence
  Description of Artificial Sequence: Synthetic coding sequence
atgctgagaggcgtgctgggcaagaccttcagactggtgggctacaccatccagtacggctgcatcgcccactgcgccttcgagtacgtgggcggcgtggtgatgtgcagcggccccagcatggagcccaccatccagaacagcgacatcgtgttcgccgagaacctgagcagacacttctacggcatccagagaggcgacatcgtgatcgccaagagccccagcgaccccaagagcaacatctgcaagagagtgatcggcctggagggcgacaagatcctgaccacctag

SEQ ID NO: 85100 - DNA, 501 bp, Artificial Sequence; identical to SEQ ID NO: 85097
  Description of Artificial Sequence: Synthetic coding sequence

SEQ ID NO: 85101 - DNA, 528 bp, Artificial Sequence
  Description of Artificial Sequence: Synthetic coding sequence
atggcccagagccagggctgggtgaagagatacatcaaggccttctgcaagggcttcttcgtggccgtgcccgtggccgtgaccttcctggacagagtggcctgcgtggccagagtggagggcgccagcatgcagcccagcctgaaccccggcggcagccagagcagcgacgtggtgctgctgaaccactggaaggtgagaaacttcgaggtgcacagaggcgacatcgtgagcctggtgagccccaagaaccccgagcagaagatcatcaagagagtgatcgccctggagggcgacatcgtgagaaccatcggccacaagaacagatacgtgaaggtgcccagaggccacatctgggtggagggcgaccaccacggccacagcttcgacagcaacagcttcggccccgtgagcctgggcctgctgcacgcccacgccacccacatcctgtggccccccgagagatggcagaagctggagagcgtgctgccccccgagagactgcccgtgcagagagaggaggagtag

SEQ ID NO: 85102 - DNA, 528 bp, Artificial Sequence; identical to SEQ ID NO: 85101
  Description of Artificial Sequence: Synthetic coding sequence

SEQ ID NO: 85103 - DNA, 528 bp, Artificial Sequence; identical to SEQ ID NO: 85101
  Description of Artificial Sequence: Synthetic coding sequence

SEQ ID NO: 85104 - DNA, 333 bp, Artificial Sequence
  Description of Artificial Sequence: Synthetic coding sequence
atggcccagagccagggctgggtgaagagatacatcaaggccttctgcaagggcttcttcgtggccgtgcccgtggccgtgaccttcctggacagagtggcctgcgtggccagagtggagggcgccagcatgcagcccagcctgaaccccggcggcagccagagcagcgacgtggtgctgctgaaccactggaaggtgagaaacttcgaggtgcacagaggcgacatcgtgagcctggtgagccccaagaaccccgagcagaagatcatcaagagagtgatcgccctggagggcgacatcgtgagagacggcagaaagctgaagagaatctag

SEQ ID NO: 85105 - DNA, 240 bp, Artificial Sequence
  Description of Artificial Sequence: Synthetic coding sequence
atggcccagagccagggctgggtgaagagatacatcaaggccttctgcaagggcttcttcgtggccgtgcccgtggccgtgaccttcctggacagagtggcctgcgtggccagagtggagggcgccagcatgcagcccagcctgaaccccggcggcagccagagcagcgacgtggtgctgctgaaccactggaaggtgagaaacttcgaggtgcacagaggcgacatcgtgagcctgtag

SEQ ID NO: 85106 - DNA, 528 bp, Artificial Sequence; identical to SEQ ID NO: 85101
  Description of Artificial Sequence: Synthetic coding sequence

SEQ ID NO: 85107 - DNA, 555 bp, Artificial Sequence
  Description of Artificial Sequence: Synthetic coding sequence
atggtgagaaagctgaagttccacgagcagaagctgctgaagcaggtggacttcctgaactgggaggtgaccgaccacaacctgcacgagctgagagtgctgagaagatacagactgcagagaagagaggactacaccagatacaaccagctgagcagagccgtgagagagctggccagaagactgagagacctgcccgagagagaccagttcagagtgagagccagcgccgccctgctggacaagctgtacgccctgggcctggtgcccaccagaggcagcctggagctgtgcgacttcgtgaccgccagcagcttctgcagaagaagactgcccaccgtgctgctgaagctgagaatggcccagcacctgcaggccgccgtggccttcgtggagcagggccacgtgagagtgggccccgacgtggtgaccgaccccgccttcctggtgaccagaagcatggaggacttcgtgacctgggtggacagcagcaagatcaagagacacgtgctggagtacaacgaggagagagacgacttcgacctggaggcctag

SEQ ID NO: 85108 - DNA, 555 bp, Artificial Sequence; identical to SEQ ID NO: 85107
  Description of Artificial Sequence: Synthetic coding sequence

SEQ ID NO: 85109 - DNA, 96 bp, Artificial Sequence
  Description of Artificial Sequence: Synthetic coding sequence
atggaggacttcgtgacctgggtggacagcagcaagatcaagagacacgtgctggagtacaacgaggagagagacgacttcgacctggaggcctag

SEQ ID NO: 85110 - DNA, 876 bp, Artificial Sequence
  Description of Artificial Sequence: Synthetic coding sequence
atgctgagaagagaggccagactgagaagagagtacctgtacagaaaggccagagaggaggcccagagaagcgcccaggagagaaaggagagactgagaagagccctggaggagaacagactgatccccaccgagctgagaagagaggccctggccctgcagggcagcctggagttcgacgacgccggcggcgagggcgtgaccagccacgtggacgacgagtacagatgggccggcgtggaggaccccaaggtgatgatcaccaccagcagagaccccagcagcagactgaagatgttcgccaaggagctgaagctggtgttccccggcgcccagagaatgaacagaggcagacacgaggtgggcgccctggtgagagcctgcaaggccaacggcgtgaccgacctgctggtggtgcacgagcacagaggcacccccgtgggcctgatcgtgagccacctgcccttcggccccaccgcctacttcaccctgtgcaacgtggtgatgagacacgacatccccgacctgggcaccatgagcgaggccaagccccacctgatcacccacggcttcagcagcagactgggcaagagagtgagcgacatcctgagatacctgttccccgtgcccaaggacgacagccacagagtgatcaccttcgccaaccaggacgactacatcagcttcagacaccacgtgtacaagaagaccgaccacagaaacgtggagctgaccgaggtgggccccagattcgagctgaagctgtacatgatcagactgggcaccctggagcaggaggccaccgccgacgtggagtggagatggcacccctacaccaacaccgccagaaagagagtgttcctgagcaccgagtag

SEQ ID NO: 85111 - DNA, 2928 bp, Artificial Sequence
  Description of Artificial Sequence: Synthetic coding sequence
atggacctgaacagcgccagcaccgtggtgctgcaggtgctgacccaggccaccagccaggacaccgccgtgctgaagcccgccgaggagcagctgaagcagtgggagacccagcccggcttctacagcgtgctgctgaacatcttcaccaaccacaccctggacatcaacgtgagatggctggccgtgctgtacttcaagcacggcatcgacagatactggagaagagtggccccccacgccctgagcgaggaggagaagaccaccctgagagccggcctgatcaccaacttcaacgagcccatcaaccagatcgccacccagatcgccgtgctgatcgccaaggtggccagactggactgccccagacagtggcccgagctgatccccaccctgatcgagagcgtgaaggtgcaggacgacctgagacagcacagagccctgctgaccttctaccacgtgaccaagaccctggccagcaagagactggccgccgacagaaagctgttctacgacctggccagcggcatctacaacttcgcctgcagcctgtggaaccaccacaccgacaccttcctgcaggaggtgagcagcggcaacgaggccgccatcctgagcagcctggagagaaccctgctgagcctgaaggtgctgagaaagctgaccgtgaacggcttcgtggagccccacaagaacatggaggtgatgggcttcctgcacggcatcttcgagagactgaagcagttcctggagtgcagcagaagcatcggcaccgacaacgtgtgcagagacagactggagaagaccatcatcctgttcaccaaggtgctgctggacttcctggaccagcaccccttcagcttcacccccctgatccagagaagcctggagttcagcgtgagctacgtgttcaccgaggtgggcgagggcgtgaccttcgagagattcatcgtgcagtgcatgaacctgatcaagatgatcgtgaagaactacgcctacaagcccagcaagaacttcgaggacagcagccccgagaccctggaggcccacaagatcaagatggccttcttcacctaccccaccctgaccgagatctgcagaagactggtgagccactacttcctgctgaccgaggaggagctgaccatgtgggaggaggaccccgagggcttcaccgtggaggagaccggcggcgacagctggaagtacagcctgagaccctgcaccgaggtgctgttcatcgacatcttccacgagtacaaccagaccctgacccccgtgctgctggagatgatgcagaccctgcagggccccaccaacgtggaggacatgaacgccctgctgatcaaggacgccgtgtacaacgccgtgggcctggccgcctacgagctgttcgacagcgtggacttcgaccagtggttcaagaaccagctgctgcccgagctgcaggtgatccacaacagatacaagcccctgagaagaagagtgatctggctgatcggccagtggatcagcgtgaagttcaagagcgacctgagacccatgctgtacgaggccatctgcaacctgctgcaggaccaggacctggtggtgagaatcgagaccgccaccaccctgaagctgaccgtggacgacttcgagttcagaaccgaccagttcctgccctacctggagaccatgttcaccctgctgttccagctgctgcagcaggtgaccgagtgcgacaccaagatgcacgtgctgcacgtgctgagctgcgtgatcgagagagtgaacatgcagatcagaccctacgtgggctgcctggtgcagtacctgcccctgctgtggaagcagagcgaggagcacaacatgctgagatgcgccatcctgaccaccctgatccacctggtgcagggcctgggcgccgacagcaagaacctgtaccccttcctgctgcccgtgatccagctgagcaccgacgtgagccagcccccccacgtgtacctgctggaggacggcctggagctgtggctggtgaccctggagaacagcccctgcatcacccccgagctgctgagaatcttccagaacatgagccccctgctggagctgagcagcgagaacctgagaacctgcttcaagatcatcaacggctacatcttcctgagcagcaccgagttcctgcagacctacgccgtgggcctgtgccagagcttctgcgagctgctgaaggagatcaccaccgagggccaggtgcaggtgctgaaggtggtggagaacgccctgaaggtgaaccccatcctgggcccccagatgttccagcccatcctgccctacgtgttcaagggcatcatcgagggcgagagataccccgtggtgatgagcacctacctgggcgtgatgggcagagtgctgctgcagaacaccagcttcttcagcagcctgctgaacgagatggcccacaagttcaaccaggagatggaccagctgctgggcaacatgatcgagatgtgggtggacagaatggacaacatcacccagcccgagagaagaaagctgagcgccctggccctgctgagcctgctgcccagcgacaacagcgtgatccaggacaagttctgcggcatcatcaacatcagcgtggagggcctgcacgacgtgatgaccgaggaccccgagaccggcacctacaaggactgcatgctgatgagccacctggaggagcccaaggtgaccgaggacgaggagccccccaccgagcaggacaagagaaagaagatgctggccctgaaggaccccgtgcacaccgtgagcctgcagcagttcatctacgagaagctgaaggcccagcaggagatgctgggcgagcagggcttccagagcctgatggagaccgtggacaccgagatcgtgacccagctgcaggagttcctgcagggcttctag

SEQ ID NO: 85112 - DNA, 3048 bp, Artificial Sequence
  Description of Artificial Sequence: Synthetic coding sequence
atggtgcagcccatcatccacctgggctacgtggtgtacagcctgctgtacctgggctacaagcccgtgcagcacgtgaccgccctgaacaccgtgagcagctgccacaagatggtgagcatggacctgaacagcgccagcaccgtggtgctgcaggtgctgacccaggccaccagccaggacaccgccgtgctgaagcccgccgaggagcagctgaagcagtgggagacccagcccggcttctacagcgtgctgctgaacatcttcaccaaccacaccctggacatcaacgtgagatggctggccgtgctgtacttcaagcacggcatcgacagatactggagaagagtggccccccacgccctgagcgaggaggagaagaccaccctgagagccggcctgatcaccaacttcaacgagcccatcaaccagatcgccacccagatcgccgtgctgatcgccaaggtggccagactggactgccccagacagtggcccgagctgatccccaccctgatcgagagcgtgaaggtgcaggacgacctgagacagcacagagccctgctgaccttctaccacgtgaccaagaccctggccagcaagagactggccgccgacagaaagctgttctacgacctggccagcggcatctacaacttcgcctgcagcctgtggaaccaccacaccgacaccttcctgcaggaggtgagcagcggcaacgaggccgccatcctgagcagcctggagagaaccctgctgagcctgaaggtgctgagaaagctgaccgtgaacggcttcgtggagccccacaagaacatggaggtgatgggcttcctgcacggcatcttcgagagactgaagcagttcctggagtgcagcagaagcatcggcaccgacaacgtgtgcagagacagactggagaagaccatcatcctgttcaccaaggtgctgctggacttcctggaccagcaccccttcagcttcacccccctgatccagagaagcctggagttcagcgtgagctacgtgttcaccgaggtgggcgagggcgtgaccttcgagagattcatcgtgcagtgcatgaacctgatcaagatgatcgtgaagaactacgcctacaagcccagcaagaacttcgaggacagcagccccgagaccctggaggcccacaagatcaagatggccttcttcacctaccccaccctgaccgagatctgcagaagactggtgagccactacttcctgctgaccgaggaggagctgaccatgtgggaggaggaccccgagggcttcaccgtggaggagaccggcggcgacagctggaagtacagcctgagaccctgcaccgaggtgctgttcatcgacatcttccacgagtacaaccagaccctgacccccgtgctgctggagatgatgcagaccctgcagggccccaccaacgtggaggacatgaacgccctgctgatcaaggacgccgtgtacaacgccgtgggcctggccgcctacgagctgttcgacagcgtggacttcgaccagtggttcaagaaccagctgctgcccgagctgcaggtgatccacaacagatacaagcccctgagaagaagagtgatctggctgatcggccagtggatcagcgtgaagttcaagagcgacctgagacccatgctgtacgaggccatctgcaacctgctgcaggaccaggacctggtggtgagaatcgagaccgccaccaccctgaagctgaccgtggacgacttcgagttcagaaccgaccagttcctgccctacctggagaccatgttcaccctgctgttccagctgctgcagcaggtgaccgagtgcgacaccaagatgcacgtgctgcacgtgctgagctgcgtgatcgagagagtgaacatgcagatcagaccctacgtgggctgcctggtgcagtacctgcccctgctgtggaagcagagcgaggagcacaacatgctgagatgcgccatcctgaccaccctgatccacctggtgcagggcctgggcgccgacagcaagaacctgtaccccttcctgctgcccgtgatccagctgagcaccgacgtgagccagcccccccacgtgtacctgctggaggacggcctggagctgtggctggtgaccctggagaacagcccctgcatcacccccgagctgctgagaatcttccagaacatgagccccctgctggagctgagcagcgagaacctgagaacctgcttcaagatcatcaacggctacatcttcctgagcagcaccgagttcctgcagacctacgccgtgggcctgtgccagagcttctgcgagctgctgaaggagatcaccaccgagggccaggtgcaggtgctgaaggtggtggagaacgccctgaaggtgaaccccatcctgggcccccagatgttccagcccatcctgccctacgtgttcaagggcatcatcgagggcgagagataccccgtggtgatgagcacctacctgggcgtgatgggcagagtgctgctgcagaacaccagcttcttcagcagcctgctgaacgagatggcccacaagttcaaccaggagatggaccagctgctgggcaacatgatcgagatgtgggtggacagaatggacaacatcacccagcccgagagaagaaagctgagcgccctggccctgctgagcctgctgcccagcgacaacagcgtgatccaggacaagttctgcggcatcatcaacatcagcgtggagggcctgcacgacgtgatgaccgaggaccccgagaccggcacctacaaggactgcatgctgatgagccacctggaggagcccaaggtgaccgaggacgaggagccccccaccgagcaggacaagagaaagaagatgctggccctgaaggaccccgtgcacaccgtgagcctgcagcagttcatctacgagaagctgaaggcccagcaggagatgctgggcgagcagggcttccagagcctgatggagaccgtggacaccgagatcgtgacccagctgcaggagttcctgcagggcttctag

SEQ ID NO: 85113 - DNA, 195 bp, Artificial Sequence
  Description of Artificial Sequence: Synthetic coding sequence
atggacctgaacagcgccagcaccgtggtgctgcaggtgctgacccaggccaccagccaggacaccgccgtgctgaagcccgccgaggagcagctgaagcagtgggagacccagcccggcttctacagcgtgctgctgaacatcttcaccaaccacaccctggacatcaacgtgagatggctggccgtgctgtag

SEQ ID NO: 85114 - DNA, 489 bp, Artificial Sequence
  Description of Artificial Sequence: Synthetic coding sequence
atggacctgaacagcgccagcaccgtggtgctgcaggtgctgacccaggccaccagccaggacaccgccgtgctgaagcccgccgaggagcagctgaagcagtgggagacccagcccggcttctacagcgtgctgctgaacatcttcaccaaccacaccctggacatcaacgtgagatggctggccgtgctgtacttcaagcacggcatcgacagatactggagaagagtggccccccacgccctgagcgaggaggagaagaccaccctgagagccggcctgatcaccaacttcaacgagcccatcaaccagatcgccacccagatcgccgtgctgatcgccaaggtggccagactggactgccccagacagtggcccgagctgatccccaccctgatcgagagcgtgaaggtgcaggacgacctgagacagcacagagccctgctgaccttctaccacgtgaccaagaccctggccagcaagagatag

SEQ ID NO: 85115 - DNA, 450 bp, Artificial Sequence
  Description of Artificial Sequence: Synthetic coding sequence
atggacctgaacagcgccagcaccgtggtgctgcaggtgctgacccaggccaccagccaggacaccgccgtgctgaagcccgccgaggagcagctgaagcagtgggagacccagcccggcttctacagcgtgctgctgaacatcttcaccaaccacaccctggacatcaacgtgagatggctggccgtgctgtacttcaagcacggcatcgacagatactggagaagagtggccccccacgccctgagcgaggaggagaagaccaccctgagagccggcctgatcaccaacttcaacgagcccatcaaccagatcgccacccagatcgccgtgctgatcgccaaggtggccagactggactgccccagacagtggcccgagctgatccccaccctgatcgagagcgtgaaggtgcaggacgacctgagacagcacagagccctgctgtag

SEQ ID NO: 85116 - DNA, 1425 bp, Artificial Sequence
  Description of Artificial Sequence: Synthetic coding sequence
atgatgcagaccctgcagggccccaccaacgtggaggacatgaacgccctgctgatcaaggacgccgtgtacaacgccgtgggcctggccgcctacgagctgttcgacagcgtggacttcgaccagtggttcaagaaccagctgctgcccgagctgcaggtgatccacaacagatacaagcccctgagaagaagagtgatctggctgatcggccagtggatcagcgtgaagttcaagagcgacctgagacccatgctgtacgaggccatctgcaacctgctgcaggaccaggacctggtggtgagaatcgagaccgccaccaccctgaagctgaccgtggacgacttcgagttcagaaccgaccagttcctgccctacctggagaccatgttcaccctgctgttccagctgctgcagcaggtgaccgagtgcgacaccaagatgcacgtgctgcacgtgctgagctgcgtgatcgagagagtgaacatgcagatcagaccctacgtgggctgcctggtgcagtacctgcccctgctgtggaagcagagcgaggagcacaacatgctgagatgcgccatcctgaccaccctgatccacctggtgcagggcctgggcgccgacagcaagaacctgtaccccttcctgctgcccgtgatccagctgagcaccgacgtgagccagcccccccacgtgtacctgctggaggacggcctggagctgtggctggtgaccctggagaacagcccctgcatcacccccgagctgctgagaatcttccagaacatgagccccctgctggagctgagcagcgagaacctgagaacctgcttcaagatcatcaacggctacatcttcctgagcagcaccgagttcctgcagacctacgccgtgggcctgtgccagagcttctgcgagctgctgaaggagatcaccaccgagggccaggtgcaggtgctgaaggtggtggagaacgccctgaaggtgaaccccatcctgggcccccagatgttccagcccatcctgccctacgtgttcaagggcatcatcgagggcgagagataccccgtggtgatgagcacctacctgggcgtgatgggcagagtgctgctgcagaacaccagcttcttcagcagcctgctgaacgagatggcccacaagttcaaccaggagatggaccagctgctgggcaacatgatcgagatgtgggtggacagaatggacaacatcacccagcccgagagaagaaagctgagcgccctggccctgctgagcctgctgcccagcgacaacagcgtgatccaggacaagttctgcggcatcatcaacatcagcgtggagggcctgcacgacgtgatgaccgaggaccccgagaccggcacctacaaggactgcatgctgatgagccacctggaggagcccaagtag

SEQ ID NO: 85117 - DNA, 3117 bp, Artificial Sequence
  Description of Artificial Sequence: Synthetic coding sequence
atggaccccaacaccatcatcgaggccctgagaggcaccatggaccccgccctgagagaggccgccgagagacagctgaacgaggcccacaagagcctgaacttcgtgagcaccctgctgcagatcaccatgagcgagcagctggacctgcccgtgagacaggccggcgtgatctacctgaagaacatgatcacccagtactggcccgacagagagaccgcccccggcgacatcagcccctacaccatccccgaggaggacagacactgcatcagagagaacatcgtggaggccatcatccacagccccgagctgatcagagtgcagctgaccacctgcatccaccacatcatcaagcacgactaccccagcagatggaccgccatcgtggacaagatcggcttctacctgcagagcgacaacagcgcctgctggctgggcatcctgctgtgcctgtaccagctggtgaagaactacgagtacaagaagcccgaggagagaagccccctggtggccgccatgcagcacttcctgcccgtgctgaaggacagattcatccagctgctgagcgaccagagcgaccagagcgtgctgatccagaagcagatcttcaagatcttctacgccctggtgcagtacaccctgcccctggagctgatcaaccagcagaacctgaccgagtggatcgagatcctgaagaccgtggtgaacagagacgtgcccaacgagaccctgcaggtggaggaggacgacagacccgagctgccctggtggaagtgcaagaagtgggccctgcacatcctggccagactgttcgagagatacggcagccccggcaacgtgagcaaggagtacaacgagttcgccgaggtgttcctgaaggccttcgccgtgggcgtgcagcaggtgctgctgaaggtgctgtaccagtacaaggagaagcagtacatggcccccagagtgctgcagcagaccctgaactacatcaaccagggcgtgagccacgccctgacctggaagaacctgaagccccacatccagggcatcatccaggacgtgatcttccccctgatgtgctacaccgacgccgacgaggagctgtggcaggaggacccctacgagtacatcagaatgaagttcgacgtgttcgaggacttcatcagccccaccaccgccgcccagaccctgctgttcaccgcctgcagcaagagaaaggaggtgctgcagaagaccatgggcttctgctaccagatcctgaccgagcccaacgccgaccccagaaagaaggacggcgccctgcacatgatcggcagcctggccgagatcctgctgaagaagaagatctacaaggaccagatggagtacatgctgcagaaccacgtgttccccctgttcagcagcgagctgggctacatgagagccagagcctgctgggtgctgcactacttctgcgaggtgaagttcaagagcgaccagaacctgcagaccgccctggagctgaccagaagatgcctgatcgacgacagagagatgcccgtgaaggtggaggccgccatcgccctgcaggtgctgatcagcaaccaggagaaggccaaggagtacatcacccccttcatcagacccgtgatgcaggccctgctgcacatcatcagagagaccgagaacgacgacctgaccaacgtgatccagaagatgatctgcgagtacagcgaggaggtgacccccatcgccgtggagatgacccagcacctggccatgaccttcaaccaggtgatccagaccggccccgacgaggagggcagcgacgacaaggccgtgaccgccatgggcatcctgaacaccatcgacaccctgctgagcgtggtggaggaccacaaggagatcacccagcagctggagggcatctgcctgcaggtgatcggcaccgtgctgcagcagcacgtgctggagttctacgaggagatcttcagcctggcccacagcctgacctgccagcaggtgagcccccagatgtggcagctgctgcccctggtgttcgaggtgttccagcaggacggcttcgactacttcaccgacatgatgcccctgctgcacaactacgtgaccgtggacaccgacaccctgctgagcgacaccaagtacctggagatgatctacagcatgtgcaagaaggtgctgaccggcgtggccggcgaggacgccgagtgccacgccgccaagctgctggaggtgatcatcctgcagtgcaagggcagaggcatcgaccagtgcatccccctgttcgtggaggccgccctggagagactgaccagagaggtgaagaccagcgagctgagaaccatgtgcctgcaggtggccatcgccgccctgtactacaacccccacctgctgctgaacaccctggagaacctgagattccccaacaacgtggagcccgtgaccaaccacttcatcacccagtggctgaacgacgtggactgcttcctgggcctgcacgacagaaagatgtgcgtgctgggcctgtgcgccctgatcgacatggagcagatcccccaggtgctgaaccaggtgagcggccagatcctgcccgccttcatcctgctgttcaacggcctgaagagagcctacgcctgccacgccgagcacgagaacgacagcgacgacgacgacgaggccgaggacgacgacgagaccgaggagctgggcagcgacgaggacgacatcgacgaggacggccaggagtacctggagatcctggccaagcaggccggcgaggacggcgacgacgaggactgggaggaggacgacgccgaggagaccgccctggagggctacagcaccatcatcgacgacgaggacaaccccgtggacgagtaccagatcttcaaggccatcttccagaccatccagaacagaaaccccgtgtggtaccaggccctgacccacggcctgaacgaggagcagagaaagcagctgcaggacatcgccaccctggccgaccagagaagagccgcccacgagagcaagatgatcgagaagcacggcggctacaagttcagcgcccccgtggtgcccagcagcttcaacttcggcggccccgcccccggcatgaactag

SEQ ID NO: 85118 - DNA, 3114 bp, Artificial Sequence
  Description of Artificial Sequence: Synthetic coding sequence
atggacctgaacagaatcatccaggccctgaagggcaccatcgaccccaagctgagaatcgccgccgagaacgagctgaaccagagctacaagatcatcaacttcgcccccagcctgctgagaatcatcgtgagcgaccacgtggagttccccgtgagacaggccgccgccatctacctgaagaacatggtgacccagtactggcccgacagagagcccccccccggcgaggccatcttccccttcaacatccacgagaacgacagacagcagatcagagacaacatcgtggagggcatcatcagaagccccgacctggtgagagtgcagctgaccatgtgcctgagagccatcatcaagcacgacttccccggccactggcccggcgtggtggacaagatcgactactacctgcagagccagagcagcgccagctggctgggcagcctgctgtgcctgtaccagctggtgaagacctacgagtacaagaaggccgaggagagagagcccctgatcatcgccatgcagatcttcctgcccagaatccagcagcagatcgtgcagctgctgcccgacagcagctactacagcgtgctgctgcagaagcagatcctgaagatcttctacgccctggtgcagtacgccctgcccctgcagctggtgaacaaccagaccatgaccacctggatggagatcttcagaaccatcatcgacagaaccgtgccccccgagaccctgcacatcgacgaggacgacagacccgagctggtgtggtggaagtgcaagaagtgggccctgcacatcgtggccagactgttcgagagatacggcagccccggcaacgtgaccaaggagtacttcgagttcagcgagttcttcctgaagacctacgccgtgggcatccagcaggtgctgctgaagatcctggaccagtacagacagaaggagtacgtggcccccagagtgctgcagcaggccttcaactacctgaaccagggcgtggtgcacagcatcacctggaagcagatgaagccccacatccagaacatcagcgaggacgtgatcttcagcgtgatgtgctacaaggacgaggacgaggagctgtggcaggaggacccctacgagtacatcagaatgaagttcgacatcttcgaggactacgccagccccaccaccgccgcccagaccctgctgtacaccgccgccaagaagagaaaggaggtgctgcccaagatgatggccttctgctaccagatcctgaccgaccccaacttcgaccccagaaagaaggacggcgccctgcacgtgatcggcagcctggccgagatcctgctgaagaagagcctgttcaaggaccagatggagctgttcctgcagaaccacgtgttccccctgctgctgagcaacctgggctacctgagagccagaagctgctgggtgctgcacgccttcagcagcctgaagttccacaacgagctgaacctgagaaacgccgtggagctggccaagaagagcctgatcgaggacaaggagatgcccgtgaaggtggaggccgccctggccctgcagagcctgatcagcaaccagatccaggccaaggagtacatgaagccccacgtgagacccatcatgcaggagctgctgcacatcgtgagagagaccgagaacgacgacgtgaccaacgtgatccagaagatgatctgcgagtacagccaggaggtggccagcatcgccgtggacatgacccagcacctggccgagatcttcggcaaggtgctgcagagcgacgagtacgaggaggtggaggacaagaccgtgatggccatgggcatcctgcacaccatcgacaccatcctgaccgtggtggaggaccacaaggagatcacccagcagctggagaacatctgcctgagaatcatcgacctggtgctgcagaagcacgtgatcgagttctacgaggagatcctgagcctggcctacagcctgacctgccacagcatcagcccccagatgtggcagctgctgggcatcctgtacgaggtgttccagcaggactgcttcgagtacttcaccgacatgatgcccctgctgcacaactacgtgaccatcgacaccgacaccctgctgagcaacgccaagcacctggagatcctgttcaccatgtgcagaaaggtgctgtgcggcgacgccggcgaggacgccgagtgccacgccgccaagctgctggaggtgatcatcctgcagtgcaagggcagaggcatcgaccagtgcatccccctgttcgtgcagctggtgctggagagactgaccagaggcgtgaagaccagcgagctgagaaccatgtgcctgcaggtggccatcgccgccctgtactacaaccccgacctgctgctgcacaccctggagagaatccagctgccccacaaccccggccccatcaccgtgcagttcatcaaccagtggatgaacgacaccgactgcttcctgggccaccacgacagaaagatgtgcatcatcggcctgagcatcctgctggagctgcagaacagaccccccgccgtggacgccgtggtgggccagatcgtgcccagcatcctgttcctgttcctgggcctgaagcaggtgtgcgccaccagacagctggtgaacagagaggacagaagcaaggccgagaaggccgacatggaggagaacgaggagatcagcagcgacgaggaggagaccaacgtgaccgcccaggccatgcagagcaacaacggcagaggcgaggacgaggaggaggaggacgacgactgggacgaggaggtgctggaggagaccgccctggagggcttcagcacccccctggacctggacaacagcgtggacgagtaccagttcttcacccaggccctgatcaccgtgcagagcagagacgccgcctggtaccagctgctgatggcccccctgagcgaggaccagagaaccgccctgcaggaggtgtacaccctggccgagcacagaagaaccgtggccgaggccaagaagaagatcgagcagcagggcggcttcaccttcgagaacaagggcgtgctgagcgccttcaacttcggcaccgtgcccagcaacaactag

SEQ ID NO: 85119 - DNA, 2499 bp, Artificial Sequence
  Description of Artificial Sequence: Synthetic coding sequence
atggagagcctgaccctgaagggctacgccctgcccctgcagctggtgaacaaccagaccatgaccacctggatggagatcttcagaaccatcatcgacagaaccgtgccccccgagaccctgcacatcgacgaggacgacagacccgagctggtgtggtggaagtgcaagaagtgggccctgcacatcgtggccagactgttcgagagatacggcagccccggcaacgtgaccaaggagtacttcgagttcagcgagttcttcctgaagacctacgccgtgggcatccagcaggtgctgctgaagatcctggaccagtacagacagaaggagtacgtggcccccagagtgctgcagcaggccttcaactacctgaaccagggcgtggtgcacagcatcacctggaagcagatgaagccccacatccagaacatcagcgaggacgtgatcttcagcgtgatgtgctacaaggacgaggacgaggagctgtggcaggaggacccctacgagtacatcagaatgaagttcgacatcttcgaggactacgccagccccaccaccgccgcccagaccctgctgtacaccgccgccaagaagagaaaggaggtgctgcccaagatgatggccttctgctaccagatcctgaccgaccccaacttcgaccccagaaagaaggacggcgccctgcacgtgatcggcagcctggccgagatcctgctgaagaagagcctgttcaaggaccagatggagctgttcctgcagaaccacgtgttccccctgctgctgagcaacctgggctacctgagagccagaagctgctgggtgctgcacgccttcagcagcctgaagttccacaacgagctgaacctgagaaacgccgtggagctggccaagaagagcctgatcgaggacaaggagatgcccgtgaaggtggaggccgccctggccctgcagagcctgatcagcaaccagatccaggccaaggagtacatgaagccccacgtgagacccatcatgcaggagctgctgcacatcgtgagagagaccgagaacgacgacgtgaccaacgtgatccagaagatgatctgcgagtacagccaggaggtggccagcatcgccgtggacatgacccagcacctggccgagatcttcggcaaggtgctgcagagcgacgagtacgaggaggtggaggacaagaccgtgatggccatgggcatcctgcacaccatcgacaccatcctgaccgtggtggaggaccacaaggagatcacccagcagctggagaacatctgcctgagaatcatcgacctggtgctgcagaagcacgtgatcgagttctacgaggagatcctgagcctggcctacagcctgacctgccacagcatcagcccccagatgtggcagctgctgggcatcctgtacgaggtgttccagcaggactgcttcgagtacttcaccgacatgatgcccctgctgcacaactacgtgaccatcgacaccgacaccctgctgagcaacgccaagcacctggagatcctgttcaccatgtgcagaaaggtgctgtgcggcgacgccggcgaggacgccgagtgccacgccgccaagctgctggaggtgatcatcctgcagtgcaagggcagaggcatcgaccagtgcatccccctgttcgtgcagctggtgctggagagactgaccagaggcgtgaagaccagcgagctgagaaccatgtgcctgcaggtggccatcgccgccctgtactacaaccccgacctgctgctgcacaccctggagagaatccagctgccccacaaccccggccccatcaccgtgcagttcatcaaccagtggatgaacgacaccgactgcttcctgggccaccacgacagaaagatgtgcatcatcggcctgagcatcctgctggagctgcagaacagaccccccgccgtggacgccgtggtgggccagatcgtgcccagcatcctgttcctgttcctgggcctgaagcaggtgtgcgccaccagacagctggtgaacagagaggacagaagcaaggccgagaaggccgacatggaggagaacgaggagatcagcagcgacgaggaggagaccaacgtgaccgcccaggccatgcagagcaacaacggcagaggcgaggacgaggaggaggaggacgacgactgggacgaggaggtgctggaggagaccgccctggagggcttcagcacccccctggacctggacaacagcgtggacgagtaccagttcttcacccaggccctgatcaccgtgcagagcagagacgccgcctggtaccagctgctgatggcccccctgagcgaggaccagagaaccgccctgcaggaggtgtacaccctggccgagcacagaagaaccgtggccgaggccaagaagaagatcgagcagcagggcggcttcaccttcgagaacaagggcgtgctgagcgccttcaacttcggcaccgtgcccagcaacaactag

SEQ ID NO: 85120 - DNA, 1542 bp, Artificial Sequence
  Description of Artificial Sequence: Synthetic coding sequence
ctgagcagcggccacgagctggccaaggagtacatgaagccccacgtgagacccatcatgcaggagctgctgcacatcgtgagagagaccgagaacgacgacgtgaccaacgtgatccagaagatgatctgcgagtacagccaggaggtggccagcatcgccgtggacatgacccagcacctggccgagatcttcggcaaggtgctgcagagcgacgagtacgaggaggtggaggacaagaccgtgatggccatgggcatcctgcacaccatcgacaccatcctgaccgtggtggaggaccacaaggagatcacccagcagctggagaacatctgcctgagaatcatcgacctggtgctgcagaagcacgtgatcgagttctacgaggagatcctgagcctggcctacagcctgacctgccacagcatcagcccccagatgtggcagctgctgggcatcctgtacgaggtgttccagcaggactgcttcgagtacttcaccgacatgatgcccctgctgcacaactacgtgaccatcgacaccgacaccctgctgagcaacgccaagcacctggagatcctgttcaccatgtgcagaaaggtgctgtgcggcgacgccggcgaggacgccgagtgccacgccgccaagctgctggaggtgatcatcctgcagtgcaagggcagaggcatcgaccagtgcatccccctgttcgtgcagctggtgctggagagactgaccagaggcgtgaagaccagcgagctgagaaccatgtgcctgcaggtggccatcgccgccctgtactacaaccccgacctgctgctgcacaccctggagagaatccagctgccccacaaccccggccccatcaccgtgcagttcatcaaccagtggatgaacgacaccgactgcttcctgggccaccacgacagaaagatgtgcatcatcggcctgagcatcctgctggagctgcagaacagaccccccgccgtggacgccgtggtgggccagatcgtgcccagcatcctgttcctgttcctgggcctgaagcaggtgtgcgccaccagacagctggtgaacagagaggacagaagcaaggccgagaaggccgacatggaggagaacgaggagatcagcagcgacgaggaggagaccaacgtgaccgcccaggccatgcagagcaacaacggcagaggcgaggacgaggaggaggaggacgacgactgggacgaggaggtgctggaggagaccgccctggagggcttcagcacccccctggacctggacaacagcgtggacgagtaccagttcttcacccaggccctgatcaccgtgcagagcagagacgccgcctggtaccagctgctgatggcccccctgagcgaggaccagagaaccgccctgcaggaggtgtacaccctggccgagcacagaagaaccgtggccgaggccaagaagaagatcgagcagcagggcggcttcaccttcgagaacaagggcgtgctgagcgccttcaacttcggcaccgtgcccagcaacaactag

SEQ ID NO: 85121 - DNA, 3546 bp, Artificial Sequence
  Description of Artificial Sequence: Synthetic coding sequence
atgcccgagaaccccgccaccgacaagctgcaggtgctgcaggtgctggacagactgaagatgaagctgcaggagaagggcgacaccagccagaacgagaagctgagcatgttctacgagaccctgaagagccccctgttcaaccagatcctgaccctgcagcagagcatcaagcagctgaagggccagctgaaccacatccccagcgactgcagcgccaacttcgacttcagcagaaagggcctgctggtgttcaccgacggcagcatcaccaacggcaacgtgcacagacccagcaacaacagcaccgtgagcggcctgttcccctggacccccaagctgggcaacgaggacttcaacagcgtgatccagcagatggcccagggcagacagatcgagtacatcgacatcgagagacccagcaccggcggcctgggcttcagcgtggtggccctgagaagccagaacctgggcaaggtggacatcttcgtgaaggacgtgcagcccggcagcgtggccgacagagaccagagactgaaggagaacgaccagatcctggccatcaaccacacccccctggaccagaacatcagccaccagcaggccatcgccctgctgcagcagaccaccggcagcctgagactgatcgtggccagagagcccgtgcacaccaagagcagcaccagcagcagcctgaacgacaccaccctgcccgagaccgtgtgctggggccacgtggaggaggtggagctgatcaacgacggcagcggcctgggcttcggcatcgtgggcggcaagaccagcggcgtggtggtgagaaccatcgtgcccggcggcctggccgacagagacggcagactgcagaccggcgaccacatcctgaagatcggcggcaccaacgtgcagggcatgaccagcgagcaggtggcccaggtgctgagaaactgcggcaacagcgtgagaatgctggtggccagagaccccgccggcgacatcagcgtgaccccccccgcccccgccgccctgcccgtggccctgcccaccgtggccagcaagggccccggcagcgacagcagcctgttcgagacctacaacgtggagctggtgagaaaggacggccagagcctgggcatcagaatcgtgggctacgtgggcaccagccacaccggcgaggccagcggcatctacgtgaagagcatcatccccggcagcgccgcctaccacaacggccacatccaggtgaacgacaagatcgtggccgtggacggcgtgaacatccagggcttcgccaaccacgacgtggtggaggtgctgagaaacgccggccaggtggtgcacctgaccctggtgagaagaaagaccagcagcagcaccagccccctggagccccccagcgacagaggcaccgtggtggagcccctgaagccccccgccctgttcctgaccggcgccgtggagaccgagaccaacgtggacggcgaggacgaggagatcaaggagagaatcgacaccctgaagaacgacaacatccaggccctggagaagctggagaaggtgcccgacagccccgagaacgagctgaagagcagatgggagaacctgctgggccccgactacgaggtgatggtggccaccctggacacccagatcgccgacgacgccgagctgcagaagtacagcaagctgctgcccatccacaccctgagactgggcgtggaggtggacagcttcgacggccaccactacatcagcagcatcgtgagcggcggccccgtggacaccctgggcctgctgcagcccgaggacgagctgctggaggtgaacggcatgcagctgtacggcaagagcagaagagaggccgtgagcttcctgaaggaggtgcccccccccttcaccctggtgtgctgcagaagactgttcgacgacgaggccagcgtggacgagcccagaagaaccgagaccagcctgcccgagaccgaggtggaccacaacatggacgtgaacaccgaggaggacgacgacggcgagctggccctgtggagccccgaggtgaagatcgtggagctggtgaaggactgcaagggcctgggcttcagcatcctggactaccaggaccccctggaccccaccagaagcgtgatcgtgatcagaagcctggtggccgacggcgtggccgagagaagcggcggcctgctgcccggcgacagactggtgagcgtgaacgagtactgcctggacaacaccagcctggccgaggccgtggagatcctgaaggccgtgccccccggcctggtgcacctgggcatctgcaagcccctggtggaggacaacgaggaggagagctgctacatcctgcacagcagcagcaacgaggacaagaccgagttcagcggcaccatccacgacatcaacagcagcctgatcctggaggcccccaagggcttcagagacgagccctacttcaaggaggagctggtggacgagcccttcctggacctgggcaagagcttccacagccagcagaaggagatcgagcagagcaaggaggcctgggagatgcacgagttcctgacccccagactgcaggagatggacgaggagagagagatcctggtggacgaggagtacgagctgtaccaggaccccagccccagcatggagctgtaccccctgagccacatccaggaggccacccccgtgcccagcgtgaacgagctgcacttcggcacccagtggctgcacgacaacgagcccagcgagagccaggaggccagaaccggcagaaccgtgtacagccaggaggcccagccctacggctactgccccgagaacgtgatgaaggagaacttcgtgatggagagcctgcccagcgtgcccagcaccgagggcaacagccagcagggcagattcgacgacctggagaacctgaacagcctggccaagaccagcctggacctgggcatgatccccaacgacgtgcagggccccagcctgctgatcgacctgcccgtggtggcccagagaagagagcaggaggacctgcccctgtaccagcaccaggccaccagagtgatcagcaaggccagcgcctacaccggcatgctgagcagcagatacgccaccgacacctgcgagctgcccgagagagaggagggcgagggcgaggagacccccaacttcagccactggggcccccccagaatcgtggagatcttcagagagcccaacgtgagcctgggcatcagcatcgtgggcggccagaccgtgatcaagagactgaagaacggcgaggagctgaagggcatcttcatcaagcaggtgctggaggacagccccgccggcaagaccaacgccctgaagaccggcgacaagatcctggaggtgagcggcgtggacctgcagaacgccagccacagcgaggccgtggaggccatcaagaacgccggcaaccccgtggtgttcatcgtgcagagcctgagcagcacccccgcctgggtgaccgagcaggacagcgtgagcaagaagaagaagaaccacgagggctag

SEQ ID NO: 85122 - DNA, 600 bp, Artificial Sequence
  Description of Artificial Sequence: Synthetic coding sequence
atggtgcagggcggcttccccgagaagatcagacagagatacgccgacctgcccggcgagctgcacatcatcgagctggagaaggacaagaacggcctgggcctgagcctggccggcaacaaggacagaagcagaatgagcatcttcgtggtgggcatcaaccccgagggccccgccgccgccgacggcagaatgagaatcggcgacgagctgctggagatcaacaaccagatcctgtacggcagaagccaccagaacgccagcgccatcatcaagaccgcccccagcaaggtgaagctggtgttcatcagaaacgaggacgccgtgaaccagatggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggctag

SEQ ID NO: 85123 - DNA, 4746 bp, Artificial Sequence
  Description of Artificial Sequence: Synthetic coding sequence
atgcccgagaaccccgccaccgacaagctgcaggtgctgcaggtgctggacagactgaagatgaagctgcaggagaagggcgacaccagccagaacgagaagctgagcatgttctacgagaccctgaagagccccctgttcaaccagatcctgaccctgcagcagagcatcaagcagctgaagggccagctgaaccacatccccagcgactgcagcgccaacttcgacttcagcagaaagggcctgctggtgttcaccgacggcagcatcaccaacggcaacgtgcacagacccagcaacaacagcaccgtgagcggcctgttcccctggacccccaagctgggcaacgaggacttcaacagcgtgatccagcagatggcccagggcagacagatcgagtacatcgacatcgagagacccagcaccggcggcctgggcttcagcgtggtggccctgagaagccagaacctgggcaaggtggacatcttcgtgaaggacgtgcagcccggcagcgtggccgacagagaccagagactgaaggagaacgaccagatcctggccatcaaccacacccccctggaccagaacatcagccaccagcaggccatcgccctgctgcagcagaccaccggcagcctgagactgatcgtggccagagagcccgtgcacaccaagagcagcaccagcagcagcctgaacgacaccaccctgcccgagaccgtgtgctggggccacgtggaggaggtggagctgatcaacgacggcagcggcctgggcttcggcatcgtgggcggcaagaccagcggcgtggtggtgagaaccatcgtgcccggcggcctggccgacagagacggcagactgcagaccggcgaccacatcctgaagatcggcggcaccaacgtgcagggcatgaccagcgagcaggtggcccaggtgctgagaaactgcggcaacagcgtgagaatgctggtggccagagaccccgccggcgacatcagcgtgaccccccccgcccccgccgccctgcccgtggccctgcccaccgtggccagcaagggccccggcagcgacagcagcctgttcgagacctacaacgtggagctggtgagaaaggacggccagagcctgggcatcagaatcgtgggctacgtgggcaccagccacaccggcgaggccagcggcatctacgtgaagagcatcatccccggcagcgccgcctaccacaacggccacatccaggtgaacgacaagatcgtggccgtggacggcgtgaacatccagggcttcgccaaccacgacgtggtggaggtgctgagaaacgccggccaggtggtgcacctgaccctggtgagaagaaagaccagcagcagcaccagccccctggagccccccagcgacagaggcaccgtggtggagcccctgaagccccccgccctgttcctgaccggcgccgtggagaccgagaccaacgtggacggcgaggacgaggagatcaaggagagaatcgacaccctgaagaacgacaacatccaggccctggagaagctggagaaggtgcccgacagccccgagaacgagctgaagagcagatgggagaacctgctgggccccgactacgaggtgatggtggccaccctggacacccagatcgccgacgacgccgagctgcagaagtacagcaagctgctgcccatccacaccctgagactgggcgtggaggtggacagcttcgacggccaccactacatcagcagcatcgtgagcggcggccccgtggacaccctgggcctgctgcagcccgaggacgagctgctggaggtgaacggcatgcagctgtacggcaagagcagaagagaggccgtgagcttcctgaaggaggtgcccccccccttcaccctggtgtgctgcagaagactgttcgacgacgaggccagcgtggacgagcccagaagaaccgagaccagcctgcccgagaccgaggtggaccacaacatggacgtgaacaccgaggaggacgacgacggcgagctggccctgtggagccccgaggtgaagatcgtggagctggtgaaggactgcaagggcctgggcttcagcatcctggactaccaggaccccctggaccccaccagaagcgtgatcgtgatcagaagcctggtggccgacggcgtggccgagagaagcggcggcctgctgcccggcgacagactggtgagcgtgaacgagtactgcctggacaacaccagcctggccgaggccgtggagatcctgaaggccgtgccccccggcctggtgcacctgggcatctgcaagcccctggtggaggacaacgaggaggagagctgctacatcctgcacagcagcagcaacgaggacaagaccgagttcagcggcaccatccacgacatcaacagcagcctgatcctggaggcccccaagggcttcagagacgagccctacttcaaggaggagctggtggacgagcccttcctggacctgggcaagagcttccacagccagcagaaggagatcgagcagagcaaggaggcctgggagatgcacgagttcctgacccccagactgcaggagatggacgaggagagagagatcctggtggacgaggagtacgagctgtaccaggaccccagccccagcatggagctgtaccccctgagccacatccaggaggccacccccgtgcccagcgtgaacgagctgcacttcggcacccagtggctgcacgacaacgagcccagcgagagccaggaggccagaaccggcagaaccgtgtacagccaggaggcccagccctacggctactgccccgagaacgtgatgaaggagaacttcgtgatggagagcctgcccagcgtgcccagcaccgagggcaacagccagcagggcagattcgacgacctggagaacctgaacagcctggccaagaccagcctggacctgggcatgatccccaacgacgtgcagggccccagcctgctgatcgacctgcccgtggtggcccagagaagagagcaggaggacctgcccctgtaccagcaccaggccaccagagtgatcagcaaggccagcgcctacaccggcatgctgagcagcagatacgccaccgacacctgcgagctgcccgagagagaggagggcgagggcgaggagacccccaacttcagccactggggcccccccagaatcgtggagatcttcagagagcccaacgtgagcctgggcatcagcatcgtgggcggccagaccgtgatcaagagactgaagaacggcgaggagctgaagggcatcttcatcaagcaggtgctggaggacagccccgccggcaagaccaacgccctgaagaccggcgacaagatcctggaggtgagcggcgtggacctgcagaacgccagccacagcgaggccgtggaggccatcaagaacgccggcaaccccgtggtgttcatcgtgcagagcctgagcagcacccccagagtgatccccaacgtgcacaacaaggccaacaagatcaccggcaaccagaaccaggacacccaggagaagaaggagaagagacagggcaccgcccccccccccatgaagctgccccccccctacaaggccctgaccgacgacagcgacgagaacgaggaggaggacgccttcaccgaccagaagatcagacagagatacgccgacctgcccggcgagctgcacatcatcgagctggagaaggacaagaacggcctgggcctgagcctggccggcaacaaggacagaagcagaatgagcatcttcgtggtgggcatcaaccccgagggccccgccgccgccgacggcagaatgagaatcggcgacgagctgctggagatcaacaaccagatcctgtacggcagaagccaccagaacgccagcgccatcatcaagaccgcccccagcaaggtgaagctggtgttcatcagaaacgaggacgccgtgaaccagatggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggcggcttccaggcccccctgagcgtggaccccgccacctgccccatcgtgcccggccaggagatgatcatcgagatcagcaagggcagaagcggcctgggcctgagcatcgtgggcggcaaggacacccccctgttctggagactgggcagccccagagcctggagccagcacctggtgagagccttcatgctgcaccaccccgtgaccgaggtggagggccagaacgccatcgtgatccacgaggtgtacgaggagggcgccgccgccagagacggcagactgtgggccggcgaccagatcctggaggtgaacggcgtggacctgagaaacagcagccacgaggaggccatcaccgccctgagacagaccccccagaaggtgagactggtggtgtacagagacgaggcccactacagagacgaggagaacctggagatcttccccgtggacctgcagaagaaggccggcagaggcctgggcctgagcatcgtgggcaagtag

SEQ ID NO: 85124 - DNA, 5406 bp, Artificial Sequence
  Description of Artificial Sequence: Synthetic coding sequence
atgcccgagaaccccgccaccgacaagctgcaggtgctgcaggtgctggacagactgaagatgaagctgcaggagaagggcgacaccagccagaacgagaagctgagcatgttctacgagaccctgaagagccccctgttcaaccagatcctgaccctgcagcagagcatcaagcagctgaagggccagctgaaccacatccccagcgactgcagcgccaacttcgacttcagcagaaagggcctgctggtgttcaccgacggcagcatcaccaacggcaacgtgcacagacccagcaacaacagcaccgtgagcggcctgttcccctggacccccaagctgggcaacgaggacttcaacagcgtgatccagcagatggcccagggcagacagatcgagtacatcgacatcgagagacccagcaccggcggcctgggcttcagcgtggtggccctgagaagccagaacctgggcaaggtggacatcttcgtgaaggacgtgcagcccggcagcgtggccgacagagaccagagactgaaggagaacgaccagatcctggccatcaaccacacccccctggaccagaacatcagccaccagcaggccatcgccctgctgcagcagaccaccggcagcctgagactgatcgtggccagagagcccgtgcacaccaagagcagcaccagcagcagcctgaacgacaccaccctgcccgagaccgtgtgctggggccacgtggaggaggtggagctgatcaacgacggcagcggcctgggcttcggcatcgtgggcggcaagaccagcggcgtggtggtgagaaccatcgtgcccggcggcctggccgacagagacggcagactgcagaccggcgaccacatcctgaagatcggcggcaccaacgtgcagggcatgaccagcgagcaggtggcccaggtgctgagaaactgcggcaacagcgtgagaatgctggtggccagagaccccgccggcgacatcagcgtgaccccccccgcccccgccgccctgcccgtggccctgcccaccgtggccagcaagggccccggcagcgacagcagcctgttcgagacctacaacgtggagctggtgagaaaggacggccagagcctgggcatcagaatcgtgggctacgtgggcaccagccacaccggcgaggccagcggcatctacgtgaagagcatcatccccggcagcgccgcctaccacaacggccacatccaggtgaacgacaagatcgtggccgtggacggcgtgaacatccagggcttcgccaaccacgacgtggtggaggtgctgagaaacgccggccaggtggtgcacctgaccctggtgagaagaaagaccagcagcagcaccagccccctggagccccccagcgacagaggcaccgtggtggagcccctgaagccccccgccctgttcctgaccggcgccgtggagaccgagaccaacgtggacggcgaggacgaggagatcaaggagagaatcgacaccctgaagaacgacaacatccaggccctggagaagctggagaaggtgcccgacagccccgagaacgagctgaagagcagatgggagaacctgctgggccccgactacgaggtgatggtggccaccctggacacccagatcgccgacgacgccgagctgcagaagtacagcaagctgctgcccatccacaccctgagactgggcgtggaggtggacagcttcgacggccaccactacatcagcagcatcgtgagcggcggccccgtggacaccctgggcctgctgcagcccgaggacgagctgctggaggtgaacggcatgcagctgtacggcaagagcagaagagaggccgtgagcttcctgaaggaggtgcccccccccttcaccctggtgtgctgcagaagactgttcgacgacgaggccagcgtggacgagcccagaagaaccgagaccagcctgcccgagaccgaggtggaccacaacatggacgtgaacaccgaggaggacgacgacggcgagctggccctgtggagccccgaggtgaagatcgtggagctggtgaaggactgcaagggcctgggcttcagcatcctggactaccaggaccccctggaccccaccagaagcgtgatcgtgatcagaagcctggtggccgacggcgtggccgagagaagcggcggcctgctgcccggcgacagactggtgagcgtgaacgagtactgcctggacaacaccagcctggccgaggccgtggagatcctgaaggccgtgccccccggcctggtgcacctgggcatctgcaagcccctggtggaggacaacgaggaggagagctgctacatcctgcacagcagcagcaacgaggacaagaccgagttcagcggcaccatccacgacatcaacagcagcctgatcctggaggcccccaagggcttcagagacgagccctacttcaaggaggagctggtggacgagcccttcctggacctgggcaagagcttccacagccagcagaaggagatcgagcagagcaaggaggcctgggagatgcacgagttcctgacccccagactgcaggagatggacgaggagagagagatcctggtggacgaggagtacgagctgtaccaggaccccagccccagcatggagctgtaccccctgagccacatccaggaggccacccccgtgcccagcgtgaacgagctgcacttcggcacccagtggctgcacgacaacgagcccagcgagagccaggaggccagaaccggcagaaccgtgtacagccaggaggcccagccctacggctactgccccgagaacgtgatgaaggagaacttcgtgatggagagcctgcccagcgtgcccagcaccgagggcaacagccagcagggcagattcgacgacctggagaacctgaacagcctggccaagaccagcctggacctgggcatgatccccaacgacgtgcagggccccagcctgctgatcgacctgcccgtggtggcccagagaagagagcaggaggacctgcccctgtaccagcaccaggccaccagagtgatcagcaaggccagcgcctacaccggcatgctgagcagcagatacgccaccgacacctgcgagctgcccgagagagaggagggcgagggcgaggagacccccaacttcagccactggggcccccccagaatcgtggagatcttcagagagcccaacgtgagcctgggcatcagcatcgtgggcggccagaccgtgatcaagagactgaagaacggcgaggagctgaagggcatcttcatcaagcaggtgctggaggacagccccgccggcaagaccaacgccctgaagaccggcgacaagatcctggaggtgagcggcgtggacctgcagaacgccagccacagcgaggccgtggaggccatcaagaacgccggcaaccccgtggtgttcatcgtgcagagcctgagcagcacccccagagtgatccccaacgtgcacaacaaggccaacaagatcaccggcaaccagaaccaggacacccaggagaagaaggagaagagacagggcaccgcccccccccccatgaagctgccccccccctacaaggccctgaccgacgacagcgacgagaacgaggaggaggacgccttcaccgaccagaagatcagacagagatacgccgacctgcccggcgagctgcacatcatcgagctggagaaggacaagaacggcctgggcctgagcctggccggcaacaaggacagaagcagaatgagcatcttcgtggtgggcatcaaccccgagggccccgccgccgccgacggcagaatgagaatcggcgacgagctgctggagatcaacaaccagatcctgtacggcagaagccaccagaacgccagcgccatcatcaagaccgcccccagcaaggtgaagctggtgttcatcagaaacgaggacgccgtgaaccagatggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggcggcttccaggcccccctgagcgtggaccccgccacctgccccatcgtgcccggccaggagatgatcatcgagatcagcaagggcagaagcggcctgggcctgagcatcgtgggcggcaaggacacccccctgaacgccatcgtgatccacgaggtgtacgaggagggcgccgccgccagagacggcagactgtgggccggcgaccagatcctggaggtgaacggcgtggacctgagaaacagcagccacgaggaggccatcaccgccctgagacagaccccccagaaggtgagactggtggtgtacagagacgaggcccactacagagacgaggagaacctggagatcttccccgtggacctgcagaagaaggccggcagaggcctgggcctgagcatcgtgggcaagagaaacggcagcggcgtgttcatcagcgacatcgtgaagggcggcgccgccgacctggacggcagactgatccagggcgaccagatcctgagcgtgaacggcgaggacatgagaaacgccagccaggagaccgtggccaccatcctgaagtgcgcccagggcctggtgcagctggagatcggcagactgagagccggcagctggaccagcgccagaaccaccagccagaacagccagggcagccagcagagcgcccacagcagctgccaccccagcttcgcccccgtgatcaccggcctgcagaacctggtgggcaccaagagagtgagcgaccccagccagaagaacagcggcaccgacatggagcccagaaccgtggagatcaacagagagctgagcgacgccctgggcatcagcatcgccggcggcagaggcagccccctgggcgacatccccgtgttcatcgccatgatccaggccagcggcgtggccgccagaacccagaagctgaaggtgggcgacagaatcgtgagcatcaacggccagcccctggacggcctgagccacgccgacgtggtgaacctgctgaagaacgcctacggcagaatcatcctgcaggtggtggccgacaccaacatcagcgccatcgccgcccagctggagaacatgagcaccggctaccacctgggcagccccaccgccgagcaccaccccgaggacaccgaggagcagctgcagatgaccgccgactag

SEQ ID NO: 85125 - DNA, 4572 bp, Artificial Sequence
  Description of Artificial Sequence: Synthetic coding sequence
atgcccgagaaccccgccaccgacaagctgcaggtgctgcaggtgctggacagactgaagatgaagctgcaggagaagggcgacaccagccagaacgagaagctgagcatgttctacgagaccctgaagagccccctgttcaaccagatcctgaccctgcagcagagcatcaagcagctgaagggccagctgaaccacatccccagcgactgcagcgccaacttcgacttcagcagaaagggcctgctggtgttcaccgacggcagcatcaccaacggcaacgtgcacagacccagcaacaacagcaccgtgagcggcctgttcccctggacccccaagctgggcaacgaggacttcaacagcgtgatccagcagatggcccagggcagacagatcgagtacatcgacatcgagagacccagcaccggcggcctgggcttcagcgtggtggccctgagaagccagaacctgggcaaggtggacatcttcgtgaaggacgtgcagcccggcagcgtggccgacagagaccagagactgaaggagaacgaccagatcctggccatcaaccacacccccctggaccagaacatcagccaccagcaggccatcgccctgctgcagcagaccaccggcagcctgagactgatcgtggccagagagcccgtgcacaccaagagcagcaccagcagcagcctgaacgacaccaccctgcccgagaccgtgtgctggggccacgtggaggaggtggagctgatcaacgacggcagcggcctgggcttcggcatcgtgggcggcaagaccagcggcgtggtggtgagaaccatcgtgcccggcggcctggccgacagagacggcagactgcagaccggcgaccacatcctgaagatcggcggcaccaacgtgcagggcatgaccagcgagcaggtggcccaggtgctgagaaactgcggcaacagcgtgagaatgctggtggccagagaccccgccggcgacatcagcgtgaccccccccgcccccgccgccctgcccgtggccctgcccaccgtggccagcaagggccccggcagcgacagcagcctgttcgagacctacaacgtggagctggtgagaaaggacggccagagcctgggcatcagaatcgtgggctacgtgggcaccagccacaccggcgaggccagcggcatctacgtgaagagcatcatccccggcagcgccgcctaccacaacggccacatccaggtgaacgacaagatcgtggccgtggacggcgtgaacatccagggcttcgccaaccacgacgtggtggaggtgctgagaaacgccggccaggtggtgcacctgaccctggtgagaagaaagaccagcagcagcaccagccccctggagccccccagcgacagaggcaccgtggtggagcccctgaagccccccgccctgttcctgaccggcgccgtggagaccgagaccaacgtggacggcgaggacgaggagatcaaggagagaatcgacaccctgaagaacgacaacatccaggccctggagaagctggagaaggtgcccgacagccccgagaacgagctgaagagcagatgggagaacctgctgggccccgactacgaggtgatggtggccaccctggacacccagatcgccgacgacgccgagctgcagaagtacagcaagctgctgcccatccacaccctgagactgggcgtggaggtggacagcttcgacggccaccactacatcagcagcatcgtgagcggcggccccgtggacaccctgggcctgctgcagcccgaggacgagctgctggaggtgaacggcatgcagctgtacggcaagagcagaagagaggccgtgagcttcctgaaggaggtgcccccccccttcaccctggtgtgctgcagaagactgttcgacgacgaggccagcgtggacgagcccagaagaaccgagaccagcctgcccgagaccgaggtggaccacaacatggacgtgaacaccgaggaggacgacgacggcgagctggccctgtggagccccgaggtgaagatcgtggagctggtgaaggactgcaagggcctgggcttcagcatcctggactaccaggaccccctggaccccaccagaagcgtgatcgtgatcagaagcctggtggccgacggcgtggccgagagaagcggcggcctgctgcccggcgacagactggtgagcgtgaacgagtactgcctggacaacaccagcctggccgaggccgtggagatcctgaaggccgtgccccccggcctggtgcacctgggcatctgcaagcccctggtggaggacaacgaggaggagagctgctacatcctgcacagcagcagcaacgaggacaagaccgagttcagcggcaccatccacgacatcaacagcagcctgatcctggaggcccccaagggcttcagagacgagccctacttcaaggaggagctggtggacgagcccttcctggacctgggcaagagcttccacagccagcagaaggagatcgagcagagcaaggaggcctgggagatgcacgagttcctgacccccagactgcaggagatggacgaggagagagagatcctggtggacgaggagtacgagctgtaccaggaccccagccccagcatggagctgtaccccctgagccacatccaggaggccacccccgtgcccagcgtgaacgagctgcacttcggcacccagtggctgcacgacaacgagcccagcgagagccaggaggccagaaccggcagaaccgtgtacagccaggaggcccagccctacggctactgccccgagaacgtgatgaaggagaacttcgtgatggagagcctgcccagcgtgcccagcaccgagggcaacagccagcagggcagattcgacgacctggagaacctgaacagcctggccaagaccagcctggacctgggcatgatccccaacgacgtgcagggccccagcctgctgatcgacctgcccgtggtggcccagagaagagagcaggaggacctgcccctgtaccagcaccaggccaccagagtgatcagcaaggccagcgcctacaccggcatgctgagcagcagatacgccaccgacacctgcgagctgcccgagagagaggagggcgagggcgaggagacccccaacttcagccactggggcccccccagaatcgtggagatcttcagagagcccaacgtgagcctgggcatcagcatcgtgggcggccagaccgtgatcaagagactgaagaacggcgaggagctgaagggcatcttcatcaagcaggtgctggaggacagccccgccggcaagaccaacgccctgaagaccggcgacaagatcctggaggtgagcggcgtggacctgcagaacgccagccacagcgaggccgtggaggccatcaagaacgccggcaaccccgtggtgttcatcgtgcagagcctgagcagcacccccagagtgatccccaacgtgcacaacaaggccaacaagatcaccggcaaccagaaccaggacacccaggagaagaaggagaagagacagggcaccgcccccccccccatgaagctgccccccccctacaaggccctgaccgacgacagcgacgagaacgaggaggaggacgccttcaccgaccagaagatcagacagagatacgccgacctgcccggcgagctgcacatcatcgagctggagaaggacaagaacggcctgggcctgagcctggccggcaacaaggacagaagcagaatgagcatcttcgtggtgggcatcaaccccgagggccccgccgccgccgacggcagaatgagaatcggcgacgagctgctggagatcaacaaccagatcctgtacggcagaagccaccagaacgccagcgccatcatcaagaccgcccccagcaaggtgaagctggtgttcatcagaaacgaggacgccgtgaaccagatggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggcggcttccaggcccccctgagcgtggaccccgccacctgccccatcgtgcccggccaggagatgatcatcgagatcagcaagggcagaagcggcctgggcctgagcatcgtgggcggcaaggacacccccctggtgaacggcgtggacctgagaaacagcagccacgaggaggccatcaccgccctgagacagaccccccagaaggtgagactggtggtgtacagagacgaggcccactacagagacgaggagaacctggagatcttccccgtggacctgcagaagaaggccggcagaggcctgggcctgagcatcgtgggcaagtag

SEQ ID NO: 85126 - DNA, 1359 bp, Artificial Sequence
  Description of Artificial Sequence: Synthetic coding sequence
atggtgcagggcggcttccccgagaagatcagacagagatacgccgacctgcccggcgagctgcacatcatcgagctggagaaggacaagaacggcctgggcctgagcctggccggcaacaaggacagaagcagaatgagcatcttcgtggtgggcatcaaccccgagggccccgccgccgccgacggcagaatgagaatcggcgacgagctgctggagatcaacaaccagatcctgtacggcagaagccaccagaacgccagcgccatcatcaagaccgcccccagcaaggtgaagctggtgttcatcagaaacgaggacgccgtgaaccagatggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggcggcttccaggcccccctgagcgtggaccccgccacctgccccatcgtgcccggccaggagatgatcatcgagatcagcaagggcagaagcggcctgggcctgagcatcgtgggcggcaaggacacccccctgttctggagactgggcagccccagagcctggagccagcacctggtgagagccttcatgctgcaccaccccgtgaccgaggtggagggccagaacgccatcgtgatccacgaggtgtacgaggagggcgccgccgccagagacggcagactgtgggccggcgaccagatcctggaggtgaacggcgtggacctgagaaacagcagccacgaggaggccatcaccgccctgagacagaccccccagaaggtgagactggtggtgtacagagacgaggcccactacagagacgaggagaacctggagatcttccccgtggacctgcagaagaaggccggcagaggcctgggcctgagcatcgtgggcaagagaaacggcagcggcgtgttcatcagcgacatcgtgaagggcggcgccgccgacctggacggcagactgatccagggcgaccagatcctgagcgtgaacggcgaggacatgagaaacgccagccaggagaccgtggccaccatcctgaagtgcgcccagggcctggtgcagctggagatcggcagactgagagccggcagctggaccagcgccagaaccaccagccagaacagccaggtggtggacggcttcagcagcgactag

SEQ ID NO: 85127 - DNA, 594 bp, Artificial Sequence
  Description of Artificial Sequence: Synthetic coding sequence
atggccgtgacccccttccccgtgcccagcagcagccccagcagcatcgaggaccagagcggcaccgagcccatcagcagcgaggaggacggcagcgtggaggtgggcatcaagcagctgcccgagagcgagagcttcaagctggccgtgagccagatgaagcagcagaagtaccccaccaaggtgagcttcagcagccaggagatccccctggcccccgccagcagctaccacagcaccgacgccgacttcaccggctacggcggcttccaggcccccctgagcgtggaccccgccacctgccccatcgtgcccggccaggagatgatcatcgagatcagcaagggcagaagcggcctgggcctgagcatcgtgggcggcaaggacacccccctggtgaacggcgtggacctgagaaacagcagccacgaggaggccatcaccgccctgagacagaccccccagaaggtgagactggtggtgtacagagacgaggcccactacagagacgaggagaacctggagatcttccccgtggacctgcagaagaaggccggcagaggcctgggcctgagcatcgtgggcaagagatag

SEQ ID NO: 85128 - DNA, 1236 bp, Artificial Sequence
  Description of Artificial Sequence: Synthetic coding sequence
atgagccccgccagactgagacccagactgcacttctgcctggtgctgctgctgctgctggtggtgcccgccgcctggggctgcggccccggcagagtggtgggcagcagaagaagaccccccagaaagctggtgcccctggcctacaagcagttcagccccaacgtgcccgagaagaccctgggcgccagcggcagatacgagggcaagatcgccagaagcagcgagagattcaaggagctgacccccaactacaaccccgacatcatcttcaaggacgaggagaacaccggcgccgacagactgatgacccagagatgcaaggacagactgaacagcctggccatcagcgtgatgaaccagtggcccggcgtgaagctgagagtgaccgagggctgggacgaggacggccaccacagcgaggagagcctgcactacgagggcagagccgtggacatcaccaccagcgacagagacagaaacaagtacggcctgctggccagactggccgtggaggccggcttcgactgggtgtactacgagagcaaggcccacgtgcactgcagcgtgaagagcgagcacagcgccgccgccaagaccggcggctgcttccccgccggcgcccaggtgagactggagagcggcgccagagtggccctgagcgccgtgagacccggcgacagagtgctggccatgggcgaggacggcagccccaccttcagcgacgtgctgatcttcctggacagagagccccacagactgagagccttccaggtgatcgagacccaggacccccccagaagactggccctgacccccgcccacctgctgttcaccgccgacaaccacaccgagcccgccgccagattcagagccaccttcgccagccacgtgcagcccggccagtacgtgctggtggccggcgtgcccggcctgcagcccgccagagtggccgccgtgagcacccacgtggccctgggcgcctacgcccccctgaccaagcacggcaccctggtggtggaggacgtggtggccagctgcttcgccgccgtggccgaccaccacctggcccagctggccttctggcccctgagactgttccacagcctggcctggggcagctggacccccggcgagggcgtgcactggtacccccagctgctgtacagactgggcagactgctgctggaggagggcagcttccaccccctgggcatgagcggcgccggcagctag

SEQ ID NO: 85129 - DNA, 1212 bp, Artificial Sequence
  Description of Artificial Sequence: Synthetic coding sequence
atggcccacgccatggagaacagctggaccatcagcaaggagtaccacatcgacgaggaggtgggcttcgccctgcccaacccccaggagaacctgcccgacttctacaacgactggatgttcatcgccaagcacctgcccgacctgatcgagagcggccagctgagagagagagtggagaagctgaacatgctgagcatcgaccacctgaccgaccacaagagccagagactggccagactggtgctgggctgcatcaccatggcctacgtgtggggcaagggccacggcgacgtgagaaaggtgctgcccagaaacatcgccgtgccctactgccagctgagcaagaagctggagctgccccccatcctggtgtacgccgactgcgtgctggccaactggaagaagaaggaccccaacaagcccctgacctacgagaacatggacgtgctgttcagcttcagagacggcgactgcagcaagggcttcttcctggtgagcctgctggtggagatcgccgccgccagcgccatcaaggtgatccccaccgtgttcaaggccatgcagatgcaggagagagacaccctgctgaaggccctgctggagatcgccagctgcctggagaaggccctgcaggtgttccaccagatccacgaccacgtgaaccccaaggccttcttcagcgtgctgagaatctacctgagcggctggaagggcaacccccagctgagcgacggcctggtgtacgagggcttctgggaggaccccaaggagttcgccggcggcagcgccggccagagcagcgtgttccagtgcttcgacgtgctgctgggcatccagcagaccgccggcggcggccacgccgcccagttcctgcaggacatgagaagatacatgccccccgcccacagaaacttcctgtgcagcctggagagcaaccccagcgtgagagagttcgtgctgagcaagggcgacgccggcctgagagaggcctacgacgcctgcgtgaaggccctggtgagcctgagaagctaccacctgcagatcgtgaccaagtacatcctgatccccgccagccagcagcccaaggagaacaagaccagcgaggaccccagcaagctggaggccaagggcaccggcggcaccgacctgatgaacttcctgaagaccgtgagaagcaccaccgagaagagcctgctgaaggagggctag

SEQ ID NO: 85130 - DNA, 237 bp, Artificial Sequence
  Description of Artificial Sequence: Synthetic coding sequence
atggcccacgccatggagaacagctggaccatcagcaaggagtaccacatcgacgaggaggtgggcttcgccctgcccaacccccaggagaacctgcccgacttctacaacgactggatgttcatcgccaagcacctgcccgacctgatcgagagcggccagctgagagagagagtggagaagctgaacatgctgagcatcgaccacctgaccgaccacaagagccagagactgtag

SEQ ID NO: 85131 - DNA, 543 bp, Artificial Sequence
  Description of Artificial Sequence: Synthetic coding sequence
atggcccacgccatggagaacagctggaccatcagcaaggagtaccacatcgacgaggaggtgggcttcgccctgcccaacccccaggagaacctgcccgacttctacaacgactggatgttcatcgccaagcacctgcccgacctgatcgagagcggccagctgagagagagagtggagaagctgaacatgctgagcatcgaccacctgaccgaccacaagagccagagactggccagactggtgctgggctgcatcaccatggcctacgtgtggggcaagggccacggcgacgtgagaaaggtgctgcccagaaacatcgccgtgccctactgccagctgagcaagaagctggagctgccccccatcctggtgtacgccgactgcgtgctggccaactggaagaagaaggaccccaacaagcccctgacctacgagaacatggacgtgctgttcagcttcagagacggcgactgcagcaagggcttcttcctggtgagcctgctggtggagatcgccgccgccagcgccatcaaggtgtag

SEQ ID NO: 85132 - DNA, 1212 bp, Artificial Sequence; identical to SEQ ID NO: 85129
  Description of Artificial Sequence: Synthetic coding sequence

SEQ ID NO: 85133 - DNA, 144 bp, Artificial Sequence
  Description of Artificial Sequence: Synthetic coding sequence
atggcccacgccatggagaacagctggaccatcagcaaggagtaccacatcgacgaggaggtgggcttcgccctgcccaacccccaggagaacctgcccgacttctacaacgactggatgttcatcgccaagcacctgccctag

SEQ ID NO: 85134 - DNA, 1224 bp, Artificial Sequence
  Description of Artificial Sequence: Synthetic coding sequence
atggagccccacagacccaacgtgaagaccgccgtgcccctgagcctggagagctaccacatcagcgaggagtacggcttcctgctgcccgacagcctgaaggagctgcccgaccactacagaccctggatggagatcgccaacaagctgccccagctgatcgacgcccaccagctgcaggcccacgtggacaagatgcccctgctgagctgccagttcctgaagggccacagagagcagagactggcccacctggtgctgagcttcctgaccatgggctacgtgtggcaggagggcgaggcccagcccgccgaggtgctgcccagaaacctggccctgcccttcgtggaggtgagcagaaacctgggcctgccccccatcctggtgcacagcgacctggtgctgaccaactggaccaagaaggaccccgacggcttcctggagatcggcaacctggagaccatcatcagcttccccggcggcgagagcctgcacggcttcatcctggtgaccgccctggtggagaaggaggccgtgcccggcatcaaggccctggtgcaggccaccaacgccatcctgcagcccaaccaggaggccctgctgcaggccctgcagagactgagactgagcatccaggacatcaccaagaccctgggccagatgcacgactacgtggaccccgacatcttctacgccggcatcagaatcttcctgagcggctggaaggacaaccccgccatgcccgccggcctgatgtacgagggcgtgagccaggagcccctgaagtacagcggcggcagcgccgcccagagcaccgtgctgcacgccttcgacgagttcctgggcatcagacacagcaaggagagcggcgacttcctgtacagaatgagagactacatgccccccagccacaaggccttcatcgaggacatccacagcgcccccagcctgagagactacatcctgagcagcggccaggaccacctgctgaccgcctacaaccagtgcgtgcaggccctggccgagctgagaagctaccacatcaccatggtgaccaagtacctgatcaccgccgccgccaaggccaagcacggcaagcccaaccacctgcccggccccccccaggccctgaaggacagaggcaccggcggcaccgccgtgatgagcttcctgaagagcgtgagagacaagaccctggagagcatcctgcaccccagaggctag

SEQ ID NO: 85135 - DNA, 1263 bp, Artificial Sequence
  Description of Artificial Sequence: Synthetic coding sequence
atgctgcacttccactactacgacaccagcaacaagatcatggagccccacagacccaacgtgaagaccgccgtgcccctgagcctggagagctaccacatcagcgaggagtacggcttcctgctgcccgacagcctgaaggagctgcccgaccactacagaccctggatggagatcgccaacaagctgccccagctgatcgacgcccaccagctgcaggcccacgtggacaagatgcccctgctgagctgccagttcctgaagggccacagagagcagagactggcccacctggtgctgagcttcctgaccatgggctacgtgtggcaggagggcgaggcccagcccgccgaggtgctgcccagaaacctggccctgcccttcgtggaggtgagcagaaacctgggcctgccccccatcctggtgcacagcgacctggtgctgaccaactggaccaagaaggaccccgacggcttcctggagatcggcaacctggagaccatcatcagcttccccggcggcgagagcctgcacggcttcatcctggtgaccgccctggtggagaaggaggccgtgcccggcatcaaggccctggtgcaggccaccaacgccatcctgcagcccaaccaggaggccctgctgcaggccctgcagagactgagactgagcatccaggacatcaccaagaccctgggccagatgcacgactacgtggaccccgacatcttctacgccggcatcagaatcttcctgagcggctggaaggacaaccccgccatgcccgccggcctgatgtacgagggcgtgagccaggagcccctgaagtacagcggcggcagcgccgcccagagcaccgtgctgcacgccttcgacgagttcctgggcatcagacacagcaaggagagcggcgacttcctgtacagaatgagagactacatgccccccagccacaaggccttcatcgaggacatccacagcgcccccagcctgagagactacatcctgagcagcggccaggaccacctgctgaccgcctacaaccagtgcgtgcaggccctggccgagctgagaagctaccacatcaccatggtgaccaagtacctgatcaccgccgccgccaaggccaagcacggcaagcccaaccacctgcccggccccccccaggccctgaaggacagaggcaccggcggcaccgccgtgatgagcttcctgaagagcgtgagagacaagaccctggagagcatcctgcaccccagaggctag

SEQ ID NO: 85136 - DNA, 792 bp, Artificial Sequence
  Description of Artificial Sequence: Synthetic coding sequence
atgaagggcggcttcaccggcggcgacgagtaccagaagcacttcctgcccagagactacctggccacctactacagcttcgacggcagccccagccccgaggccgagatgctgaagttcaacctggagtgcctgcacaagaccttcggccccggcggcctgcagggcgacaccctgatcgacatcggcagcggccccaccatctaccaggtgctggccgcctgcgacagcttccaggacatcaccctgagcgacttcaccgacagaaacagagaggagctggagaagtggctgaagaaggagcccggcgcctacgactggacccccgccgtgaagttcgcctgcgagctggagggcaacagcggcagatgggaggagaaggaggagaagctgagagccgccgtgaagagagtgctgaagtgcgacgtgcacctgggcaaccccctggcccccgccgtgctgcccctggccgactgcgtgctgaccctgctggccatggagtgcgcctgctgcagcctggacgcctacagagccgccctgtgcaacctggccagcctgctgaagcccggcggccacctggtgaccaccgtgaccctgagactgcccagctacatggtgggcaagagagagttcagctgcgtggccctggagaaggaggaggtggagcaggccgtgctggacgccggcttcgacatcgagcagctgctgcacagcccccagagctacagcgtgaccaacgccgccaacaacggcgtgtgcttcatcgtggccagaaagaagcccggcccctag

SEQ ID NO: 85137 - DNA, 789 bp, Artificial Sequence
  Description of Artificial Sequence: Synthetic coding sequence
atgaagggcggcttcaccggcggcgacgagtaccagaagcacttcctgcccagagactacctggccacctactacagcttcgacggcagccccagccccgaggccgagatgctgaagttcaacctggagtgcctgcacaagaccttcggccccggcctgcagggcgacaccctgatcgacatcggcagcggccccaccatctaccaggtgctggccgcctgcgacagcttccaggacatcaccctgagcgacttcaccgacagaaacagagaggagctggagaagtggctgaagaaggagcccggcgcctacgactggacccccgccgtgaagttcgcctgcgagctggagggcaacagcggcagatgggaggagaaggaggagaagctgagagccgccgtgaagagagtgctgaagtgcgacgtgcacctgggcaaccccctggcccccgccgtgctgcccctggccgactgcgtgctgaccctgctggccatggagtgcgcctgctgcagcctggacgcctacagagccgccctgtgcaacctggccagcctgctgaagcccggcggccacctggtgaccaccgtgaccctgagactgcccagctacatggtgggcaagagagagttcagctgcgtggccctggagaaggaggaggtggagcaggccgtgctggacgccggcttcgacatcgagcagctgctgcacagcccccagagctacagcgtgaccaacgccgccaacaacggcgtgtgcttcatcgtggccagaaagaagcccggcccctag

SEQ ID NO: 85138 - DNA, 600 bp, Artificial Sequence
  Description of Artificial Sequence: Synthetic coding sequence
atgaagagcggcctgtggtacttcttcctgttctgcctgagaatcaaggtgctgaccggcgagatcaacggcagcgccaactacgagatgttcatcttccacaacggcggcgtgcagatcctgtgcaagtaccccgacatcgtgcagcagttcaagatgcagctgctgaagggcggccagatcctgtgcgacctgaccaagaccaagggcagcggcaacaccgtgagcatcaagagcctgaagttctgccacagccagctgagcaacaacagcgtgagcttcttcctgtacaacctggaccacagccacgccaactactacttctgcaacctgagcatcttcgaccccccccccttcaaggtgaccctgaccggcggctacctgcacatctacgagagccagctgtgctgccagctgaagttctggctgcccatcggctgcgccgccttcgtggtggtgtgcatcctgggctgcatcctgatctgctggctgaccaagaagaagtacagcagcagcgtgcacgaccccaacggcgagtacatgttcatgagagccgtgaacaccgccaagaagagcagactgaccgacgtgaccctgtag

SEQ ID NO: 85139 - DNA, 507 bp, Artificial Sequence
  Description of Artificial Sequence: Synthetic coding sequence
atgaagagcggcctgtggtacttcttcctgttctgcctgagaatcaaggtgctgaccggcgagatcaacggcagcgccaactacgagatgttcatcttccacaacggcggcgtgcagatcctgtgcaagtaccccgacatcgtgcagcagttcaagatgcagctgctgaagggcggccagatcctgtgcgacctgaccaagaccaagggcagcggcaacaccgtgagcatcaagagcctgaagttctgccacagccagctgagcaacaacagcgtgagcttcttcctgtacaacctggaccacagccacgccaactactacttctgcaacctgagcatcttcgaccccccccccttcaaggtgaccctgaccggcggctacctgcacatctacgagagccagctgtgctgccagctgaagttctggctgcccatcggctgcgccgccttcgtggtggtgtgcatcctgggctgcatcctgatctgctggctgaccaagaagatgtag

SEQ ID NO: 85140 - DNA, 930 bp, Artificial Sequence
  Description of Artificial Sequence: Synthetic coding sequence
atgagactgggcagccccggcctgctgttcctgctgttcagcagcctgagagccgacacccaggagaaggaggtgagagccatggtgggcagcgacgtggagctgagctgcgcctgccccgagggcagcagattcgacctgaacgacgtgtacgtgtactggcagaccagcgagagcaagaccgtggtgacctaccacatcccccagaacagcagcctggagaacgtggacagcagatacagaaacagagccctgatgagccccgccggcatgctgagaggcgacttcagcctgagactgttcaacgtgaccccccaggacgagcagaagttccactgcctggtgctgagccagagcctgggcttccaggaggtgctgagcgtggaggtgaccctgcacgtggccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccgagagctggaacctgctgctgctgctgagctag

SEQ ID NO: 85141 - DNA, 558 bp, Artificial Sequence
  Description of Artificial Sequence: Synthetic coding sequence
atgagactgggcagccccggcctgctgttcctgctgttcagcagcctgagagccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccggccacgtgtag

SEQ ID NO: 85142 - DNA, 909 bp, Artificial Sequence
  Description of Artificial Sequence: Synthetic coding sequence
atgagactgggcagccccggcctgctgttcctgctgttcagcagcctgagagccgacacccaggagaaggaggtgagagccatggtgggcagcgacgtggagctgagctgcgcctgccccgagggcagcagattcgacctgaacgacgtgtacgtgtactggcagaccagcgagagcaagaccgtggtgacctaccacatcccccagaacagcagcctggagaacgtggacagcagatacagaaacagagccctgatgagccccgccggcatgctgagaggcgacttcagcctgagactgttcaacgtgaccccccaggacgagcagaagttccactgcctggtgctgagccagagcctgggcttccaggaggtgctgagcgtggaggtgaccctgcacgtggccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccggccacgtgtag

SEQ ID NO: 85143 - DNA, 1101 bp, Artificial Sequence
  Description of Artificial Sequence: Synthetic coding sequence
atggtgctgcacctgctgctgttcctgctgctgaccccccagggcggccacagctgccagggcctggagctggccagagagctggtgctggccaaggtgagagccctgttcctggacgccctgggcccccccgccgtgaccagagagggcggcgaccccggcgtgagaagactgcccagaagacacgccctgggcggcttcacccacagaggcagcgagcccgaggaggaggaggacgtgagccaggccatcctgttccccgccaccgacgccagctgcgaggacaagagcgccgccagaggcctggcccaggaggccgaggagggcctgttcagatacatgttcagacccagccagcacaccagaagcagacaggtgaccagcgcccagctgtggttccacaccggcctggacagacagggcaccgccgccagcaacagcagcgagcccctgctgggcctgctggccctgagccccggcggccccgtggccgtgcccatgagcctgggccacgcccccccccactgggccgtgctgcacctggccaccagcgccctgagcctgctgacccaccccgtgctggtgctgctgctgagatgccccctgtgcacctgcagcgccagacccgaggccacccccttcctggtggcccacaccagaaccagaccccccagcggcggcgagagagccagaagaagcacccccctgatgagctggccctggagccccagcgccctgagactgctgcagagaccccccgaggagcccgccgcccacgccaactgccacagagtggccctgaacatcagcttccaggagctgggctgggagagatggatcgtgtacccccccagcttcatcttccactactgccacggcggctgcggcctgcacatcccccccaacctgagcctgcccgtgcccggcgccccccccacccccgcccagccctacagcctgctgcccggcgcccagccctgctgcgccgccctgcccggcaccatgagacccctgcacgtgagaaccaccagcgacggcggctacagcttcaagtacgagaccgtgcccaacctgctgacccagcactgcgcctgcatctag

SEQ ID NO: 85144 - DNA, 1281 bp, Artificial Sequence
  Description of Artificial Sequence: Synthetic coding sequence
atgcccctgctgtggctgagaggcttcctgctggccagctgctggatcatcgtgagaagcagccccacccccggcagcgagggccacagcgccgcccccgactgccccagctgcgccctggccgccctgcccaaggacgtgcccaacagccagcccgagatggtggaggccgtgaagaagcacatcctgaacatgctgcacctgaagaagagacccgacgtgacccagcccgtgcccaaggccgccctgctgaacgccatcagaaagctgcacgtgggcaaggtgggcgagaacggctacgtggagatcgaggacgacatcggcagaagagccgagatgaacgagctgatggagcagaccagcgagatcatcaccttcgccgagagcggcaccgccagaaagaccctgcacttcgagatcagcaaggagggcagcgacctgagcgtggtggagagagccgaggtgtggctgttcctgaaggtgcccaaggccaacagaaccagaaccaaggtgaccatcagactgttccagcagcagaagcacccccagggcagcctggacaccggcgaggaggccgaggaggtgggcctgaagggcgagagaagcgagctgctgctgagcgagaaggtggtggacgccagaaagagcacctggcacgtgttccccgtgagcagcagcatccagagactgctggaccagggcaagagcagcctggacgtgagaatcgcctgcgagcagtgccaggagagcggcgccagcctggtgctgctgggcaagaagaagaagaaggaggaggagggcgagggcaagaagaagggcggcggcgagggcggcgccggcgccgacgaggagaaggagcagagccacagacccttcctgatgctgcaggccagacagagcgaggaccacccccacagaagaagaagaagaggcctggagtgcgacggcaaggtgaacatctgctgcaagaagcagttcttcgtgagcttcaaggacatcggctggaacgactggatcatcgcccccagcggctaccacgccaactactgcgagggcgagtgccccagccacatcgccggcaccagcggcagcagcctgagcttccacagcaccgtgatcaaccactacagaatgagaggccacagccccttcgccaacctgaagagctgctgcgtgcccaccaagctgagacccatgagcatgctgtactacgacgacggccagaacatcatcaagaaggacatccagaacatgatcgtggaggagtgcggctgcagctag

SEQ ID NO: 85145 - DNA, 1281 bp, Artificial Sequence; identical to SEQ ID NO: 85144
  Description of Artificial Sequence: Synthetic coding sequence

SEQ ID NO: 85146 - DNA, 1224 bp, Artificial Sequence
  Description of Artificial Sequence: Synthetic coding sequence
atggacggcctgcccggcagagccctgggcgccgcctgcctgctgctgctggccgccggctggctgggccccgaggcctggggcagccccacccccccccccacccccgccgcccccccccccccccccccccccggcagccccggcggcagccaggacacctgcaccagctgcggcggcttcagaagacccgaggagctgggcagagtggacggcgacttcctggaggccgtgaagagacacatcctgagcagactgcagatgagaggcagacccaacatcacccacgccgtgcccaaggccgccatggtgaccgccctgagaaagctgcacgccggcaaggtgagagaggacggcagagtggagatcccccacctggacggccacgccagccccggcgccgacggccaggagagagtgagcgagatcatcagcttcgccgagaccgacggcctggccagcagcagagtgagactgtacttcttcatcagcaacgagggcaaccagaacctgttcgtggtgcaggccagcctgtggctgtacctgaagctgctgccctacgtgctggagaagggcagcagaagaaaggtgagagtgaaggtgtacttccaggagcagggccacggcgacagatggaacatggtggagaagagagtggacctgaagagaagcggctggcacaccttccccctgaccgaggccatccaggccctgttcgagagaggcgagagaagactgaacctggacgtgcagtgcgacagctgccaggagctggccgtggtgcccgtgttcgtggaccccggcgaggagagccacagacccttcgtggtggtgcaggccagactgggcgacagcagacacagaatcagaaagagaggcctggagtgcgacggcagaaccaacctgtgctgcagacagcagttcttcatcgacttcagactgatcggctggaacgactggatcatcgcccccaccggctactacggcaactactgcgagggcagctgccccgcctacctggccggcgtgcccggcagcgccagcagcttccacaccgccgtggtgaaccagtacagaatgagaggcctgaaccccggcaccgtgaacagctgctgcatccccaccaagctgagcaccatgagcatgctgtacttcgacgacgagtacaacatcgtgaagagagacgtgcccaacatgatcgtggaggagtgcggctgcgcctag

SEQ ID NO: 85147 - DNA, 1059 bp, Artificial Sequence
  Description of Artificial Sequence: Synthetic coding sequence
atgaccagcagcctgctgctggccttcctgctgctggcccccaccaccgtggccacccccagagccggcggccagtgccccgcctgcggcggccccaccctggagctggagagccagagagagctgctgctggacctggccaagagaagcatcctggacaagctgcacctgacccagagacccaccctgaacagacccgtgagcagagccgccctgagaaccgccctgcagcacctgcacggcgtgccccagggcgccctgctggaggacaacagagagcaggagtgcgagatcatcagcttcgccgagaccggcctgagcaccatcaaccagaccagactggacttccacttcagcagcgacagaaccgccggcgacagagaggtgcagcaggccagcctgatgttcttcgtgcagctgcccagcaacaccacctggaccctgaaggtgagagtgctggtgctgggcccccacaacaccaacctgaccctggccacccagtacctgctggaggtggacgccagcggctggcaccagctgcccctgggccccgaggcccaggccgcctgcagccagggccacctgaccctggagctggtgctggagggccaggtggcccagagcagcgtgatcctgggcggcgccgcccacagacccttcgtggccgccagagtgagagtgggcggcaagcaccagatccacagaagaggcatcgactgccagggcggcagcagaatgtgctgcagacaggagttcttcgtggacttcagagagatcggctggcacgactggatcatccagcccgagggctacgccatgaacttctgcatcggccagtgccccctgcacatcgccggcatgcccggcatcgccgccagcttccacaccgccgtgctgaacctgctgaaggccaacaccgccgccggcaccaccggcggcggcagctgctgcgtgcccaccgccagaagacccctgagcctgctgtactacgacagagacagcaacatcgtgaagaccgacatccccgacatggtggtggaggcctgcggctgcagctag

SEQ ID NO: 85148 - DNA, 1053 bp, Artificial Sequence
  Description of Artificial Sequence: Synthetic coding sequence
atgagactgcccgacgtgcagctgtggctggtgctgctgtgggccctggtgagagcccagggcaccggcagcgtgtgccccagctgcggcggcagcaagctggccccccaggccgagagagccctggtgctggagctggccaagcagcagatcctggacggcctgcacctgaccagcagacccagaatcacccacccccccccccaggccgccctgaccagagccctgagaagactgcagcccggcagcgtggcccccggcaacggcgaggaggtgatcagcttcgccaccgtgaccgacagcaccagcgcctacagcagcctgctgaccttccacctgagcacccccagaagccaccacctgtaccacgccagactgtggctgcacgtgctgcccaccctgcccggcaccctgtgcctgagaatcttcagatggggccccagaagaagaagacagggcagcagaaccctgctggccgagcaccacatcaccaacctgggctggcacaccctgaccctgcccagcagcggcctgagaggcgagaagagcggcgtgctgaagctgcagctggactgcagacccctggagggcaacagcaccgtgaccggccagcccagaagactgctggacaccgccggccaccagcagcccttcctggagctgaagatcagagccaacgagcccggcgccggcagagccagaagaagaacccccacctgcgagcccgccacccccctgtgctgcagaagagaccactacgtggacttccaggagctgggctggagagactggatcctgcagcccgagggctaccagctgaactactgcagcggccagtgccccccccacctggccggcagccccggcatcgccgccagcttccacagcgccgtgttcagcctgctgaaggccaacaacccctggcccgccagcaccagctgctgcgtgcccaccgccagaagacccctgagcctgctgtacctggaccacaacggcaacgtggtgaagaccgacgtgcccgacatggtggtggaggcctgcggctgcagctag

SEQ ID NO: 85149 - DNA, 4062 bp, Artificial Sequence
  Description of Artificial Sequence: Synthetic coding sequence
atgagcagccccatgcccgactgcaccagcaagtgcagaagcctgaagcacgccctggacgtgctgagcgtggtgaccaagggcagcgagaaccagatcaaggccttcctgagcagccactgctacaacgccgccaccatcaaggacgtgttcggcagaaacgccctgcacctggtgagcagctgcggcaagaagggcgtgctggactggctgatccagaagggcgtggacctgctggtgaaggacaaggagagcggctggaccgccctgcacagaagcatcttctacggccacatcgactgcgtgtggagcctgctgaagcacggcgtgagcctgtacatccaggacaaggagggcctgagcgccctggacctggtgatgaaggacagacccacccacgtggtgttcaagaacaccgaccccaccgacgtgtacacctggggcgacaacaccaacttcaccctgggccacggcagccagaacagcaagcaccaccccgagctggtggacctgttcagcagaagcggcatctacatcaagcaggtggtgctgtgcaagttccacagcgtgttcctgagccagaagggccaggtgtacacctgcggccacggccccggcggcagactgggccacggcgacgagcagacctgcctggtgcccagactggtggagggcctgaacggccacaactgcagccaggtggccgccgccaaggaccacaccgtggtgctgaccgaggacggctgcgtgtacaccttcggcctgaacatcttccaccagctgggcatcatccccccccccagcagctgcaacgtgcccagacagatccaggccaagtacctgaagggcagaaccatcatcggcgtggccgccggcagattccacaccgtgctgtggaccagagaggccgtgtacaccatgggcctgaacggcggccagctgggctgcctgctggaccccaacggcgagaagtgcgtgaccgcccccagacaggtgagcgccctgcaccacaaggacatcgccctgagcctggtggccgccagcgacggcgccaccgtgtgcgtgaccaccagaggcgacatctacctgctggccgactaccagtgcaagaagatggccagcaagcagctgaacctgaagaaggtgctggtgagcggcggccacatggagtacaaggtggaccccgagcacctgaaggagaacggcggccagaagatctgcatcctggccatggacggcgccggcagagtgttctgctggagaagcgtgaacagcagcctgaagcagtgcagatgggcctaccccagacaggtgttcatcagcgacatcgccctgaacagaaacgagatcctgttcgtgacccaggacggcgagggcttcagaggcagatggttcgaggagaagagaaagagcagcgagaagaaggagatcctgagcaacctgcacaacagcagcagcgacgtgagctacgtgagcgacatcaacagcgtgtacgagagaatcagactggagaagctgaccttcgcccacagagccgtgagcgtgagcaccgaccccagcggctgcaacttcgccatcctgcagagcgaccccaagaccagcctgtacgagatccccgccgtgagcagcagcagcttcttcgaggagttcggcaagctgctgagagaggccgacgagatggacagcatccacgacgtgaccttccaggtgggcaacagactgttccccgcccacaagtacatcctggccgtgcacagcgacttcttccagaagctgttcctgagcgacggcaacaccagcgagttcaccgacatctaccagaaggacgaggacagcgccggctgccacctgttcgtggtggagaaggtgcaccccgacatgttcgagtacctgctgcagttcatctacaccgacacctgcgacttcctgacccacggcttcaagcccagaatccacctgaacaagaaccccgaggagtaccagggcaccctgaacagccacctgaacaaggtgaacttccacgaggacgacaaccagaagagcgccttcgaggtgtacaagagcaaccaggcccagaccgtgagcgagagacagaagagcaagcccaagagctgcaagaagggcaagaacatcagagaggacgaccccgtgagaatgctgcagaccgtggccaagaagttcgacttcagcaacctgagcagcagactggacggcgtgagattcgagaacgagaagatcaacgtgatcgccaagaacaccggcaacaagctgaagctgagccagaagaagtgcagcttcctgtgcgacgtgaccatgaagagcgtggacggcaaggagttcccctgccacaagtgcgtgctgtgcgccagactggagtacttccacagcatgctgagcagcagctggatcgaggccagcagctgcgccgccctggagatgcccatccacagcgacatcctgaaggtgatcctggactacctgtacaccgacgaggccgtggtgatcaaggagagccagaacgtggacttcatctgcagcgtgctggtggtggccgaccagctgctgatcaccagactgaaggagatctgcgaggtggccctgaccgagaagctgaccctgaagaacgccgccatgctgctggagttcgccgccatgtacagcgccaagcagctgaagctgagctgcctgcagttcatcggcctgaacatggccgccctgctggaggccagaagcctggacgtgctgagcgacggcgtgctgaaggacctgagcgagttctacagaaagatgatccccgccatggacagaagagtgatcaccccctaccaggacggccccgacatcagctacctggaggtggaggacggcgacatcttcctgaaggaggagatcaacatggagcagaaccacagcgagaccatgttcaagaaggccaagaccaaggccaagaagaagcccagaaagagaagcgacagcagcggcggctacaacctgagcgacatcatccagagccccagcagcaccggcctgctgaagagcggcaagaccaacagcgtggagagcctgcccgagctgctgaccagcgacagcgagggcagctacgccggcgtgggcagccccagagacctgcagagccccgacttcaccaccggcttccacagcgacaagatcgaggccaaggtgaagccctacgtgaacggcaccagccccgtgtacagcagagaggacctgaagccctgggagaagagccccatcctgaagatcagcgccccccagcccatccccagcaacagaatcgacaccaccagcagcgccagctgggtggccggcagcttcagccccgtgagcccccccgtggtggacctgagaaccatcatggagatcgaggagagcagacagaagtgcggcgccacccccaagagccacctgggcaagaccgtgagccacggcgtgaagctgagccagaagcagagaaagatgatcgccctgaccaccaaggagaacaacagcggcatgaacagcatggagaccgtgctgttcacccccagcaaggcccccaagcccgtgaacgcctgggccagcagcctgcacagcgtgagcagcaagagcttcagagacttcctgctggaggagaagaagagcgtgaccagccacagcagcggcgaccacgtgaagaaggtgagcttcaagggcatcgagaacagccaggcccccaagatcgtgagatgcagcacccacggcacccccggccccgagggcaaccacatcagcgacctgcccctgctggacagccccaacccctggctgagcagcagcgtgaccgcccccagcatggtggcccccgtgaccttcgccagcatcgtggaggaggagctgcagcaggaggccgccctgatcagaagcagagagaagcccctggccctgatccagatcgaggagcacgccatccaggacctgctggtgttctacgaggccttcggcaaccccgaggagttcgtgatcgtggagagaaccccccagggccccctggccgtgcccatgtggaacaagcacggctgctag

SEQ ID NO: 85150 - DNA, 1386 bp, Artificial Sequence
  Description of Artificial Sequence: Synthetic coding sequence
atgtggcagctgaccagcctgctgctgttcgtggccacctggggcatcagcggcacccccgcccccctggacagcgtgttcagcagcagcgagagagcccaccaggtgctgagaatcagaaagagagccaacagcttcctggaggagctgagacacagcagcctggagagagagtgcatcgaggagatctgcgacttcgaggaggccaaggagatcttccagaacgtggacgacaccctggccttctggagcaagcacgtggacggcgaccagtgcctggtgctgcccctggagcacccctgcgccagcctgtgctgcggccacggcacctgcatcgacggcatcggcagcttcagctgcgactgcagaagcggctgggagggcagattctgccagagagaggtgagcttcctgaactgcagcctggacaacggcggctgcacccactactgcctggaggaggtgggctggagaagatgcagctgcgcccccggctacaagctgggcgacgacctgctgcagtgccaccccgccgtgaagttcccctgcggcagaccctggaagagaatggagaagaagagaagccacctgaagagagacaccgaggaccaggaggaccaggtggaccccagactgatcgacggcaagatgaccagaagaggcgacagcccctggcaggtggtgctgctggacagcaagaagaagctggcctgcggcgccgtgctgatccaccccagctgggtgctgaccgccgcccactgcatggacgagagcaagaagctgctggtgagactgggcgagtacgacctgagaagatgggagaagtgggagctggacctggacatcaaggaggtgttcgtgcaccccaactacagcaagagcaccaccgacaacgacatcgccctgctgcacctggcccagcccgccaccctgagccagaccatcgtgcccatctgcctgcccgacagcggcctggccgagagagagctgaaccaggccggccaggagaccctggtgaccggctggggctaccacagcagcagagagaaggaggccaagagaaacagaaccttcgtgctgaacttcatcaagatccccgtggtgccccacaacgagtgcagcgaggtgatgagcaacatggtgagcgagaacatgctgtgcgccggcatcctgggcgacagacaggacgcctgcgagggcgacagcggcggccccatggtggccagcttccacggcacctggttcctggtgggcctggtgagctggggcgagggctgcggcctgctgcacaactacggcgtgtacaccaaggtgagcagatacctggactggatccacggccacatcagagacaaggaggccccccagaagagctgggccccctag

SEQ ID NO: 85151 - DNA, 405 bp, Artificial Sequence
  Description of Artificial Sequence: Synthetic coding sequence
atgaaggccttcagccccgtgagaagcgtgagaaagaacagcctgagcgaccacagcctgggcatcagcagaagcaagacccccgtggacgaccccatgagcctgctgtacaacatgaacgactgctacagcaagctgaaggagctggtgcccagcatcccccagaacaagaaggtgagcaagatggagatcctgcagcacgtgatcgactacatcctggacctgcagatcgccctggacagccaccccaccatcgtgagcctgcaccaccagagacccggccagaaccaggccagcagaacccccctgaccaccctgaacaccgacatcagcatcctgagcctgcaggccagcgagttccccagcgagctgatgagcaacgacagcaaggccctgtgcggctag

SEQ ID NO: 85152 - DNA, 405 bp, Artificial Sequence; identical to SEQ ID NO: 85151
  Description of Artificial Sequence: Synthetic coding sequence

SEQ ID NO: 85153 - DNA, 360 bp, Artificial Sequence
  Description of Artificial Sequence: Synthetic coding sequence
atgaaggccctgagccccgtgagaggctgctacgaggccgtgtgctgcctgagcgagagaagcctggccatcgccagaggcagaggcaagggccccgccgccgaggagcccctgagcctgctggacgacatgaaccactgctacagcagactgagagagctggtgcccggcgtgcccagaggcacccagctgagccaggtggagatcctgcagagagtgatcgactacatcctggacctgcaggtggtgctggccgagcccgcccccggcccccccgacggcccccacctgcccatccagaccgccgagctgacccccgagctggtgatcagcaacgacaagagaagcttctgccactag

SEQ ID NO: 85154 - DNA, 486 bp, Artificial Sequence
  Description of Artificial Sequence: Synthetic coding sequence
atgaaggccgtgagccccgtgagacccagcggcagaaaggcccccagcggctgcggcggcggcgagctggccctgagatgcctggccgagcacggccacagcctgggcggcagcgccgccgccgccgccgccgccgccgccgccagatgcaaggccgccgaggccgccgccgacgagcccgccctgtgcctgcagtgcgacatgaacgactgctacagcagactgagaagactggtgcccaccatcccccccaacaagaaggtgagcaaggtggagatcctgcagcacgtgatcgactacatcctggacctgcagctggccctggagacccaccccgccctgctgagacagccccccccccccgcccccccccaccaccccgccggcacctgccccgccgccccccccagaacccccctgaccgccctgaacaccgaccccgccggcgccgtgaacaagcagggcgacagcatcctgtgcagatag

SEQ ID NO: 85155 - DNA, 843 bp, Artificial Sequence
  Description of Artificial Sequence: Synthetic coding sequence
atgctgggccagcagcagcagcagctgtacagcagcgccgccctgctgaccggcgagagaagcagactgctgacctgctacgtgcaggactacctggagtgcgtggagagcctgccccacgacatgcagagaaacgtgagcgtgctgagagagctggacaacaagtaccaggagaccctgaaggagatcgacgacgtgtacgagaagtacaagaaggaggacgacctgaaccagaagaagagactgcagcagctgctgcagagagccctgatcaacagccaggagctgggcgacgagaagatccagatcgtgacccagatgctggagctggtggagaacagagccagacagatggagctgcacagccagtgcttccaggaccccgccgagagcgagagagccagcgacaaggccaagatggacagcagccagcccgagagaagcagcagaagacccagaagacagagaaccagcgagagcagagacctgtgccacatggccaacggcatcgaggactgcgacgaccagccccccaaggagaagaagagcaagagcgccaagaagaagaagagaagcaaggccaagcaggagagagaggccagccccgtggagttcgccatcgaccccaacgagcccacctactgcctgtgcaaccaggtgagctacggcgagatgatcggctgcgacaacgagcagtgccccatcgagtggttccacttcagctgcgtgagcctgacctacaagcccaagggcaagtggtactgccccaagtgcagaggcgacaacgagaagaccatggacaagagcaccgagaagaccaagaaggacagaagaagcagatag

SEQ ID NO: 85156 - DNA, 723 bp, Artificial Sequence
  Description of Artificial Sequence: Synthetic coding sequence
atggaccaggacggcgaccagcagctgggccccagcagaatcctggccccccagaccctgaaggagatcgacgacgtgtacgagaagtacaagaaggaggacgacctgaaccagaagaagagactgcagcagctgctgcagagagccctgatcaacagccaggagctgggcgacgagaagatccagatcgtgacccagatgctggagctggtggagaacagagccagacagatggagctgcacagccagtgcttccaggaccccgccgagagcgagagagccagcgacaaggccaagatggacagcagccagcccgagagaagcagcagaagacccagaagacagagaaccagcgagagcagagacctgtgccacatggccaacggcatcgaggactgcgacgaccagccccccaaggagaagaagagcaagagcgccaagaagaagaagagaagcaaggccaagcaggagagagaggccagccccgtggagttcgccatcgaccccaacgagcccacctactgcctgtgcaaccaggtgagctacggcgagatgatcggctgcgacaacgagcagtgccccatcgagtggttccacttcagctgcgtgagcctgacctacaagcccaagggcaagtggtactgccccaagtgcagaggcgacaacgagaagaccatggacaagagcaccgagaagaccaagaaggacagaagaagcagatag

SEQ ID NO: 85157 - DNA, 1257 bp, Artificial Sequence
  Description of Artificial Sequence: Synthetic coding sequence
atgctgtacctggaggactacctggagatgatcgagcagctgcccatggacctgagagacagattcaccgagatgagagagatggacctgcaggtgcagaacgccatggaccagctggagcagagagtgagcgagttcttcatgaacgccaagaagaacaagcccgagtggagagaggagcagatggccagcatcaagaaggactactacaaggccctggaggacgccgacgagaaggtgcagctggccaaccagatctacgacctggtggacagacacctgagaaagctggaccaggagctggccaagttcaagatggagctggaggccgacaacgccggcatcaccgagatcctggagagaagaagcctggagctggacacccccagccagcccgtgaacaaccaccacgcccacagccacacccccgtggagaagagaaagtacaaccccaccagccaccacaccaccaccgaccacatccccgagaagaagttcaagagcgaggccctgctgagcaccctgaccagcgacgccagcaaggagaacaccctgggctgcagaaacaacaacagcaccgccagcagcaacaacgcctacaacgtgaacagcagccagcccctgggcagctacaacatcggcagcctgagcagcggcaccggcgccggcgccatcaccatggccgccgcccaggccgtgcaggccaccgcccagatgaaggagggcagaagaaccagcagcctgaaggccagctacgaggccttcaagaacaacgacttccagctgggcaaggagttcagcatggccagagagaccgtgggctacagcagcagcagcgccctgatgaccaccctgacccagaacgccagcagcagcgccgccgacagcagaagcggcagaaagagcaagaacaacaacaagagcagcagccagcagagcagcagcagcagcagcagcagcagcctgagcagctgcagcagcagcagcaccgtggtgcaggagatcagccagcagaccaccgtggtgcccgagagcgacagcaacagccaggtggactggacctacgaccccaacgagcccagatactgcatctgcaaccaggtgagctacggcgagatggtgggctgcgacaaccaggactgccccatcgagtggttccactacggctgcgtgggcctgaccgaggcccccaagggcaagtggtactgcccccagtgcaccgccgccatgaagagaagaggcagcagacacaagtag

SEQ ID NO: 85158 - DNA, 279 bp, Artificial Sequence
  Description of Artificial Sequence: Synthetic coding sequence
atgctgtacctggaggactacctggagatgatcgagcagctgcccatggacctgagagacagattcaccgagatgagagagatggacctgcaggtgcagaacgccatggaccagctggagcagagagtgagcgagttcttcatgaacgccaagaagaacaagcccgagtggagagaggagcagatggccagcatcaagaaggactactacaaggccctggaggacgccgacgagaaggtgcagctggccaaccagatctacgacctgcagcacttctag

SEQ ID NO: 85159 - DNA, 723 bp, Artificial Sequence
  Description of Artificial Sequence: Synthetic coding sequence
atggccaccgccatgtacctggagcactacctggacagcatcgagaacctgccctgcgagctgcagagaaacttccagctgatgagagagctggaccagagaaccgaggacaagaaggccgagatcgacatcctggccgccgagtacatcagcaccgtgaagaccctgagccccgaccagagagtggagagactgcagaagatccagaacgcctacagcaagtgcaaggagtacagcgacgacaaggtgcagctggccatgcagacctacgagatggtggacaagcacatcagaagactggacgccgacctggccagattcgaggccgacctgaaggacaagatggagggcagcgacttcgagagcagcggcggcagaggcctgaagaagggcagaggccagaaggagaagagaggcagcagaggcagaggcagaagaaccagcgaggaggacacccccaagaagaagaagcacaagggcggcagcgagttcaccgacaccatcctgagcgtgcaccccagcgacgtgctggacatgcccgtggaccccaacgagcccacctactgcctgtgccaccaggtgagctacggcgagatgatcggctgcgacaaccccgactgccccatcgagtggttccacttcgcctgcgtggacctgaccaccaagcccaagggcaagtggttctgccccagatgcgtgcaggagaagagaaagaagaagtag

SEQ ID NO: 85160 - DNA, 681 bp, Artificial Sequence
  Description of Artificial Sequence: Synthetic coding sequence
atggccaccgccatgtacctggagcactacctggacagcatcgagaacctgccctgcgagctgcagagaaacttccagctgatgagagagctggaccagagaaccgaggacaagaaggccgagatcgacatcctggccgccgagtacatcagcaccgtgaagaccctgagccccgaccagagagtggagagactgcagaagatccagaacgcctacagcaagtgcaaggagtacagcgacgacaaggtgcagctggccatgcagacctacgagatggtggacaagcacatcagaagactggacgccgacctggccagattcgaggccgacctgaaggacaagatggagggcagcgacttcgagagcagcggcggcagaggcctgaagaagggcagaggccagaaggagaagagaggcagcagaggcagaggcagaagaaccagcgaggaggacacccccaagaagaagaagcacaagggcggcagcgagttcaccgacaccatcctgagcgtgcaccccagcgacgtgctggacatgcccgtggaccccaacgagcccacctactgcctgtgccaccaggtgagctacggcgagatgatcggctgcgacaaccccgactgccccatcgagtggttccacttcgcctgcgtggacctgaccaccaagcccaagggcaagtag

SEQ ID NO: 85161 - DNA, 2265 bp, Artificial Sequence
  Description of Artificial Sequence: Synthetic coding sequence
atgttcagcggcggctgccacagccccggcttcggcagacccagccccgccttccccgcccccggcagccccccccccgcccccagaccctgcagacaggagaccggcgagcagatcgccatcaagcagtgcagacaggagctgagccccagaaacagagagagatggtgcctggagatccagatcatgagaagactgacccaccccaacgtggtggccgccagagacgtgcccgagggcatgcagaacctggcccccaacgacctgcccctgctggccatggagtactgccagggcggcgacctgagaaagtacctgaaccagttcgagaactgctgcggcctgagagagggcgccatcctgaccctgctgagcgacatcgccagcgccctgagatacctgcacgagaacagaatcatccacagagacctgaagcccgagaacatcgtgctgcagcagggcgagcagagactgatccacaagatcatcgacctgggctacgccaaggagctggaccagggcagcctgtgcaccagcttcgtgggcaccctgcagtacctggcccccgagctgctggagcagcagaagtacaccgtgaccgtggactactggagcttcggcaccctggccttcgagtgcatcaccggcttcagacccttcctgcccaactggcagcccgtgcagtggcacagcaaggtgagacagaagagcgaggtggacatcgtggtgagcgaggacctgaacggcaccgtgaagttcagcagcagcctgccctaccccaacaacctgaacagcgtgctggccgagagactggagaagtggctgcagctgatgctgatgtggcaccccagacagagaggcaccgaccccacctacggccccaacggctgcttcaaggccctggacgacatcctgaacctgaagctggtgcacatcctgaacatggtgaccggcaccatccacacctaccccgtgaccgaggacgagagcctgcagagcctgaaggccagaatccagcaggacaccggcatccccgaggaggaccaggagctgctgcaggaggccggcctggccctgatccccgacaagcccgccacccagtgcatcagcgacggcaagctgaacgagggccacaccctggacatggacctggtgttcctgttcgacaacagcaagatcacctacgagacccagatcagccccagaccccagcccgagagcgtgagctgcatcctgcaggagcccaagagaaacctggccttcttccagctgagaaaggtgtggggccaggtgtggcacagcatccagaccctgaaggaggactgcaacagactgcagcagggccagagagccgccatgatgaacctgctgagaaacaacagctgcctgagcaagatgaagaacagcatggccagcatgagccagcagctgaaggccaagctggacttcttcaagaccagcatccagatcgacctggagaagtacagcgagcagaccgagttcggcatcaccagcgacaagctgctgctggcctggagagagatggagcaggccgtggagctgtgcggcagagagaacgaggtgaagctgctggtggagagaatgatggccctgcagaccgacatcgtggacctgcagagaagccccatgggcagaaagcagggcggcaccctggacgacctggaggagcaggccagagagctgtacagaagactgagagagaagcccagagaccagagaaccgagggcgacagccaggagatggtgagactgctgctgcaggccatccagagcttcgagaagaaggtgagagtgatctacacccagctgagcaagaccgtggtgtgcaagcagaaggccctggagctgctgcccaaggtggaggaggtggtgagcctgatgaacgaggacgagaagaccgtggtgagactgcaggagaagagacagaaggagctgtggaacctgctgaagatcgcctgcagcaaggtgagaggccccgtgagcggcagccccgacagcatgaacgccagcagactgagccagcccggccagctgatgagccagcccagcaccgccagcaacagcctgcccgagcccgccaagaagagcgaggagctggtggccgaggcccacaacctgtgcaccctgctggagaacgccatccaggacaccgtgagagagcaggaccagagcttcaccgccctggactggagctggctgcagaccgaggaggaggagcacagctgcctggagcaggccagctag

SEQ ID NO: 85162 - DNA, 963 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagaagaaagctggcccagctgcaggtggcctaccaccagctgttccaggagtacgacaaccacatcaagagcagcgtggtgggcagcgagagaaagagagccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 85163 - DNA, 1602 bp, Artificial Sequence
  Description of Artificial Sequence: Synthetic coding sequence
atgagcagcgacggcaccatcagacacagcaaggtgagacagaagagcgaggtggacatcgtggtgagcgaggacctgaacggcaccgtgaagttcagcagcagcctgccctaccccaacaacctgaacagcgtgctggccgagagactggagaagtggctgcagctgatgctgatgtggcaccccagacagagaggcaccgaccccacctacggccccaacggctgcttcaaggccctggacgacatcctgaacctgaagctggtgcacatcctgaacatggtgaccggcaccatccacacctaccccgtgaccgaggacgagagcctgcagagcctgaaggccagaatccagcaggacaccggcatccccgaggaggaccaggagctgctgcaggaggccggcctggccctgatccccgacaagcccgccacccagtgcatcagcgacggcaagctgaacgagggccacaccctggacatggacctggtgttcctgttcgacaacagcaagatcacctacgagacccagatcagccccagaccccagcccgagagcgtgagctgcatcctgcaggagcccaagagaaacctggccttcttccagctgagaaaggtgtggggccaggtgtggcacagcatccagaccctgaaggaggactgcaacagactgcagcagggccagagagccgccatgatgaacctgctgagaaacaacagctgcctgagcaagatgaagaacagcatggccagcatgagccagcagctgaaggccaagctggacttcttcaagaccagcatccagatcgacctggagaagtacagcgagcagaccgagttcggcatcaccagcgacaagctgctgctggcctggagagagatggagcaggccgtggagctgtgcggcagagagaacgaggtgaagctgctggtggagagaatgatggccctgcagaccgacatcgtggacctgcagagaagccccatgggcagaaagcagggcggcaccctggacgacctggaggagcaggccagagagctgtacagaagactgagagagaagcccagagaccagagaaccgagggcgacagccaggagatggtgagactgctgctgcaggccatccagagcttcgagaagaaggtgagagtgatctacacccagctgagcaagaccgtggtgtgcaagcagaaggccctggagctgctgcccaaggtggaggaggtggtgagcctgatgaacgaggacgagaagaccgtggtgagactgcaggagaagagacagaaggagctgtggaacctgctgaagatcgcctgcagcaaggtgagaggccccgtgagcggcagccccgacagcatgaacgccagcagactgagccagcccggccagctgatgagccagcccagcaccgccagcaacagcctgcccgagcccgccaagaagagcgaggagctggtggccgaggcccacaacctgtgcaccctgctggagaacgccatccaggacaccgtgagagagcaggaccagagcttcaccgccctggactggagctggctgcagaccgaggaggaggagcacagctgcctggagcaggccagctag

SEQ ID NO: 85164 - DNA, 2094 bp, Artificial Sequence
  Description of Artificial Sequence: Synthetic coding sequence
atgagcagcgacggcaccatcagactgacccaccccaacgtggtggccgccagagacgtgcccgagggcatgcagaacctggcccccaacgacctgcccctgctggccatggagtactgccagggcggcgacctgagaaagtacctgaaccagttcgagaactgctgcggcctgagagagggcgccatcctgaccctgctgagcgacatcgccagcgccctgagatacctgcacgagaacagaatcatccacagagacctgaagcccgagaacatcgtgctgcagcagggcgagcagagactgatccacaagatcatcgacctgggctacgccaaggagctggaccagggcagcctgtgcaccagcttcgtgggcaccctgcagtacctggcccccgagctgctggagcagcagaagtacaccgtgaccgtggactactggagcttcggcaccctggccttcgagtgcatcaccggcttcagacccttcctgcccaactggcagcccgtgcagtggcacagcaaggtgagacagaagagcgaggtggacatcgtggtgagcgaggacctgaacggcaccgtgaagttcagcagcagcctgccctaccccaacaacctgaacagcgtgctggccgagagactggagaagtggctgcagctgatgctgatgtggcaccccagacagagaggcaccgaccccacctacggccccaacggctgcttcaaggccctggacgacatcctgaacctgaagctggtgcacatcctgaacatggtgaccggcaccatccacacctaccccgtgaccgaggacgagagcctgcagagcctgaaggccagaatccagcaggacaccggcatccccgaggaggaccaggagctgctgcaggaggccggcctggccctgatccccgacaagcccgccacccagtgcatcagcgacggcaagctgaacgagggccacaccctggacatggacctggtgttcctgttcgacaacagcaagatcacctacgagacccagatcagccccagaccccagcccgagagcgtgagctgcatcctgcaggagcccaagagaaacctggccttcttccagctgagaaaggtgtggggccaggtgtggcacagcatccagaccctgaaggaggactgcaacagactgcagcagggccagagagccgccatgatgaacctgctgagaaacaacagctgcctgagcaagatgaagaacagcatggccagcatgagccagcagctgaaggccaagctggacttcttcaagaccagcatccagatcgacctggagaagtacagcgagcagaccgagttcggcatcaccagcgacaagctgctgctggcctggagagagatggagcaggccgtggagctgtgcggcagagagaacgaggtgaagctgctggtggagagaatgatggccctgcagaccgacatcgtggacctgcagagaagccccatgggcagaaagcagggcggcaccctggacgacctggaggagcaggccagagagctgtacagaagactgagagagaagcccagagaccagagaaccgagggcgacagccaggagatggtgagactgctgctgcaggccatccagagcttcgagaagaaggtgagagtgatctacacccagctgagcaagaccgtggtgtgcaagcagaaggccctggagctgctgcccaaggtggaggaggtggtgagcctgatgaacgaggacgagaagaccgtggtgagactgcaggagaagagacagaaggagctgtggaacctgctgaagatcgcctgcagcaaggtgagaggccccgtgagcggcagccccgacagcatgaacgccagcagactgagccagcccggccagctgatgagccagcccagcaccgccagcaacagcctgcccgagcccgccaagaagagcgaggagctggtggccgaggcccacaacctgtgcaccctgctggagaacgccatccaggacaccgtgagagagcaggaccagagcttcaccgccctggactggagctggctgcagaccgaggaggaggagcacagctgcctggagcaggccagctag

SEQ ID NO: 85165 - DNA, 2271 bp, Artificial Sequence
  Description of Artificial Sequence: Synthetic coding sequence
atgagctggagccccagcctgaccacccagacctgcggcgcctgggagatgaaggagagactgggcaccggcggcttcggcaacgtgatcagatggcacaaccaggagaccggcgagcagatcgccatcaagcagtgcagacaggagctgagccccagaaacagagagagatggtgcctggagatccagatcatgagaagactgacccaccccaacgtggtggccgccagagacgtgcccgagggcatgcagaacctggcccccaacgacctgcccctgctggccatggagtactgccagggcggcgacctgagaaagtacctgaaccagttcgagaactgctgcggcctgagagagggcgccatcctgaccctgctgagcgacatcgccagcgccctgagatacctgcacgagaacagaatcatccacagagacctgaagcccgagaacatcgtgctgcagcagggcgagcagagactgatccacaagatcatcgacctgggctacgccaaggagctggaccagggcagcctgtgcaccagcttcgtgggcaccctgcagtacctggcccccgagctgctggagcagcagaagtacaccgtgaccgtggactactggagcttcggcaccctggccttcgagtgcatcaccggcttcagacccttcctgcccaactggcagcccgtgcagtggcacagcaaggtgagacagaagagcgaggtggacatcgtggtgagcgaggacctgaacggcaccgtgaagttcagcagcagcctgccctaccccaacaacctgaacagcgtgctggccgagagactggagaagtggctgcagctgatgctgatgtggcaccccagacagagaggcaccgaccccacctacggccccaacggctgcttcaaggccctggacgacatcctgaacctgaagctggtgcacatcctgaacatggtgaccggcaccatccacacctaccccgtgaccgaggacgagagcctgcagagcctgaaggccagaatccagcaggacaccggcatccccgaggaggaccaggagctgctgcaggaggccggcctggccctgatccccgacaagcccgccacccagtgcatcagcgacggcaagctgaacgagggccacaccctggacatggacctggtgttcctgttcgacaacagcaagatcacctacgagacccagatcagccccagaccccagcccgagagcgtgagctgcatcctgcaggagcccaagagaaacctggccttcttccagctgagaaaggtgtggggccaggtgtggcacagcatccagaccctgaaggaggactgcaacagactgcagcagggccagagagccgccatgatgaacctgctgagaaacaacagctgcctgagcaagatgaagaacagcatggccagcatgagccagcagctgaaggccaagctggacttcttcaagaccagcatccagatcgacctggagaagtacagcgagcagaccgagttcggcatcaccagcgacaagctgctgctggcctggagagagatggagcaggccgtggagctgtgcggcagagagaacgaggtgaagctgctggtggagagaatgatggccctgcagaccgacatcgtggacctgcagagaagccccatgggcagaaagcagggcggcaccctggacgacctggaggagcaggccagagagctgtacagaagactgagagagaagcccagagaccagagaaccgagggcgacagccaggagatggtgagactgctgctgcaggccatccagagcttcgagaagaaggtgagagtgatctacacccagctgagcaagaccgtggtgtgcaagcagaaggccctggagctgctgcccaaggtggaggaggtggtgagcctgatgaacgaggacgagaagaccgtggtgagactgcaggagaagagacagaaggagctgtggaacctgctgaagatcgcctgcagcaaggtgagaggccccgtgagcggcagccccgacagcatgaacgccagcagactgagccagcccggccagctgatgagccagcccagcaccgccagcaacagcctgcccgagcccgccaagaagagcgaggagctggtggccgaggcccacaacctgtgcaccctgctggagaacgccatccaggacaccgtgagagagcaggaccagagcttcaccgccctggactggagctggctgcagaccgaggaggaggagcacagctgcctggagcaggccagctag

SEQ ID NO: 85166 - DNA, 3999 bp, Artificial Sequence
  Description of Artificial Sequence: Synthetic coding sequence
atgagaaacctgaagctgttcagaaccctggagttcagagacatccagggccccggcaacccccagtgcttcagcctgagaaccgagcagggcaccgtgctgatcggcagcgagcacggcctgatcgaggtggaccccgtgagcagagaggtgaagaacgaggtgagcctggtggccgagggcttcctgcccgaggacggcagcggcagaatcgtgggcgtgcaggacctgctggaccaggagagcgtgtgcgtggccaccgccagcggcgacgtgatcctgtgcagcctgagcacccagcagctggagtgcgtgggcagcgtggccagcggcatcagcgtgatgagctggagccccgaccaggagctggtgctgctggccaccggccagcagaccctgatcatgatgaccaaggacttcgagcccatcctggagcagcagatccaccaggacgacttcggcgagagcaagttcatcaccgtgggctggggcagaaaggagacccagttccacggcagcgagggcagacaggccgccttccagatgcagatgcacgagagcgccctgccctgggacgaccacagaccccaggtgacctggagaggcgacggccagttcttcgccgtgagcgtggtgtgccccgagaccggcgccagaaaggtgagagtgtggaacagagagttcgccctgcagagcaccagcgagcccgtggccggcctgggccccgccctggcctggaagcccagcggcagcctgatcgccagcacccaggacaagcccaaccagcaggacatcgtgttcttcgagaagaacggcctgctgcacggccacttcaccctgcccttcctgaaggacgaggtgaaggtgaacgacctgctgtggaacgccgacagcagcgtgctggccgtgtggctggaggacctgcagagagaggagagcagcatccccaagacctgcgtgcagctgtggaccgtgggcaactaccactggtacctgaagcagagcctgagcttcagcacctgcggcaagagcaagatcgtgagcctgatgtgggaccccgtgaccccctacagactgcacgtgctgtgccagggctggcactacctggcctacgactggcactggaccaccgacagaagcgtgggcgacaacagcagcgacctgagcaacgtggccgtgatcgacggcaacagagtgctggtgaccgtgttcagacagaccgtggtgcccccccccatgtgcacctaccagctgctgttcccccaccccgtgaaccaggtgaccttcctggcccacccccagaagagcaacgacctggccgtgctggacgccagcaaccagatcagcgtgtacaagtgcggcgactgccccagcgccgaccccaccgtgaagctgggcgccgtgggcggcagcggcttcaaggtgtgcctgagaaccccccacctggagaagagatacaagatccagttcgagaacaacgaggaccaggacgtgaaccccctgaagctgggcctgctgacctggatcgaggaggacgtgttcctggccgtgagccacagcgagttcagccccagaagcgtgatccaccacctgaccgccgccagcagcgagatggacgaggagcacggccagctgaacgtgagcagcagcgccgccgtggacggcgtgatcatcagcctgtgctgcaacagcaagaccaagagcgtggtgctgcagctggccgacggccagatcttcaagtacctgtgggagagccccagcctggccatcaagccctggaagaacagcggcggcttccccgtgagattcccctacccctgcacccagaccgagctggccatgatcggcgaggaggagtgcgtgctgggcctgaccgacagatgcagattcttcatcaacgacatcgaggtggccagcaacatcaccagcttcgccgtgtacgacgagttcctgctgctgaccacccacagccacacctgccagtgcttctgcctgagagacgccagcttcaagaccctgcaggccggcctgagcagcaaccacgtgagccacggcgaggtgctgagaaaggtggagagaggcagcagaatcgtgaccgtggtgccccaggacaccaagctggtgctgcagatgcccagaggcaacctggaggtggtgcaccacagagccctggtgctggcccagatcagaaagtggctggacaagctgatgttcaaggaggccttcgagtgcatgagaaagctgagaatcaacctgaacctgatctacgaccacaaccccaaggtgttcctgggcaacgtggagaccttcatcaagcagatcgacagcgtgaaccacatcaacctgttcttcaccgagctgaaggaggaggacgtgaccaagaccatgtaccccgcccccgtgaccagcagcgtgtacctgagcagagaccccgacggcaacaagatcgacctggtgtgcgacgccatgagagccgtgatggagagcatcaacccccacaagtactgcctgagcatcctgaccagccacgtgaagaagaccacccccgagctggagatcgtgctgcagaaggtgcacgagctgcagggcaacgcccccagcgaccccgacgccgtgagcgccgaggaggccctgaagtacctgctgcacctggtggacgtgaacgagctgtacgaccacagcctgggcacctacgacttcgacctggtgctgatggtggccgagaagagccagaaggaccccaaggagtacctgcccttcctgaacaccctgaagaagatggagaccaactaccagagattcaccatcgacaagtacctgaagagatacgagaaggccatcggccacctgagcaagtgcggccccgagtacttccccgagtgcctgaacctgatcaaggacaagaacctgtacaacgaggccctgaagctgtacagccccagcagccagcagtaccaggacatcagcatcgcctacggcgagcacctgatgcaggagcacatgtacgagcccgccggcctgatgttcgccagatgcggcgcccacgagaaggccctgagcgccttcctgacctgcggcaactggaagcaggccctgtgcgtggccgcccagctgaacttcaccaaggaccagctggtgggcctgggcagaaccctggccggcaagctggtggagcagagaaagcacatcgacgccgccatggtgctggaggagtgcgcccaggactacgaggaggccgtgctgctgctgctggagggcgccgcctgggaggaggccctgagactggtgtacaagtacaacagactggacatcatcgagaccaacgtgaagcccagcatcctggaggcccagaagaactacatggccttcctggacagccagaccgccaccttcagcagacacaagaagagactgctggtggtgagagagctgaaggagcaggcccagcaggccggcctggacgacgaggtgccccacggccaggagagcgacctgttcagcgagaccagcagcgtggtgagcggcagcgagatgagcggcaagtacagccacagcaacagcagaatcagcgccagaagcagcaagaacagaagaaaggccgagagaaagaagcacagcctgaaggagggcagccccctggaggacctggccctgctggaggccctgagcgaggtggtgcagaacaccgagaacctgaaggacgaggtgtaccacatcctgaaggtgctgttcctgttcgagttcgacgagcagggcagagagctgcagaaggccttcgaggacaccctgcagctgatggagagaagcctgcccgagatctggaccctgacctaccagcagaacagcgccacccccgtgctgggccccaacagcaccgccaacagcatcatggccagctaccagcagcagaagaccagcgtgcccgtgctggacgccgagctgttcatcccccccaagatcaacagaagaacccagtggaagctgagcctgctggactag

SEQ ID NO: 85167 - DNA, 2952 bp, Artificial Sequence
  Description of Artificial Sequence: Synthetic coding sequence
atgtgggaccccgtgaccccctacagactgcacgtgctgtgccagggctggcactacctggcctacgactggcactggaccaccgacagaagcgtgggcgacaacagcagcgacctgagcaacgtggccgtgatcgacggcaacagagtgctggtgaccgtgttcagacagaccgtggtgcccccccccatgtgcacctaccagctgctgttcccccaccccgtgaaccaggtgaccttcctggcccacccccagaagagcaacgacctggccgtgctggacgccagcaaccagatcagcgtgtacaagtgcggcgactgccccagcgccgaccccaccgtgaagctgggcgccgtgggcggcagcggcttcaaggtgtgcctgagaaccccccacctggagaagagatacaagatccagttcgagaacaacgaggaccaggacgtgaaccccctgaagctgggcctgctgacctggatcgaggaggacgtgttcctggccgtgagccacagcgagttcagccccagaagcgtgatccaccacctgaccgccgccagcagcgagatggacgaggagcacggccagctgaacgtgagcagcagcgccgccgtggacggcgtgatcatcagcctgtgctgcaacagcaagaccaagagcgtggtgctgcagctggccgacggccagatcttcaagtacctgtgggagagccccagcctggccatcaagccctggaagaacagcggcggcttccccgtgagattcccctacccctgcacccagaccgagctggccatgatcggcgaggaggagtgcgtgctgggcctgaccgacagatgcagattcttcatcaacgacatcgaggtggccagcaacatcaccagcttcgccgtgtacgacgagttcctgctgctgaccacccacagccacacctgccagtgcttctgcctgagagacgccagcttcaagaccctgcaggccggcctgagcagcaaccacgtgagccacggcgaggtgctgagaaaggtggagagaggcagcagaatcgtgaccgtggtgccccaggacaccaagctggtgctgcagatgcccagaggcaacctggaggtggtgcaccacagagccctggtgctggcccagatcagaaagtggctggacaagctgatgttcaaggaggccttcgagtgcatgagaaagctgagaatcaacctgaacctgatctacgaccacaaccccaaggtgttcctgggcaacgtggagaccttcatcaagcagatcgacagcgtgaaccacatcaacctgttcttcaccgagctgaaggaggaggacgtgaccaagaccatgtaccccgcccccgtgaccagcagcgtgtacctgagcagagaccccgacggcaacaagatcgacctggtgtgcgacgccatgagagccgtgatggagagcatcaacccccacaagtactgcctgagcatcctgaccagccacgtgaagaagaccacccccgagctggagatcgtgctgcagaaggtgcacgagctgcagggcaacgcccccagcgaccccgacgccgtgagcgccgaggaggccctgaagtacctgctgcacctggtggacgtgaacgagctgtacgaccacagcctgggcacctacgacttcgacctggtgctgatggtggccgagaagagccagaaggaccccaaggagtacctgcccttcctgaacaccctgaagaagatggagaccaactaccagagattcaccatcgacaagtacctgaagagatacgagaaggccatcggccacctgagcaagtgcggccccgagtacttccccgagtgcctgaacctgatcaaggacaagaacctgtacaacgaggccctgaagctgtacagccccagcagccagcagtaccaggacatcagcatcgcctacggcgagcacctgatgcaggagcacatgtacgagcccgccggcctgatgttcgccagatgcggcgcccacgagaaggccctgagcgccttcctgacctgcggcaactggaagcaggccctgtgcgtggccgcccagctgaacttcaccaaggaccagctggtgggcctgggcagaaccctggccggcaagctggtggagcagagaaagcacatcgacgccgccatggtgctggaggagtgcgcccaggactacgaggaggccgtgctgctgctgctggagggcgccgcctgggaggaggccctgagactggtgtacaagtacaacagactggacatcatcgagaccaacgtgaagcccagcatcctggaggcccagaagaactacatggccttcctggacagccagaccgccaccttcagcagacacaagaagagactgctggtggtgagagagctgaaggagcaggcccagcaggccggcctggacgacgaggtgccccacggccaggagagcgacctgttcagcgagaccagcagcgtggtgagcggcagcgagatgagcggcaagtacagccacagcaacagcagaatcagcgccagaagcagcaagaacagaagaaaggccgagagaaagaagcacagcctgaaggagggcagccccctggaggacctggccctgctggaggccctgagcgaggtggtgcagaacaccgagaacctgaaggacgaggtgtaccacatcctgaaggtgctgttcctgttcgagttcgacgagcagggcagagagctgcagaaggccttcgaggacaccctgcagctgatggagagaagcctgcccgagatctggaccctgacctaccagcagaacagcgccacccccgtgctgggccccaacagcaccgccaacagcatcatggccagctaccagcagcagaagaccagcgtgcccgtgctggacgccgagctgttcatcccccccaagatcaacagaagaacccagtggaagctgagcctgctggactag

SEQ ID NO: 85168 - DNA, 2151 bp, Artificial Sequence
  Description of Artificial Sequence: Synthetic coding sequence
atgcagagcaccgccaactacctgtggcacaccgacgacctgctgggccagggcgccaccgccagcgtgtacaaggccagaaacaagaagagcggcgagctggtggccgtgaaggtgttcaacaccaccagctacctgagacccagagaggtgcaggtgagagagttcgaggtgctgagaaagctgaaccaccagaacatcgtgaagctgttcgccgtggaggagaccggcggcagcagacagaaggtgctggtgatggagtactgcagcagcggcagcctgctgagcgtgctggagagccccgagaacgccttcggcctgcccgaggacgagttcctggtggtgctgagatgcgtggtggccggcatgaaccacctgagagagaacggcatcgtgcacagagacatcaagcccggcaacatcatgagactggtgggcgaggagggccagagcatctacaagctgaccgacttcggcgccgccagagagctggacgacgacgagaagttcgtgagcgtgtacggcaccgaggagtacctgcaccccgacatgtacgagagagccgtgctgagaaagccccagcagaaggccttcggcgtgaccgtggacctgtggagcatcggcgtgaccctgtaccacgccgccaccggcagcctgcccttcatccccttcggcggccccagaagaaacaaggagatcatgtacagaatcaccaccgagaagcccgccggcgccatcgccggcgcccagagaagagagaacggccccctggagtggagctacaccctgcccatcacctgccagctgagcctgggcctgcagagccagctggtgcccatcctggccaacatcctggaggtggagcaggccaagtgctggggcttcgaccagttcttcgccgagaccagcgacatcctgcagagagtggtggtgcacgtgttcagcctgagccaggccgtgctgcaccacatctacatccacgcccacaacaccatcgccatcttccaggaggccgtgcacaagcagaccagcgtggcccccagacaccaggagtacctgttcgagggccacctgtgcgtgctggagcccagcgtgagcgcccagcacatcgcccacaccaccgccagcagccccctgaccctgttcagcaccgccatccccaagggcctggccttcagagaccccgccctggacgtgcccaagttcgtgcccaaggtggacctgcaggccgactacaacaccgccaagggcgtgctgggcgccggctaccaggccctgagactggccagagccctgctggacggccaggagctgatgttcagaggcctgcactgggtgatggaggtgctgcaggccacctgcagaagaaccctggaggtggccagaaccagcctgctgtacctgagcagcagcctgggcaccgagagattcagcagcgtggccggcacccccgagatccaggagctgaaggccgccgccgagctgagaagcagactgagaaccctggccgaggtgctgagcagatgcagccagaacatcaccgagacccaggagagcctgagcagcctgaacagagagctggtgaagagcagagaccaggtgcacgaggacagaagcatccagcagatccagtgctgcctggacaagatgaacttcatctacaagcagttcaagaagagcagaatgagacccggcctgggctacaacgaggagcagatccacaagctggacaaggtgaacttcagccacctggccaagagactgctgcaggtgttccaggaggagtgcgtgcagaagtaccaggccagcctggtgacccacggcaagagaatgagagtggtgcacgagaccagaaaccacctgagactggtgggctgcagcgtggccgcctgcaacaccgaggcccagggcgtgcaggagagcctgagcaagctgctggaggagctgagccaccagctgctgcaggacagagccaagggcgcccaggccagccccccccccatcgccccctaccccagccccaccagaaaggacctgctgctgcacatgcaggagctgtgcgagggcatgaagctgctggccagcgacctgctggacaacaacagaatcatcgagagactgaacagagtgcccgccccccccgacgtgtag

SEQ ID NO: 85169 - DNA, 1896 bp, Artificial Sequence
  Description of Artificial Sequence: Synthetic coding sequence
atggagtactgcagcagcggcagcctgctgagcgtgctggagagccccgagaacgccttcggcctgcccgaggacgagttcctggtggtgctgagatgcgtggtggccggcatgaaccacctgagagagaacggcatcgtgcacagagacatcaagcccggcaacatcatgagactggtgggcgaggagggccagagcatctacaagctgaccgacttcggcgccgccagagagctggacgacgacgagaagttcgtgagcgtgtacggcaccgaggagtacctgcaccccgacatgtacgagagagccgtgctgagaaagccccagcagaaggccttcggcgtgaccgtggacctgtggagcatcggcgtgaccctgtaccacgccgccaccggcagcctgcccttcatccccttcggcggccccagaagaaacaaggagatcatgtacagaatcaccaccgagaagcccgccggcgccatcgccggcgcccagagaagagagaacggccccctggagtggagctacaccctgcccatcacctgccagctgagcctgggcctgcagagccagctggtgcccatcctggccaacatcctggaggtggagcaggccaagtgctggggcttcgaccagttcttcgccgagaccagcgacatcctgcagagagtggtggtgcacgtgttcagcctgagccaggccgtgctgcaccacatctacatccacgcccacaacaccatcgccatcttccaggaggccgtgcacaagcagaccagcgtggcccccagacaccaggagtacctgttcgagggccacctgtgcgtgctggagcccagcgtgagcgcccagcacatcgcccacaccaccgccagcagccccctgaccctgttcagcaccgccatccccaagggcctggccttcagagaccccgccctggacgtgcccaagttcgtgcccaaggtggacctgcaggccgactacaacaccgccaagggcgtgctgggcgccggctaccaggccctgagactggccagagccctgctggacggccaggagctgatgttcagaggcctgcactgggtgatggaggtgctgcaggccacctgcagaagaaccctggaggtggccagaaccagcctgctgtacctgagcagcagcctgggcaccgagagattcagcagcgtggccggcacccccgagatccaggagctgaaggccgccgccgagctgagaagcagactgagaaccctggccgaggtgctgagcagatgcagccagaacatcaccgagacccaggagagcctgagcagcctgaacagagagctggtgaagagcagagaccaggtgcacgaggacagaagcatccagcagatccagtgctgcctggacaagatgaacttcatctacaagcagttcaagaagagcagaatgagacccggcctgggctacaacgaggagcagatccacaagctggacaaggtgaacttcagccacctggccaagagactgctgcaggtgttccaggaggagtgcgtgcagaagtaccaggccagcctggtgacccacggcaagagaatgagagtggtgcacgagaccagaaaccacctgagactggtgggctgcagcgtggccgcctgcaacaccgaggcccagggcgtgcaggagagcctgagcaagctgctggaggagctgagccaccagctgctgcaggacagagccaagggcgcccaggccagccccccccccatcgccccctaccccagccccaccagaaaggacctgctgctgcacatgcaggagctgtgcgagggcatgaagctgctggccagcgacctgctggacaacaacagaatcatcgagagactgaacagagtgcccgccccccccgacgtgtag

SEQ ID NO: 85170 - DNA, 1107 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagaagaaagctggcccagctgcaggtggcctaccaccagctgttccaggagtacgacaaccacatcaagagcagcgtggtgggcagcgagagaaagagaggcatgcagctggaggacctgaagcagcagctgcagcaggccgaggaggccctggtggccaagcaggaggtgatcgacaagctgaaggaggaggccgagcagcacaagatcgtgatggagaccgtgcccgtgctgaaggcccaggccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 85171 - DNA, 1260 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggccagagcgtggaggccgccctgagaatggagagacaggccgccagcgaggagaagagaaagctggcccagctgcaggtggcctaccaccagctgttccaggagtacgacaaccacatcaagagcagcgtggtgggcagcgagagaaagagaggcatgcagctggaggacctgaagcagcagctgcagcaggccgaggaggccctggtggccaagcaggaggtgatcgacaagctgaaggaggaggccgagcagcacaagatcgtgatggagaccgtgcccgtgctgaaggcccaggccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 85172 - DNA, 1260 bp, Artificial Sequence; identical to SEQ ID NO: 85171
  Description of Artificial Sequence: Synthetic coding sequence

SEQ ID NO: 85173 - DNA, 1260 bp, Artificial Sequence; identical to SEQ ID NO: 85171
  Description of Artificial Sequence: Synthetic coding sequence

SEQ ID NO: 85174 - DNA, 1464 bp, Artificial Sequence
  Description of Artificial Sequence: Synthetic coding sequence
atggccctggtgatccaggtgggcaagctgagacccagagaggtgagaaccccccagaccatcaaccccagcctgttccccagcctgcccgtgaagctgagcagcatcatcgaggtgcccagcggcggcgagagatgctgcagcagaagaaccctggtgtacaaggccagagccttctggaagggcgcccccctgccctgctggatgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggccagagcgtggaggccgccctgagaatggagagacaggccgccagcgaggagaagagaaagctggcccagctgcaggtggcctaccaccagctgttccaggagtacgacaaccacatcaagagcagcgtggtgggcagcgagagaaagagaggcatgcagctggaggacctgaagcagcagctgcagcaggccgaggaggccctggtggccaagcaggaggtgatcgacaagctgaaggaggaggccgagcagcacaagatcgtgatggagaccgtgcccgtgctgaaggcccaggccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 85175 - DNA, 621 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggctag

SEQ ID NO: 85176 - DNA, 756 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggccagagcgtggaggccgccctgagaatggagagacaggccgccagcgaggagaagagaaagctggcccagctgcaggtggcctaccaccagctgttccaggagtacgacaaccacatcaagagcagcgtggtgggctag

SEQ ID NO: 85177 - DNA, 417 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagcagatggccgaggactag

SEQ ID NO: 85178 - DNA, 1257 bp, Artificial Sequence
  Description of Artificial Sequence: Synthetic coding sequence
atgaacagacacctgtggaagagccagctgtgcgagatggtgcagcccagcggcggccccgccgccgaccaggacgtgctgggcgaggagagccccctgggcaagcccgccatgctgcacctgcccagcgagcagggcgcccccgagaccctgcagagatgcctggaggagaaccaggagctgagagacgccatcagacagagcaaccagatcctgagagagagatgcgaggagctgctgcacttccaggccagccagagagaggagaaggagttcctgatgtgcaagttccaggaggccagaaagctggtggagagactgggcctggagaagctggacctgaagagacagaaggagcaggccctgagagaggtggagcacctgaagagatgccagcagatggccgaggacaaggccagcgtgaaggcccaggtgaccagcctgctgggcgagctgcaggagagccagagcagactggaggccgccaccaaggagtgccaggccctggagggcagagccagagccgccagcgagcaggccagacagctggagagcgagagagaggccctgcagcagcagcacagcgtgcaggtggaccagctgagaatgcagggccagagcgtggaggccgccctgagaatggagagacaggccgccagcgaggagaagagaaagctggcccagctgcaggtggcctaccaccagctgttccaggagtacgacaaccacatcaagagcagcgtggtgggcagcgagagaaagagaggcatgcagctggaggacctgaagcagcagctgcagcaggccgaggaggccctggtggccaagcaggaggtgatcgacaagctgaaggaggaggccgagcagcacaagatcgtgatggagaccgtgcccgtgctgaaggcccaggccgacatctacaaggccgacttccaggccgagagacaggccagagagaagctggccgagaagaaggagctgctgcaggagcagctggagcagctgcagagagagtacagcaagctgaaggccagctgccaggagagcgccagaatcgaggacatgagaaagagacacgtggaggtgagccaggcccccctgccccccgcccccgcctacctgagcagccccctggccctgcccagccagagaagaagcccccccgaggagccccccgacttctgctgccccaagtgccagtaccaggcccccgacatggacaccctgcagatccacgtgatggagtgcatcgagtag

SEQ ID NO: 85179 - DNA, 2181 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgcccccaccgaggccgcccagatcatcagcgccgccggcgacaccctgagcgtgcccgcccccgccgtgcagcccgaggagagcctgaagaccgaccaccccgagatcggcgagggcaagcccacccccgccctgagcgccctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgaagaaggtgcaggccgcccagagcgaggccaaggtggtgagccagtaccacgagctggtggtgcaggccagagacgacttcaagagagagctggacagcatcacccccgaggtgctgcccggctggaagggcatgagcgagtacaacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85180 - DNA, 1119 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgccggcgacaccctgagcgtgcccgcccccgccgtgcagcccgaggagagcctgaagaccgaccaccccgagatcggcgagggcaagcccacccccgccctgagcgaggccagcagcagcagcatcagagagagaccccccgaggaggtggccgccagactggcccagcaggagaagcaggagcaggtgaagatcgagagcctggccaagagcctggaggacgccctgagacagaccgccagcgtgaccctgcaggccatcgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85181 - DNA, 1980 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgccctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgcaggccagagacgacttcaagagagagctggacagcatcacccccgaggtgctgcccggctggaagggcatgagcgtgagcgacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85182 - DNA, 2277 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgcccccaccgaggccgcccagatcatcagcgccgccggcgacaccctgagcgtgcccgcccccgccgtgcagcccgaggagagcctgaagaccgaccaccccgagatcggcgagggcaagcccacccccgccctgagcgaggaggccagcagcagcagcatcagagagagaccccccgaggaggtggccgccagactggcccagcaggagaagcaggagcaggtgaagatcgagagcctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgaagaaggtgcaggccgcccagagcgaggccaaggtggtgagccagtaccacgagctggtggtgcaggccagagacgacttcaagagagagctggacagcatcacccccgaggtgctgcccggctggaagggcatgagcgtgagcgacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85183 - DNA, 2274 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgcccccaccgaggccgcccagatcatcagcgccgccggcgacaccctgagcgtgcccgcccccgccgtgcagcccgaggagagcctgaagaccgaccaccccgagatcggcgagggcaagcccacccccgccctgagcgaggccagcagcagcagcatcagagagagaccccccgaggaggtggccgccagactggcccagcaggagaagcaggagcaggtgaagatcgagagcctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgaagaaggtgcaggccgcccagagcgaggccaaggtggtgagccagtaccacgagctggtggtgcaggccagagacgacttcaagagagagctggacagcatcacccccgaggtgctgcccggctggaagggcatgagcgtgagcgacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85184 - DNA, 2244 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgccggcgacaccctgagcgtgcccgcccccgccgtgcagcccgaggagagcctgaagaccgaccaccccgagatcggcgagggcaagcccacccccgccctgagcgaggaggccagcagcagcagcatcagagagagaccccccgaggaggtggccgccagactggcccagcaggagaagcaggagcaggtgaagatcgagagcctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgaagaaggtgcaggccgcccagagcgaggccaaggtggtgagccagtaccacgagctggtggtgcaggccagagacgacttcaagagagagctggacagcatcacccccgaggtgctgcccggctggaagggcatgagcgtgagcgacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85185 - DNA, 2244 bp, Artificial Sequence
  Description of Artificial Sequence: Synthetic coding sequence
atgctgagagcctgccagctgagcggcgtgaccgccgccgcccagagctgcctgtgcggcaagttcgtgctgagacccctgagaccctgcagaagatacagcaccagcggcagcagcggcctgaccaccggcaagatcgccggcgccggcctgctgttcgtgggcggcggcatcggcggcaccatcctgtacgccaagtgggacagccacttcagagagagcgtggagaagaccatcccctacagcgacaagctgttcgagatggtgctgggccccgccgcctacaacgtgcccctgcccaagaagagcatccagagcggccccctgaagatcagcagcgtgagcgaggtgatgaaggagagcaagcagcccgccagccagctgcagaagcagaagggcgacacccccgccagcgccaccgccggcgacaccctgagcgtgcccgcccccgccgtgcagcccgaggagagcctgaagaccgaccaccccgagatcggcgagggcaagcccacccccgccctgagcgaggaggccagcagcagcagcatcagagagagaccccccgaggaggtggccgccagactggcccagcaggagaagcaggagcaggtgaagatcgagagcctggccaagagcctggaggacgccctgagacagaccgccagcgtgaccctgcaggccatcgccgcccagaacgccgccgtgcaggccgtgaacgcccacagcaacatcctgaaggccgccatggacaacagcgagatcgccggcgagaagaagagcgcccagtggagaaccgtggagggcgccctgaaggagagaagaaaggccgtggacgaggccgccgacgccctgctgaaggccaaggaggagctggagaagatgaagagcgtgatcgagaacgccaagaagaaggaggtggccggcgccaagccccacatcaccgccgccgagggcaagctgcacaacatgatcgtggacctggacaacgtggtgaagaaggtgcaggccgcccagagcgaggccaaggtggtgagccagtaccacgagctggtggtgcaggccagagacgacttcaagagagagctggacagcatcacccccgaggtgctgcccggctggaagggcatgagcgagtacaacctggccgacaagctgagcaccgacgacctgaacagcctgatcgcccacgcccacagaagaatcgaccagctgaacagagagctggccgagcagaaggccaccgagaagcagcacatcaccctggccctggagaagcagaagctggaggagaagagagccttcgacagcgccgtggccaaggccctggagcaccacagaagcgagatccaggccgagcaggacagaaagatcgaggaggtgagagacgccatggagaacgagatgagaacccagctgagaagacaggccgccgcccacaccgaccacctgagagacgtgctgagagtgcaggagcaggagctgaagagcgagttcgagcagaacctgagcgagaagctgagcgagcaggagctgcagttcagaagactgagccaggagcaggtggacaacttcaccctggacatcaacaccgcctacgccagactgagaggcatcgagcaggccgtgcagagccacgccgtggccgaggaggaggccagaaaggcccaccagctgtggctgagcgtggaggccctgaagtacagcatgaagaccagcagcgccgagacccccaccatccccctgggcagcgccgtggaggccatcaaggccaactgcagcgacaacgagttcacccaggccctgaccgccgccatcccccccgagagcctgaccagaggcgtgtacagcgaggagaccctgagagccagattctacgccgtgcagaagctggccagaagagtggccatgatcgacgagaccagaaacagcctgtaccagtacttcctgagctacctgcagagcctgctgctgttccccccccagcagctgaagcccccccccgagctgtgccccgaggacatcaacaccttcaagctgctgagctacgccagctactgcatcgagcacggcgacctggagctggccgccaagttcgtgaaccagctgaagggcgagagcagaagagtggcccaggactggctgaaggaggccagaatgaccctggagaccaagcagatcgtggagatcctgaccgcctacgccagcgccgtgggcatcggcaccacccaggtgcagcccgagtag

SEQ ID NO: 85186 - DNA, 579 bp, Artificial Sequence
  Description of Artificial Sequence: Synthetic coding sequence
atggacagagcccacagactgggccagaccaagcaggtgaccgtgtacagactgatctgcaagggcaccatcgaggagagaatcctgcagagagccaaggagaagagcgagatccagagaatggtgatcagcggcggcaacttcaagcccgacaccctgaagcccaaggaggtggtgagcctgctgctggacgacgaggagctggagaagaagctgagactgagacaggaggagaagagacagcaggaggagaccaacagagtgaaggagagaaagagaaagagagagaagtacgccgagaagaagaagaaggaggacgagctggacggcaagagaagaaaggagggcgtgaacctggtgatccccttcgtgcccagcgccgacaacagcaacctgagcgccgacggcgacgacagcttcatcagcgtggacagcgccatgcccagccccttcagcgagatcagcatcagcagcgagctgcacaccggcagcatccccctggacgagagcagcagcctggcccccgacagcctggtgagaaagcagggcaagggcaccaaccccagcggcggcagatag

SEQ ID NO: 85187 - DNA, 4671 bp, Artificial Sequence
  Description of Artificial Sequence: Synthetic coding sequence
atggccagcgagctgggcgccagagacgacggcggctgcaccgagctggccaagcccctgtacctgcagtacctggagagagccctgagactggaccacttcctgagacagaccagcgccatcttcaacagaaacatcagcagcgacgacagcgaggacggcctggacgacagcaaccccctgctgccccagagcggcgaccccctgatccaggtgaaggaggagccccccaacagcctgctgggcgagaccagcggcgccggcagcagcggcatgctgaacacctacagcctgaacggcgtgctgcagagcgagagcaagtgcgacaagggcaacctgtacaacttcagcaagctgaagaagagcagaaagtggctgaagagcatcctgctgagcgacgagagcagcgaggccgacagccagagcgaggacgacgacgaggaggagctgaacctgagcagagaggagctgcacaacatgctgagactgcacaagtacaagaagctgcaccagaacaagtacagcaaggacaaggagctgcagcagtaccagtactacagcgccggcctgctgagcacctacgaccccttctacgagcagcagagacacctgctgggccccaagaagaagaagttcaaggaggagaagaagctgaaggccaagctgaagaaggtgaagaagaagagaagaagagacgaggagctgagcagcgaggagagccccagaagacaccaccaccagaccaaggtgttcgccaagttcagccacgacgcccccccccccggcaccaagaagaagcacctgagcatcgagcagctgaacgccagaagaagaaaggtgtggctgagcatcgtgaagaaggagctgcccaaggccaacaagcagaaggccagcgccagaaacctgttcctgaccaacagcagaaagctggcccaccagtgcatgaaggaggtgagaagagccgccctgcaggcccagaagaactgcaaggagaccctgcccagagccagaagactgaccaaggagatgctgctgtactggaagaagtacgagaaggtggagaaggagcacagaaagagagccgagaaggaggccctggagcagagaaagctggacgaggagatgagagaggccaagagacagcagagaaagctgaacttcctgatcacccagaccgagctgtacgcccacttcatgagcagaaagagagacatgggccacgacggcatccaggaggagatcctgagaaagctggaggacagcagcacccagagacagatcgacatcggcggcggcgtggtggtgaacatcacccaggaggactacgacagcaaccacttcaaggcccaggccctgaagaacgccgagaacgcctaccacatccaccaggccagaaccagaagcttcgacgaggacgccaaggagagcagagccgccgccctgagagccgccaacaagagcggcaccggcttcggcgagagctacagcctggccaaccccagcatcagagccggcgaggacatcccccagcccaccatcttcaacggcaagctgaagggctaccagctgaagggcatgaactggctggccaacctgtacgagcagggcatcaacggcatcctggccgacgagatgggcctgggcaagaccgtgcagagcatcgccctgctggcccacctggccgagagagagaacatctggggccccttcctgatcatcagccccgccagcaccctgaacaactggcaccaggagttcaccagattcgtgcccaagttcaaggtgctgccctactggggcaacccccacgacagaaaggtgatcagaagattctggagccagaagaccctgtacacccaggacgcccccttccacgtggtgatcaccagctaccagctggtggtgcaggacgtgaagtacttccagagagtgaagtggcagtacatggtgctggacgaggcccaggccctgaagagcagcagcagcgtgagatggaagatcctgctgcagttccagtgcagaaacagactgctgctgaccggcacccccatccagaacaccatggccgagctgtgggccctgctgcacttcatcatgcccaccctgttcgacagccacgaggagttcaacgagtggttcagcaaggacatcgagagccacgccgagaacaagagcgccatcgacgagaaccagctgagcagactgcacatgatcctgaagcccttcatgctgagaagaatcaagaaggacgtggagaacgagctgagcgacaagatcgagatcctgatgtactgccagctgaccagcagacagaagctgctgtaccaggccctgaagaacaagatcagcatcgaggacctgctgcagagcagcatgggcagcacccagcaggcccagaacaccaccagcagcctgatgaacctggtgatgcagttcagaaaggtgtgcaaccaccccgagctgttcgagagacaggagacctggagccccttccacatcagcctgaagccctaccacatcagcaagttcatctacagacacggccagatcagagtgttcaaccacagcagagacagatggctgagagtgctgagccccttcgcccccgactacatccagagaagcctgttccacagaaagggcatcaacgaggagagctgcttcagcttcctgagattcatcgacatcagccccgccgagatggccaacctgatgctgcagggcctgctggccagatggctggccctgttcctgagcctgaaggccagctacagactgcaccagctgagaagctggggcgcccccgagggcgagagccaccagagatacctgagaaacaaggacttcctgctgggcgtgaacttccccctgagcttccccaacctgtgcagctgccccctgctgaagagcctggtgttcagcagccactgcaaggccgtgagcggctacagcgaccaggtggtgcaccagagaagaagcgccaccagcagcctgagaagatgcctgctgaccgagctgcccagcttcctgtgcgtggccagccccagagtgaccgccgtgcccctggacagctactgcaacgacagaagcgccgagtacgagagaagagtgctgaaggagggcggcagcctggccgccaagcagtgcctgctgaacggcgcccccgagctggccgccgactggctgaacagaagaagccagttcttccccgagcccgccggcggcctgtggagcatcagaccccagaacggctggagcttcatcagaatccccggcaaggagagcctgatcaccgacagcggcaagctgtacgccctggacgtgctgctgaccagactgaagagccagggccacagagtgctgatctacagccagatgaccagaatgatcgacctgctggaggagtacatggtgtacagaaagcacacctacatgagactggacggcagcagcaagatcagcgagagaagagacatggtggccgacttccagaacagaaacgacatcttcgtgttcctgctgagcaccagagccggcggcctgggcatcaacctgaccgccgccgacaccgtgatcttctacgacagcgactggaaccccaccgtggaccagcaggccatggacagagcccacagactgggccagaccaagcaggtgaccgtgtacagactgatctgcaagggcaccatcgaggagagaatcctgcagagagccaaggagaagagcgagatccagagaatggtgatcagcggcggcaacttcaagcccgacaccctgaagcccaaggaggtggtgagcctgctgctggacgacgaggagctggagaagaagctgagactgagacaggaggagaagagacagcaggaggagaccaacagagtgaaggagagaaagagaaagagagagaagtacgccgagaagaagaagaaggaggacgagctggacggcaagagaagaaaggagggcgtgaacctggtgatccccttcgtgcccagcgccgacaacagcaacctgagcgccgacggcgacgacagcttcatcagcgtggacagcgccatgcccagccccttcagcgagatcagcatcagcagcgagctgcacaccggcagcatccccctggacgagagcagcagcgacatgctggtgatcgtggacgaccccgccagcagcgccccccagagcagagccaccaacagccccgccagcatcaccggcagcgtgagcgacaccgtgaacggcatcagcatccaggagatgcccgccgccggcagaggccacagcgccagaagcagaggcagacccaagggcagcggcagcaccgccaagggcgccggcaagggcagaagcagaaagagcaccgccggcagcgccgccgccatggccggcgccaaggccggcgccgccgccgccagcgccgccgcctacgccgcctacggctacaacgtgagcaagggcatcagcgccagcagccccctgcagaccagcctggtgagacccgccggcctggccgacttcggccccagcagcgccagcagccccctgagcagccccctgagcaagggcaacaacgtgcccggcaaccccaagaacctgcacatgaccagcagcctggcccccgacagcctggtgagaaagcagggcaagggcaccaaccccagcggcggcagatag

SEQ ID NO: 85188 - DNA, 4671 bp, Artificial Sequence; identical to SEQ ID NO: 85187
  Description of Artificial Sequence: Synthetic coding sequence

SEQ ID NO: 85189 - DNA, 585 bp, Artificial Sequence
  Description of Artificial Sequence: Synthetic coding sequence
atggccgccagcctggtgggcaagaagatcgtgttcgtgaccggcaacgccaagaagctggaggaggtggtgcagatcctgggcgacaagttcccctgcaccctggtggcccagaagatcgacctgcccgagtaccagggcgagcccgacgagatcagcatccagaagtgccaggaggccgtgagacaggtgcagggccccgtgctggtggaggacacctgcctgtgcttcaacgccctgggcggcctgcccggcccctacatcaagtggttcctggagaagctgaagcccgagggcctgcaccagctgctggccggcttcgaggacaagagcgcctacgccctgtgcaccttcgccctgagcaccggcgaccccagccagcccgtgagactgttcagaggcagaaccagcggcagaatcgtggcccccagaggctgccaggacttcggctgggacccctgcttccagcccgacggctacgagcagacctacgccgagatgcccaaggccgagaagaacgccgtgagccacagattcagagccctgctggagctgcaggagtacttcggcagcctggccgcctag

SEQ ID NO: 85190 - DNA, 462 bp, Artificial Sequence
  Description of Artificial Sequence: Synthetic coding sequence
atggccgccagcctggtgggcaagaagatcgtgttcgtgaccggcaacgccaagaagctggaggaggtgcagggccccgtgctggtggaggacacctgcctgtgcttcaacgccctgggcggcctgcccggcccctacatcaagtggttcctggagaagctgaagcccgagggcctgcaccagctgctggccggcttcgaggacaagagcgcctacgccctgtgcaccttcgccctgagcaccggcgaccccagccagcccgtgagactgttcagaggcagaaccagcggcagaatcgtggcccccagaggctgccaggacttcggctgggacccctgcttccagcccgacggctacgagcagacctacgccgagatgcccaaggccgagaagaacgccgtgagccacagattcagagccctgctggagctgcaggagtacttcggcagcctggccgcctag

SEQ ID NO: 85191 - DNA, 534 bp, Artificial Sequence
  Description of Artificial Sequence: Synthetic coding sequence
atggccgccagcctggtggtgcagatcctgggcgacaagttcccctgcaccctggtggcccagaagatcgacctgcccgagtaccagggcgagcccgacgagatcagcatccagaagtgccaggaggccgtgagacaggtgcagggccccgtgctggtggaggacacctgcctgtgcttcaacgccctgggcggcctgcccggcccctacatcaagtggttcctggagaagctgaagcccgagggcctgcaccagctgctggccggcttcgaggacaagagcgcctacgccctgtgcaccttcgccctgagcaccggcgaccccagccagcccgtgagactgttcagaggcagaaccagcggcagaatcgtggcccccagaggctgccaggacttcggctgggacccctgcttccagcccgacggctacgagcagacctacgccgagatgcccaaggccgagaagaacgccgtgagccacagattcagagccctgctggagctgcaggagtacttcggcagcctggccgcctag

SEQ ID NO: 85192 - DNA, 8232 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcaacaacgacgtggagaagctgaagagcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagcgaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagctgatcagcatcgacgagctggacaacgccgagctgccccccgcccccgacagcgagaacgccaccgaggagctggagcccagcccccccctgagacagctggaggaccacaagagaggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85193 - DNA, 8232 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgacttcgaggaggagtgcctggagttccagcccagcgtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcaacaacgacgtggagaagctgaagagcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagcgaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagctgatcagcatcgacgagctggacaacgccgagctgccccccgcccccgacagcgagaacgccaccgagaagggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85194 - DNA, 8277 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgacttcgaggaggagtgcctggagttccagcccagcgtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcaacaacgacgtggagaagctgaagagcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagcgaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagctgatcagcatcgacgagctggacaacgccgagctgccccccgcccccgacagcgagaacgccaccgaggagctggagcccagcccccccctgagacagctggaggaccacaagagaggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85195 - DNA, 8133 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgacttcgaggaggagtgcctggagttccagcccagcgtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagcgaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85196 - DNA, 8133 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgacttcgaggaggagtgcctggagttccagcccagcgtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagaaaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85197 - DNA, 3615 bp, Artificial Sequence
  Description of Artificial Sequence: Synthetic coding sequence
caggagcccggccactgccacagcagaggccccggccagcccagccagcagcccctgagccaggtgccccagcactgcgccgaggccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagctgatcagcatcgacgagctggacaacgccgagctgccccccgcccccgacagcgagaacgccaccgaggagctggagcccagcccccccctgagacagctggaggaccacaagagaggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85198 - DNA, 8232 bp, Artificial Sequence; identical to SEQ ID NO: 85192
  Description of Artificial Sequence: Synthetic coding sequence

SEQ ID NO: 85199 - DNA, 8088 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgaccaggacgccagcagaagcagactgagaaacgcccaggagaagatggtgtacagcctggtgagcgtgcccgagggcaacgacatcagcagcatcttcgagctggaccccaccaccctgagaggcggcgacagcctggtgcccagaaacagctacgtgagactgagacacctgtgcaccaacacctgggtgcacagcaccaacatccccatcgacaaggaggaggagaagcccgtgatgctgaagatcggcaccagccccgtgaaggaggacaaggaggccttcgccatcgtgcccgtgagccccgccgaggtgagagacctggacttcgccaacgacgccagcaaggtgctgggcagcatcgccggcaagctggagaagggcaccatcacccagaacgagagaagaagcgtgaccaagctgctggaggacctggtgtacttcgtgaccggcggcaccaacagcggccaggacgtgctggaggtggtgttcagcaagcccaacagagagagacagaagctgatgagagagcagaacatcctgaagcagatcttcaagctgctgcaggcccccttcaccgactgcggcgacggccccatgctgagactggaggagctgggcgaccagagacacgcccccttcagacacatctgcagactgtgctacagagtgctgagacacagccagcaggactacagaaagaaccaggagtacatcgccaagcagttcggcttcatgcagaagcagatcggctacgacgtgctggccgaggacaccatcaccgccctgctgcacaacaacagaaagctgctggagaagcacatcaccgccgccgagatcgacaccttcgtgagcctggtgagaaagaacagagagcccagattcctggactacctgagcgacctgtgcgtgagcatgaacaagagcatccccgtgacccaggagctgatctgcaaggccgtgctgaaccccaccaacgccgacatcctgatcgagaccaagctggtgctgagcagattcgagttcgagggcgtgagcagcaccggcgagaacgccctggaggccggcgaggacgaggaggaggtgtggctgttctggagagacagcaacaaggagatcagaagcaagagcgtgagagagctggcccaggacgccaaggagggccagaaggaggacagagacgtgctgagctactacagataccagctgaacctgttcgccagaatgtgcctggacagacagtacctggccatcaacgagatcagcggccagctggacgtggacctgatcctgagatgcatgagcgacgagaacctgccctacgacctgagagccagcttctgcagactgatgctgcacatgcacgtggacagagacccccaggagcaggtgacccccgtgaagtacgccagactgtggagcgagatccccagcgagatcgccatcgacgactacgacagcagcggcgccagcaaggacgagatcaaggagagattcgcccagaccatggagttcgtggaggagtacctgagagacgtggtgtgccagagattccccttcagcgacaaggagaagaacaagctgaccttcgaggtggtgaacctggccagaaacctgatctacttcggcttctacaacttcagcgacctgctgagactgaccaagatcctgctggccatcctggactgcgtgcacgtgaccaccatcttccccatcagcaagatggccaagggcgaggagaacaagggcagcaacgtgatgagaagcatccacggcgtgggcgagctgatgacccaggtggtgctgagaggcggcggcttcctgcccatgacccccatggccgccgcccccgagggcaacgtgaagcaggccgagcccgagaaggaggacatcatggtgatggacaccaagctgaagatcatcgagatcctgcagttcatcctgaacgtgagactggactacagaatcagctgcctgctgtgcatcttcaagagagagttcgacgagagcaacagccagaccagcgagaccagcagcggcaacagcagccaggagggccccagcaacgtgcccggcgccctggacttcgagcacatcgaggagcaggccgagggcatcttcggcggcagcgaggagaacacccccctggacctggacgaccacggcggcagaaccttcctgagagtgctgctgcacctgaccatgcacgactacccccccctggtgagcggcgccctgcagctgctgttcagacacttcagccagagacaggaggtgctgcaggccttcaagcaggtgcagctgctggtgaccagccaggacgtggacaactacaagcagatcaagcaggacctggaccagctgagaagcatcgtggagaagagcgagctgtgggtgtacaagggccagggccccgacgagaccatggacggcgccagcggcgagaacgagcacaagaagaccgaggagggcaacaacaagccccagaagcacgagagcaccagcagctacaactacagagtggtgaaggagatcctgatcagactgagcaagctgtgcgtgcaggagagcgccagcgtgagaaagagcagaaagcagcagcagagactgctgagaaacatgggcgcccacgccgtggtgctggagctgctgcagatcccctacgagaaggccgaggacaccaagatgcaggagatcatgagactggcccacgagttcctgcagaacttctgcgccggcaaccagcagaaccaggccctgctgcacaagcacatcaacctgttcctgaaccccggcatcctggaggccgtgaccatgcagcacatcttcatgaacaacttccagctgtgcagcgagatcaacgagagagtggtgcagcacttcgtgcactgcatcgagacccacggcagaaacgtgcagtacatcaagttcctgcagaccatcgtgaaggccgagggcaagttcatcaagaagtgccaggacatggtgatggccgagctggtgaacagcggcgaggacgtgctggtgttctacaacgacagagccagcttccagaccctgatccagatgatgagaagcgagagagacagaatggacgagaacagccccctgatgtaccacatccacctggtggagctgctggccgtgtgcaccgagggcaagaacgtgtacaccgagatcaagtgcaacagcctgctgcccctggacgacatcgtgagagtggtgacccacgaggactgcatccccgaggtgaagatcgcctacatcaacttcctgaaccactgctacgtggacaccgaggtggagatgaaggagatctacaccagcaaccacatgtggaagctgttcgagaacttcctggtggacatctgcagagcctgcaacaacaccagcgacagaaagcacgccgacagcatcctggagaagtacgtgaccgagatcgtgatgagcatcgtgaccaccttcttcagcagccccttcagcgaccagagcaccaccctgcagaccagacagcccgtgttcgtgcagctgctgcagggcgtgttcagagtgtaccactgcaactggctgatgcccagccagaaggccagcgtggagagctgcatcagagtgctgagcgacgtggccaagagcagagccatcgccatccccgtggacctggacagccaggtgaacaacctgttcctgaagagccacagcatcgtgcagaagaccgccatgaactggagactgagcgccagaaacgccgccagaagagacagcgtgctggccgccagcagagactacagaaacatcatcgagagactgcaggacatcgtgagcgccctggaggacagactgagacccctggtgcaggccgagctgagcgtgctggtggacgtgctgcacagacccgagctgctgttccccgagaacaccgacgccagaagaaagtgcgagagcggcggcttcatctgcaagctgatcaagcacaccaagcagctgctggaggagaacgaggagaagctgtgcatcaaggtgctgcagaccctgagagagatgatgaccaaggacagaggctacggcgagaagggcgaggccctgagacaggtgctggtgaacagatactacggcaacgtgagacccagcggcagaagagagagcctgaccagcttcggcaacggccccctgagcgccggcggccccggcaagcccggcggcggcggcggcggcagcggcagcagcagcatgagcagaggcgagatgagcctggccgaggtgcagtgccacctggacaaggagggcgccagcaacctggtgatcgacctgatcatgaacgccagcagcgacagagtgttccacgagagcatcctgctggccatcgccctgctggagggcggcaacaccaccatccagcacagcttcttctgcagactgaccgaggacaagaagagcgagaagttcttcaaggtgttctacgacagaatgaaggtggcccagcaggagatcaaggccaccgtgaccgtgaacaccagcgacctgggcaacaagaagaaggacgacgaggtggacagagacgcccccagcagaaagaaggccaaggagcccaccacccagatcaccgaggaggtgagagaccagctgctggaggccagcgccgccaccagaaaggccttcaccaccttcagaagagaggccgaccccgacgaccactaccagcccggcgagggcacccaggccaccgccgacaaggccaaggacgacctggagatgagcgccgtgatcaccatcatgcagcccatcctgagattcctgcagctgctgtgcgagaaccacaacagagacctgcagaacttcctgagatgccagaacaacaagaccaactacaacctggtgtgcgagaccctgcagttcctggactgcatctgcggcagcaccaccggcggcctgggcctgctgggcctgtacatcaacgagaagaacgtggccctgatcaaccagaccctggagagcctgaccgagtactgccagggcccctgccacgagaaccagaactgcatcgccacccacgagagcaacggcatcgacatcatcaccgccctgatcctgaacgacatcaaccccctgggcaagaagagaatggacctggtgctggagctgaagaacaacgccagcaagctgctgctggccatcatggagagcagacacgacagcgagaacgccgagagaatcctgtacaacatgagacccaaggagctggtggaggtgatcaagaaggcctacatgcagggcgaggtggagttcgaggacggcgagaacggcgaggacggcgccgccagccccagaaacgtgggccacaacatctacatcctggcccaccagctggccagacacaacaaggagctgcagagcatgctgaagcccggcggccaggtggacggcgacgaggccctggagttctacgccaagcacaccgcccagatcgagatcgtgagactggacagaaccatggagcagatcgtgttccccgtgcccagcatctgcgagttcctgaccaaggagagcaagctgagaatctactacaccaccgagagagacgagcagggcagcaagatcaacgacttcttcctgagaagcgaggacctgttcaacgagatgaactggcagaagaagctgagagcccagcccgtgctgtactggtgcgccagaaacatgagcttctggagcagcatcagcttcaacctggccgtgctgatgaacctgctggtggccttcttctaccccttcaagggcgtgagaggcggcaccctggagccccactggagcggcctgctgtggaccgccatgctgatcagcctggccatcgtgatcgccctgcccaagccccacggcatcagagccctgatcgccagcaccatcctgagactgatcttcagcgtgggcctgcagcccaccctgttcctgctgggcgccttcaacgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85200 - DNA, 2166 bp, Artificial Sequence
  Description of Artificial Sequence: Synthetic coding sequence
atgagcgacaagatgagcagcttcctgcacatcggcgacatctgcagcctgtacgccgagggcagcaccaacggcttcatcagcaccctgggcctggtggacgacagatgcgtggtgcagcccgagaccggcgacctgaacaacccccccaagaagttcagagactgcctgttcaagctgtgccccatgaacagatacagcgcccagaagcagttctggaaggccgccaagcccggcgccaacagcaccaccgacgccgtgctgctgaacaagctgcaccacgccgccgacctggagaagaagcagaacgagaccgagaacagaaagctgctgggcaccgtgatccagtacggcaacgtgatccagctgctgcacctgaagagcaacaagtacctgaccgtgaacaagagactgcccgccctgctggagaagaacgccatgagagtgaccctggacgaggccggcaacgagggcagctggttctacatccagcccttctacaagctgagaagcatcggcgacagcgtggtgatcggcgacaaggtggtgctgaaccccgtgaacgccggccagcccctgcacgccagcagccaccagctggtggacaaccccggctgcaacgaggtgaacagcgtgaactgcaacaccagctggaagatcgtgctgttcatgaagtggagcgacaacaaggacgacatcctgaagggcggcgacgtggtgagactgttccacgccgagcaggagaagttcctgacctgcgacgagcacagaaagaagcagcacgtgttcctgagaaccaccggcagacagagcgccaccagcgccaccagcagcaaggccctgtgggaggtggaggtggtgcagcacgacccctgcagaggcggcgccggctactggaacagcctgttcagattcaagcacctggccaccggccactacctggccgccgaggtggaccccgacttcgaggaggagtgcctggagttccagcccagcgtgtgcaacaagatcatcttcctgatgagcttcgtgggcaactgcggcaccttcaccagaggctacagagccatggtgctggacgtggagttcctgtaccacctgctgtacctggtgatctgcgccatgggcctgttcgtgcacgagttcttctacagcctgctgctgttcgacctggtgtacagagaggagaccctgctgaacgtgatcaagagcgtgaccagaaacggcagaagcatcatcctgaccgccgtgctggccctgatcctggtgtacctgttcagcatcgtgggctacctgttcttcaaggacgacttcatcctggaggtggacagactgcccaacgagaccgccgtgcccgagaccggcgagagcctggccagcgagttcctgttcagcgacgtgtgcagagtggagagcggcgagaactgcagcagccccgcccccagagaggagctggtgcccgccgaggagaccgagcaggacaaggagcacacctgcgagaccctgctgatgtgcatcgtgaccgtgctgagccacggcctgagaagcggcggcggcgtgggcgacgtgctgagaaagcccagcaaggaggagcccctgttcgccgccagagtgatctacgacctgctgttcttcttcatggtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgaccttcgaggagcacatcaaggaggagcacaacatgtggcactacctgtgcttcatcgtgctggtgaaggtgaaggacagcaccgagtacaccggccccgagagctacgtggccgagatgatcaaggagagaaacctggactggttccccagaatgagagccatgagcctggtgagcagcgacagcgagggcgagcagaacgagctgagaaacctgcaggagaagctggagagcaccatgaagctggtgaccaacctgagcggccagctgagcgagctgaaggaccagatgaccgagcagagaaagcagaagcagagaatcggcctgctgggccaccccccccacatgaacgtgaacccccagcagcccgcctag

SEQ ID NO: 85201 - DNA, 546 bp, Artificial Sequence
  Description of Artificial Sequence: Synthetic coding sequence
atgaccgagaagatgagcagcttcctgtacatcggcgacatcgtgagcctgtacgccgagggcagcgtgaacggcttcatcagcaccctgggcctggtggacgacagatgcgtggtgcaccccgaggccggcgacctggccaacccccccaagaagttcagagactgcctgttcaaggtgtgccccatgaacagatacagcgcccagaagcagtactggaaggccaagcaggccaagcagggcaaccacaccgaggccgccctgctgaagaagctgcagcacgccgccgagctggagcagaagcagaacgagagcgagaacaagaagctgctgggcgagatcgtgaagtacagcaacgtgatccagctgctgcacatcaagagcaacaagtacctgaccgtgaacaagagactgcccgccctgctggagaagaacgccatgagagtgagcctggacgccgccggcaacgagggcagctggttctacatccaccccttctggaagctgagaagcgagggcgacaacgacgccagcttctggatctag

SEQ ID NO: 85202 - DNA, 8106 bp, Artificial Sequence
  Description of Artificial Sequence: Synthetic coding sequence
atgaccgagaagatgagcagcttcctgtacatcggcgacatcgtgagcctgtacgccgagggcagcgtgaacggcttcatcagcaccctgggcctggtggacgacagatgcgtggtgcaccccgaggccggcgacctggccaacccccccaagaagttcagagactgcctgttcaaggtgtgccccatgaacagatacagcgcccagaagcagtactggaaggccaagcaggccaagcagggcaaccacaccgaggccgccctgctgaagaagctgcagcacgccgccgagctggagcagaagcagaacgagagcgagaacaagaagctgctgggcgagatcgtgaagtacagcaacgtgatccagctgctgcacatcaagagcaacaagtacctgaccgtgaacaagagactgcccgccctgctggagaagaacgccatgagagtgagcctggacgccgccggcaacgagggcagctggttctacatccaccccttctggaagctgagaagcgagggcgacaacatcgtggtgggcgacaaggtggtgctgatgcccgtgaacgccggccagcccctgcacgccagcaacatcgagctgctggacaaccccggctgcaaggaggtgaacgccgtgaactgcaacaccagctggaagatcaccctgttcatgaagtacagcagctacagagaggacgtgctgaagggcggcgacgtggtgagactgttccacgccgagcaggagaagttcctgacctgcgacgagtacgagaagaagcagcacatcttcctgagaaccaccctgagacagagcgccaccagcgccaccagcagcaaggccctgtgggagatcgaggtggtgcaccacgacccctgcagaggcggcgccggccagtggaacagcctgttcagattcaagcacctggccaccggcaactacctggccgccgagctgaaccccgactacagagacgcccagaacgagggcaagaacgtgagagacggcgtgccccccaccagcaagaagaagagacaggccggcgagaagatcatgtacaccctggtgagcgtgccccacggcaacgacatcgccagcctgttcgagctggacgccaccaccctgcagagagccgactgcctggtgcccagaaacagctacgtgagactgagacacctgtgcaccaacacctgggtgaccagcaccagcatccccatcgacaccgacgaggagagacccgtgatgctgaagatcggcacctgccagaccaaggaggacaaggaggccttcgccatcgtgagcgtgcccctgagcgaggtgagagacctggacttcgccaacgacgccaacaaggtgctggccaccaccgtgaagaagctggagaacggcaccatcacccagaacgagagaagattcgtgaccaagctgctggaggacctgatcttcttcgtggccgacgtgcccaacaacggccaggaggtgctggacgtggtgatcaccaagcccaacagagagagacagaagctgatgagagagcagaacatcctggcccaggtgttcggcatcctgaaggcccccttcaaggagaaggccggcgagggcagcatgctgagactggaggacctgggcgaccagagatacgccccctacaagtacatgctgagactgtgctacagagtgctgagacacagccagcaggactacagaaagaaccaggagtacatcgccaagaacttctgcgtgatgcagagccagatcggctacgacatcctggccgaggacaccatcaccgccctgctgcacaacaacagaaagctgctggagaagcacatcaccgccaaggagatcgagaccttcgtgagcctgctgagaagaaacagagagcccagattcctggactacctgagcgacctgtgcgtgagcaacaccaccgccatccccgtgacccaggagctgatctgcaagttcatgctgagccccggcaacgccgacatcctgatccagaccaaggtggtgagcatgcaggccgacaaccccatggagagcagcatcctgagcgacgacatcgacgacgaggaggtgtggctgtactggatcgacagcaacaaggagccccacggcaaggccatcagacacctggcccaggaggccaaggagggcaccaaggccgacctggaggtgctgacctactacagataccagctgaacctgttcgccagaatgtgcctggacagacagtacctggccatcaaccagatcagcacccagctgagcgtggacctgatcctgagatgcgtgagcgacgagagcctgcccttcgacctgagagccagcttctgcagactgatgctgcacatgcacgtggacagagacccccaggagagcgtggtgcccgtgagatacgccagactgtggaccgagatccccaccaagatcaccatccacgagtacgacagcatcaccgacagcagcagaaacgacatgaagagaaagttcgccctgaccatggagttcgtggaggagtacctgaaggaggtggtgaaccagcccttccccttcggcgacaaggagaagaacaagctgaccttcgaggtggtgcacctggccagaaacctgatctacttcggcttctacagcttcagcgagctgctgagactgaccagaaccctgctggccatcctggacatcgtgcaggcccccatgagcagctacttcgagagactgagcaagttccaggacggcggcaacaacgtgatgagaaccatccacggcgtgggcgagatgatgacccagatggtgctgagcagaggcagcatcttccccatgagcgtgcccgacgtgccccccagcatccaccccagcaagcagggcagccccaccgagcacgaggacgtgaccgtgatggacaccaagctgaagatcatcgagatcctgcagttcatcctgagcgtgagactggactacagaatcagctacatgctgagcatctacaagaaggagttcggcgaggacaacgacaacgccgagaccagcgccagcggcagccccgacaccctgctgcccagcgccatcgtgcccgacatcgacgagatcgccgcccaggccgagaccatgttcgccggcagaaaggagaagaaccccgtgcagctggacgacgagggcggcagaaccttcctgagagtgctgatccacctgatcatgcacgactacccccccctgctgagcggcgccctgcagctgctgttcaagcacttcagccagagagccgaggtgctgcaggccttcaagcaggtgcagctgctggtgagcaaccaggacgtggacaactacaagcagatcaaggccgacctggaccagctgagactgaccgtggagaagagcgagctgtgggtggagaagagcagcaactacgagaacggcgagatcggcgagagccaggtgaagggcggcgaggagcccatcgaggagagcaacatcctgagccccgtgcaggacggcaccaagaagccccagatcgacagcaacaagagcaacaactacagaatcgtgaaggagatcctgatcagactgagcaagctgtgcgtgcagaacaagaagtgcagaaaccagcaccagagactgctgaagaacatgggcgcccacagcgtggtgctggacctgctgcagatcccctacgagaagaacgacgagaagatgaacgaggtgatgaacctggcccacaccttcctgcagaacttctgcagaggcaacccccagaaccaggtgctgctgcacaagcacctgaacctgttcctgacccccggcctgctggaggccgagaccatgagacacatcttcatgaacaactaccacctgtgcaacgagatcagcgagagagtggtgcagcacttcgtgcactgcatcgagacccacggcagacacgtggagtacctgagattcctgcagaccatcgtgaaggccgacggcaagtacgtgaagaagtgccaggacatggtgatgaccgagctgatcaacggcggcgaggacgtgctgatcttctacaacgacagagccagcttccccatcctgctgcacatgatgtgcagcgagagagacagaggcgacgagagcggccccctggcctaccacatcaccctggtggagctgctggccgcctgcaccgagggcaagaacgtgtacaccgagatcaagtgcaacagcctgctgcccctggacgacatcgtgagagtggtgacccacgacgactgcatccccgaggtgaagatcgcctacgtgaacttcgtgaaccactgctacgtggacaccgaggtggagatgaaggagatctacaccagcaaccacatctggaagctgttcgagaacttcctggtggacatggccagagtgtgcaacaccaccaccgacagaaagcacgccgacatcttcctggagaagtgcgtgaccgagagcatcatgaacatcgtgagcggcttcttcaacagccccttcagcgacaacagcaccagcctgcagacccaccagcccgtgttcatccagctgctgcagagcgccttcagaatctacaactgcacctggcccaaccccgcccagaaggccagcgtggagagctgcatcagaaccctggccgaggtggccaagaacagaggcatcgccatccccgtggacctggacagccaggtgaacaccctgttcatgaagagccacagcaacatggtgcagagagccgccatgggctggagactgagcgccagaagcggccccagattcaaggaggccctgggcggccccgcctgggactacagaaacatcatcgagaagctgcaggacgtggtggccagcctggagcaccagttcagccccatgatgcaggccgagttcagcgtgctggtggacgtgctgtacagccccgagctgctgttccccgagggcagcgacgccagaatcagatgcggcgccttcatgagcaagctgatcaaccacaccaagaagctgatggagaaggaggagaagctgtgcatcaagatcctgcagaccctgagagagatgctggagaagaaggacagcttcgtggaggagggcaacaccctgagaaagatcctgctgaacagatacttcaagggcgactacagcatcggcgtgaacggccacctgagcggcgcctacagcaagaccgcccaggtgggcggcagcttcagcggccaggacagcgacaagatgggcatcagcatgagcgacatccagtgcctgctggacaaggagggcgccagcgagctggtgatcgacgtgatcgtgaacaccaagaacgacagaatcttcagcgagggcatcttcctgggcatcgccctgctggagggcggcaacacccagacccagtacagcttctaccagcagctgcacgagcagaagaagagcgagaagttcttcaaggtgctgtacgacagaatgaaggccgcccagaaggagatcagaagcaccgtgaccgtgaacaccatcgacctgggcaacaagaagagagacgacgacaacgagctgatgaccagcggccccagaatgagagtgagagacagcaccctgcacctgaaggagggcatgaagggccagctgaccgaggccagcagcgccaccagcaaggcctactgcgtgtacagaagagagatggaccccgagatcgacatcatgtgcaccggccccgaggccggcaacaccgaggagaagagcgccgaggaggtgaccatgagccccgccatcgccatcatgcagcccatcctgagattcctgcagctgctgtgcgagaaccacaacagagagctgcagaacttcctgagaaaccagaacaacaagaccaactacaacctggtgtgcgagaccctgcagttcctggactgcatctgcggcagcaccaccggcggcctgggcctgctgggcctgtacatcaacgagaagaacgtggccctggtgaaccagaacctggagagcctgaccgagtactgccagggcccctgccacgagaaccagacctgcatcgccacccacgagagcaacggcatcgacatcatcatcgccctgatcctgaacgacatcaaccccctgggcaagtacagaatggacctggtgctgcagctgaagaacaacgccagcaagctgctgctggccatcatggagagcagacacgacagcgagaacgccgagagaatcctgttcaacatgagacccagagagctggtggacgtgatgaagaacgcctacaaccagggcctggagtgcgaccacggcgacgacgagggcggcgacgacggcgtgagccccaaggacgtgggccacaacatctacatcctggcccaccagctggccagacacaacaagctgctgcagcagatgctgaagcccggcagcgaccccgacgagggcgacgaggccctgaagtactacgccaaccacaccgcccagatcgagatcgtgagacacgacagaaccatggagcagatcgtgttccccgtgcccaacatctgcgagtacctgaccagagagagcaagtgcagagtgttcaacaccaccgagagagacgagcagggcagcaaggtgaacgacttcttccagcagaccgaggacctgtacaacgagatgaagtggcagaagaagatcagaaacaaccccgccctgttctggttcagcagacacatcagcctgtggggcagcatcagcttcaacctggccgtgttcatcaacctggccgtggccctgttctaccccttcggcgacgacggcgacgagggcaccctgagccccctgttcagcgtgctgctgtggatcgccgtggccatctgcaccagcatgctgttcttcttcagcaagcccgtgggcatcagacccttcctggtgagcatcatgctgagaagcatctacaccatcggcctgggccccaccctgatcctgctgggcgccgccaacctgtgcaacaagatcgtgttcctggtgagcttcgtgggcaacagaggcaccttcaccagaggctacagagccgtgatcctggacatggccttcctgtaccacgtggcctacgtgctggtgtgcatgctgggcctgttcgtgcacgagttcttctacagcttcctgctgttcgacctggtgtacagagaggagaccctgctgaacgtgatcaagagcgtgaccagaaacggcagaagcatcatcctgaccgccgtgctggccctgatcctggtgtacctgttcagcatcatcggcttcctgttcctgaaggacgacttcaccatggaggtggacagactgaagaacagaacccccgtgaccggcagccaccaggtgcccaccatgaccctgaccaccatgatggaggcctgcgccaaggagaactgcagccccaccatccccgccagcaacaccgccgacgaggagtacgaggacggcatcgagagaacctgcgacaccctgctgatgtgcatcgtgaccgtgctgaaccagggcctgagaaacggcggcggcgtgggcgacgtgctgagaagacccagcaaggacgagcccctgttcgccgccagagtggtgtacgacctgctgttctacttcatcgtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgagcttcgaggagcacatcaagagcgagcacaacatgtggcactacctgtacttcatcgtgctggtgaaggtgaaggaccccaccgagtacaccggccccgagagctacgtggcccagatgatcgtggagaagaacctggactggttccccagaatgagagccatgagcctggtgagcaacgagggcgacagcgagcagaacgagatcagaagcctgcaggagaagctggagagcaccatgagcctggtgaagcagctgagcggccagctggccgagctgaaggagcagatgaccgagcagagaaagaacaagcagagactgggcttcctgggcagcaacaccccccacgtgaaccaccacatgcccccccactag

SEQ ID NO: 85203 - DNA, 8016 bp, Artificial Sequence
  Description of Artificial Sequence: Synthetic coding sequence
atgagcgagatgagcagcttcctgcacatcggcgacatcgtgagcctgtacgccgagggcagcgtgaacggcttcatcagcaccctgggcctggtggacgacagatgcgtggtggagcccgccgccggcgacctggacaacccccccaagaagttcagagactgcctgttcaaggtgtgccccatgaacagatacagcgcccagaagcagtactggaaggccaagcagaccaagcaggacaaggagaagatcgccgacgtggtgctgctgcagaagctgcagcacgccgcccagatggagcagaagcagaacgacaccgagaacaagaaggtgcacggcgacgtggtgaagtacggcagcgtgatccagctgctgcacatgaagagcaacaagtacctgaccgtgaacaagagactgcccgccctgctggagaagaacgccatgagagtgaccctggacgccaccggcaacgagggcagctggctgttcatccagcccttctggaagctgagaagcaacggcgacaacgtggtggtgggcgacaaggtgatcctgaaccccgtgaacgccggccagcccctgcacgccagcaactacgagctgagcgacaacgccggctgcaaggaggtgaacagcgtgaactgcaacaccagctggaagatcaacctgttcatgcagttcagagaccacctggaggaggtgctgaagggcggcgacgtggtgagactgttccacgccgagcaggagaagttcctgacctgcgacgagtacaagggcaagctgcaggtgttcctgagaaccaccctgagacagagcgccaccagcgccaccagcagcaacgccctgtgggaggtggaggtggtgcaccacgacccctgcagaggcggcgccggccactggaacggcctgtacagattcaagcacctggccaccggcaactacctggccgccgaggagaaccccagctacaagggcgacgccagcgaccccaaggccgccggcatgggcgcccagggcagaaccggcagaagaaacgccggcgagaagatcaagtactgcctggtggccgtgccccacggcaacgacatcgccagcctgttcgagctggaccccaccaccctgcagaagaccgacagcttcgtgcccagaaacagctacgtgagactgagacacctgtgcaccaacacctggatccagagcaccaacgtgcccatcgacatcgaggaggagagacccatcagactgatgctgggcacctgccccaccaaggaggacaaggaggccttcgccatcgtgagcgtgcccgtgagcgagatcagagacctggacttcgccaacgacgccagcagcatgctggccagcgccgtggagaagctgaacgagggcttcatcagccagaacgacagaagattcgtgatccagctgctggaggacctggtgttcttcgtgagcgacgtgcccaacaacggccagaacgtgctggacatcatggtgaccaagcccaacagagagagacagaagctgatgagagagcagaacatcctgaagcaggtgttcggcatcctgaaggcccccttcagagagaagggcggcgagggccccctggtgagactggaggagctgagcgaccagaagaacgccccctaccagcacatgttcagactgtgctacagagtgctgagacacagccaggaggactacagaaagaaccaggagcacatcgccaagcagttcggcatgatgcagagccagatcggctacgacatcctggccgaggacaccatcaccgccctgctgcacaacaacagaaagctgctggagaagcacatcaccaagaccgaggtggagaccttcgtgagcctggtgagaaagaacagagagcccagattcctggactacctgagcgacctgtgcgtgagcaaccacatcgccatccccgtgacccaggagctgatctgcaagtgcgtgctggaccccaagaacagcgacatcctgatcagaaccgagctgagacccgtgaaggagatggcccagagccacgagtacctgagcatcgagtacagcgaggaggaggtgtggctgacctggaccgacaagaacaacgagcaccacgagaagagcgtgagacagctggcccaggaggccagagccggcaacgcccacgacgagaacgtgctgagctactacagataccagctgaagctgttcgccagaatgtgcctggacagacagtacctggccatcgacgagatcagccagcagctgggcgtggacctgatcttcctgtgcatggccgacgagatgctgcccttcgacctgagagccagcttctgccacctgatgctgcacgtgcacgtggacagagacccccaggagctggtgacccccgtgaagttcgccagactgtggaccgagatccccaccgccatcaccatcaaggactacgacagcaacctgaacgccagcagagacgacaagaagaacaagttcgccaacaccatggagttcgtggaggactacctgaacaacgtggtgagcgaggccgtgcccttcgccaacgaggagaagaacaagctgaccttcgaggtggtgagcctggcccacaacctgatctacttcggcttctacagcttcagcgagctgctgagactgaccagaaccctgctgggcatcatcgactgcgtgcagggcccccccgccatgctgcaggcctacgaggaccccggcggcaagaacgtgagaagaagcatccagggcgtgggccacatgatgagcaccatggtgctgagcagaaagcagagcgtgttcagcgcccccagcctgagcgccggcgccagcgccgccgagcccctggacagaagcaagttcgaggagaacgaggacatcgtggtgatggagaccaagctgaagatcctggagatcctgcagttcatcctgaacgtgagactggactacagaatcagctacctgctgagcgtgttcaagaaggagttcgtggaggtgttccccatgcaggacagcggcgccgacggcaccgcccccgccttcgacagcaccaccgccaacatgaacctggacagaatcggcgagcaggccgaggccatgttcggcgtgggcaagaccagcagcatgctggaggtggacgacgagggcggcagaatgttcctgagagtgctgatccacctgaccatgcacgactacgcccccctggtgagcggcgccctgcagctgctgttcaagcacttcagccagagacaggaggccatgcacaccttcaagcaggtgcagctgctgatcagcgcccaggacgtggagaactacaaggtgatcaagagcgagctggacagactgagaaccatggtggagaagagcgagctgtgggtggacaagaagggcagcggcaagggcgaggaggtggaggccggcgccgccaaggacaagaaggagagacccaccgacgaggagggcttcctgcacccccccggcgagaagagcagcgagaactaccagatcgtgaagggcatcctggagagactgaacaagatgtgcggcgtgggcgagcagatgagaaagaagcagcagagactgctgaagaacatggacgcccacaaggtgatgctggacctgctgcagatcccctacgacaagggcgacgccaagatgatggagatcctgagatacacccaccagttcctgcagaagttctgcgccggcaaccccggcaaccaggccctgctgcacaagcacctgcacctgttcctgacccccggcctgctggaggccgagaccatgcagcacatcttcctgaacaactaccagctgtgcagcgagatcagcgagcccgtgctgcagcacttcgtgcacctgctggccacccacggcagacacgtgcagtacctggacttcctgcacaccgtgatcaaggccgagggcaagtacgtgaagaagtgccaggacatgatcatgaccgagctgaccaacgccggcgacgacgtggtggtgttctacaacgacaaggccagcctggcccacctgctggacatgatgaaggccgccagagacggcgtggaggaccacagccccctgatgtaccacatcagcctggtggacctgctggccgcctgcgccgagggcaagaacgtgtacaccgagatcaagtgcaccagcctgctgcccctggaggacgtggtgagcgtggtgacccacgaggactgcatcaccgaggtgaagatggcctacgtgaacttcgtgaaccactgctacgtggacaccgaggtggagatgaaggagatctacaccagcaaccacatctggaccctgttcgagaacttcaccctggacatggccagagtgtgcagcaagagagagaagagagtggccgaccccaccctggagaagtacgtgctgagcgtggtgctggacaccatcaacgccttcttcagcagccccttcagcgagaacagcaccagcctgcagacccaccagaccatcgtggtgcagctgctgcagagcaccaccagactgctggagtgcccctggctgcagcagcagcacaagggcagcgtggaggcctgcatcagaaccctggccatggtggccaagggcagagccatcctgctgcccatggacctggacgcccacatcagcagcatgctgagcagcggcgccagctgcgccgccgccgcccagagaaacgccagcagctacaaggccaccaccagagccttccccagagtgacccccaccgccaaccagtgggactacaagaacatcatcgagaagctgcaggacatcatcaccgccctggaggagagactgaagcccctggtgcaggccgagctgagcgtgctggtggacgtgctgcactggcccgagctgctgttcctggagggcagcgaggcctaccagagatgcgagagcggcggcttcctgagcaagctgatccagcacaccaaggacctgatggagagcgaggagaagctgtgcatcaaggtgctgagaaccctgcagcagatgctgctgaagaagaccaagtacggcgacagaggcaaccagctgagaaagatgctgctgcagaactacctgcagaacagaaagagcaccagcagaggcgacctgcccgaccccatcggcaccggcctggaccccgactggagcgccatcgccgccacccagtgcagactggacaaggagggcgccaccaagctggtgtgcgacctgatcaccagcaccaagaacgagaagatcttccaggagagcatcggcctggccatccacctgctggacggcggcaacaccgagatccagaagagcttccacaacctgatgatgagcgacaagaagagcgagagattcttcaaggtgctgcacgacagaatgaagagagcccagcaggagaccaagagcaccgtggccgtgaacatgaacgacctgggcagccagccccacgaggacagagagcccgtggaccccaccaccaagggcagagtggccagcttcagcatccccggcagcagcagcagatacagcctgggccccagcctgagaagaggccacgaggtgagcgagagagtgcagagcagcgagatgggcaccagcgtgctgatcatgcagcccatcctgagattcctgcagctgctgtgcgagaaccacaacagagacctgcagaacttcctgagatgccagaacaacaagaccaactacaacctggtgtgcgagaccctgcagttcctggacatcatgtgcggcagcaccaccggcggcctgggcctgctgggcctgtacatcaacgaggacaacgtgggcctggtgatccagaccctggagaccctgaccgagtactgccagggcccctgccacgagaaccagacctgcatcgtgacccacgagagcaacggcatcgacatcatcaccgccctgatcctgaacgacatcagccccctgtgcaagtacagaatggacctggtgctgcagctgaaggacaacgccagcaagctgctgctggccctgatggagagcagacacgacagcgagaacgccgagagaatcctgatcagcctgagaccccaggagctggtggacgtgatcaagaaggcctacctgcaggaggaggagagagagaacagcgaggtgagccccagagaggtgggccacaacatctacatcctggccctgcagctgagcagacacaacaagcagctgcagcacctgctgaagcccgtgaagagaatccaggaggaggaggccgagggcatcagcagcatgctgagcctgaacaacaagcagctgagccagatgctgaagagcagcgcccccgcccaggaggaggaggaggaccccctggcctactacgagaaccacaccagccagatcgagatcgtgagacaggacagaagcatggagcagatcgtgttccccgtgcccggcatctgccagttcctgaccgaggagaccaagcacagactgttcaccaccaccgagcaggacgagcagggcagcaaggtgagcgacttcttcgaccagagcagcttcctgcacaacgagatggagtggcagagaaagctgagaagcatgcccctgatctactggttcagcagaagaatgaccctgtggggcagcatcagcttcaacctggccgtgttcatcaacatcatcatcgccttcttctacccctacatggagggcgccagcaccggcgtgctggacagccccctgatcagcctgctgttctggatcctgatctgcttcagcatcgccgccctgttcaccaagagatacagcatcagacccctgatcgtggccctgatcctgagaagcatctactacctgggcatcggccccaccctgaacatcctgggcgccctgaacctgaccaacaagatcgtgttcgtggtgagcttcgtgggcaacagaggcaccttcatcagaggctacaaggccatggtgatggacatggagttcctgtaccacgtgggctacatcctgaccagcgtgctgggcctgttcgcccacgagctgttctacagcatcctgctgttcgacctgatctacagagaggagaccctgttcaacgtgatcaagagcgtgaccagaaacggcagaagcatcctgctgaccgccctgctggccctgatcctggtgtacctgttcagcatcgtgggcttcctgttcctgaaggacgacttcatcctggaggtggacagactgcccaacaaccacagcaccgccagccccctgggcatgccccacggcgccgccgccttcgtggacacctgcagcggcgacaagatggactgcgtgagcggcctgagcgtgcccgaggtgctggaggaggacagagagctggacagcaccgagagagcctgcgacaccctgctgatgtgcatcgtgaccgtgatgaaccacggcctgagaaacggcggcggcgtgggcgacatcctgagaaagcccagcaaggacgagagcctgttccccgccagagtggtgtacgacctgctgttcttcttcatcgtgatcatcatcgtgctgaacctgatcttcggcgtgatcatcgacaccttcgccgacctgagaagcgagaagcagaagaaggaggagatcctgaagaccacctgcttcatctgcggcctggagagagacaagttcgacaacaagaccgtgagcttcgaggagcacatcaagctggagcacaacatgtggaactacctgtacttcatcgtgctggtgagagtgaagaacaagaccgactacaccggccccgagagctacgtggcccagatgatcaagaacaagaacctggactggttccccagaatgagagccatgagcctggtgagcaacgagggcgagggcgagcagaacgagatcagaatcctgcaggacaagctgaacagcaccatgaagctggtgagccacctgaccgcccagctgaacgagctgaaggagcagatgaccgagcagagaaagagaagacagagactgggcttcgtggacgtgcagaactgcatcagcagatag

SEQ ID NO: 85204 - DNA, 1326 bp, Artificial Sequence
  Description of Artificial Sequence: Synthetic coding sequence
atgtgcgtgtgccagaccatggaggtgggccagtacggcaagaacgccagcagagccggcgacagaggcgtgctgctggagcccttcatccaccaggtgggcggccacagcagcatgatgagatacgacgaccacaccgtgtgcaagcccctgatcagcagagagcagagattctacgagagcctgccccccgagatgaaggagttcacccccgagtacaagggcgtggtgagcgtgtgcttcgagggcgacagcgacggctacatcaacctggtggcctacccctacgtggagagcgagaccgtggagcaggacgacaccaccgagagagagcagcccagaagaaagcacagcagaagaagcctgcacagaagcggcagcggcagcgaccacaaggaggagaaggccagcctgagcctggagaccagcgagagcagccaggaggccaagagccccaaggtggagctgcacagccacagcgaggtgcccttccagatgctggacggcaacagcggcctgagcagcgagaagatcagccacaacccctggagcctgagatgccacaagcagcagctgagcagaatgagaagcgagagcaaggacagaaagctgtacaagttcctgctgctggagaacgtggtgcaccacttcaagtacccctgcgtgctggacctgaagatgggcaccagacagcacggcgacgacgccagcgccgagaaggccgccagacagatgagaaagtgcgagcagagcaccagcgccaccctgggcgtgagagtgtgcggcatgcaggtgtaccagctggacaccggccactacctgtgcagaaacaagtactacggcagaggcctgagcatcgagggcttcagaaacgccctgtaccagtacctgcacaacggcctggacctgagaagagacctgttcgagcccatcctgagcaagctgagaggcctgaaggccgtgctggagagacaggccagctacagattctacagcagcagcctgctggtgatctacgacggcaaggagtgcagagccgagagctgcctggacagaagaagcgagatgagactgaagcacctggacatggtgctgcccgaggtggccagcagctgcggccccagcaccagccccagcaacaccagccccgaggccggccccagcagccagcccaaggtggacgtgagaatgatcgacttcgcccacagcaccttcaagggcttcagagacgaccccaccgtgcacgacggccccgacagaggctacgtgttcggcctggagaacctgatcagcatcatggagcagatgagagacgagaaccagtag

SEQ ID NO: 85205 - DNA, 831 bp, Artificial Sequence
  Description of Artificial Sequence: Synthetic coding sequence
atgctggacggcaacagcggcctgagcagcgagaagatcagccacaacccctggagcctgagatgccacaagcagcagctgagcagaatgagaagcgagagcaaggacagaaagctgtacaagttcctgctgctggagaacgtggtgcaccacttcaagtacccctgcgtgctggacctgaagatgggcaccagacagcacggcgacgacgccagcgccgagaaggccgccagacagatgagaaagtgcgagcagagcaccagcgccaccctgggcgtgagagtgtgcggcatgcaggtgtaccagctggacaccggccactacctgtgcagaaacaagtactacggcagaggcctgagcatcgagggcttcagaaacgccctgtaccagtacctgcacaacggcctggacctgagaagagacctgttcgagcccatcctgagcaagctgagaggcctgaaggccgtgctggagagacaggccagctacagattctacagcagcagcctgctggtgatctacgacggcaaggagtgcagagccgagagctgcctggacagaagaagcgagatgagactgaagcacctggacatggtgctgcccgaggtggccagcagctgcggccccagcaccagccccagcaacaccagccccgaggccggccccagcagccagcccaaggtggacgtgagaatgatcgacttcgcccacagcaccttcaagggcttcagagacgaccccaccgtgcacgacggccccgacagaggctacgtgttcggcctggagaacctgatcagcatcatggagcagatgagagacgagaaccagtag

SEQ ID NO: 85206 - DNA, 831 bp, Artificial Sequence; identical to SEQ ID NO: 85205
  Description of Artificial Sequence: Synthetic coding sequence

SEQ ID NO: 85207 - DNA, 1281 bp, Artificial Sequence
  Description of Artificial Sequence: Synthetic coding sequence
atgagccccgccttcagagccatggacgtggagcccagagccaagggcgtgctgctggagcccttcgtgcaccaggtgggcggccacagctgcgtgctgagattcaacgagaccaccctgtgcaagcccctggtgcccagagagcaccagttctacgagaccctgcccgccgagatgagaaagttcaccccccagtacaagggcgtggtgagcgtgagattcgaggaggacgaggacagaaacctgtgcctgatcgcctaccccctgaagggcgaccacggcatcgtggacatcgtggacaacagcgactgcgagcccaagagcaagctgctgagatggaccaccaacaagaagcaccacgtgctggagaccgagaagacccccaaggactgggtgagacagcacagaaaggaggagaagatgaagagccacaagctggaggaggagttcgagtggctgaagaagagcgaggtgctgtactacaccgtggagaagaagggcaacatcagcagccagctgaagcactacaacccctggagcatgaagtgccaccagcagcagctgcagagaatgaaggagaacgccaagcacagaaaccagtacaagttcatcctgctggagaacctgaccagcagatacgaggtgccctgcgtgctggacctgaagatgggcaccagacagcacggcgacgacgccagcgaggagaaggccgccaaccagatcagaaagtgccagcagagcaccagcgccgtgatcggcgtgagagtgtgcggcatgcaggtgtaccaggccggcagcggccagctgatgttcatgaacaagtaccacggcagaaagctgagcgtgcagggcttcaaggaggccctgttccagttcttccacaacggcagatacctgagaagagagctgctgggccccgtgctgaagaagctgaccgagctgaaggccgtgctggagagacaggagagctacagattctacagcagcagcctgctggtgatctacgacggcaaggagagacccgaggtggtgctggacagcgacgccgaggacctggaggacctgagcgaggagagcgccgacgagagcgccggcgcctacgcctacaagcccatcggcgccagcagcgtggacgtgagaatgatcgacttcgcccacaccacctgcagactgtacggcgaggacaccgtggtgcacgagggccaggacgccggctacatcttcggcctgcagagcctgatcgacatcgtgaccgagatcagcgaggagagcggcgagtag

SEQ ID NO: 85208 - DNA, 294 bp, Artificial Sequence
  Description of Artificial Sequence: Synthetic coding sequence
atgagccccgccttcagagccatggacgtggagcccagagccaagggcgtgctgctggagcccttcgtgcaccaggtgggcggccacagctgcgtgctgagattcaacgagaccaccctgtgcaagcccctggtgcccagagagcaccagttctacgagaccctgcccgccgagatgagaaagttcaccccccagtacaagggccagagccagagacccctggtgagctggcccagcctgccccacttcttcccctggagcttccccctgtggccccagggcagcgtggcctag

SEQ ID NO: 85209 - DNA, 294 bp, Artificial Sequence; identical to SEQ ID NO: 85208
  Description of Artificial Sequence: Synthetic coding sequence

SEQ ID NO: 85210 - DNA, 558 bp, Artificial Sequence
  Description of Artificial Sequence: Synthetic coding sequence
atgagcctgaacctgcccgaggccagcctgctgagcagagccagctggcccgagcaggccaaggagcccagaagagagggccacaccgacaagcagcagaccgaggacgtgctggccgccggcctgagatgcctgccccacctgcccgccatctgcgccagaagaatgagccccgccttcagagccatggacgtggagcccagagccaagggcgtgctgctggagcccttcgtgcaccaggtgggcggccacagctgcgtgctgagattcaacgagaccaccctgtgcaagcccctggtgcccagagagcaccagttctacgagaccctgcccgccgagatgagaaagttcaccccccagtacaagggcaagagccagctgctggagggcctgccccactggagaggcgacgtgagagacagaggccacggcagaccctggcagcccagcctggagcccagcctgccccccaccctgtgcttccccagcctgagcagcttcagcagcagctggcccagcgcccagcacctgacccccagcgtgttcaacccctggtag

SEQ ID NO: 85211 - DNA, 264 bp, Artificial Sequence
  Description of Artificial Sequence: Synthetic coding sequence
atgagccccgccttcagagccatggacgtggagcccagagccaagggcgtgctgctggagcccttcgtgcaccaggtgggcggccacagctgcgtgctgagattcaacgagaccaccctgtgcaagcccctggtgcccagagagcaccagttctacgagaccctgcccgccgagatgagaaagttcaccccccagtacaagggcgacatcagcagccaccagcacggcggcgtgttcgtgggcgagtggggcagcctgctgtag

SEQ ID NO: 85212 - DNA, 567 bp, Artificial Sequence
  Description of Artificial Sequence: Synthetic coding sequence
atgaacctgtgccagagccccttccaggagggctgccagagcctgctggccagctggcccgagcaggccaaggagcccagaagagagggccacaccgacaagcagcagaccgaggacgtgctggccgccggcctgagatgcctgccccacctgcccgccatctgcgccagaagaatgagccccgccttcagagccatggacgtggagcccagagccaagggcgtgctgctggagcccttcgtgcaccaggtgggcggccacagctgcgtgctgagattcaacgagaccaccctgtgcaagcccctggtgcccagagagcaccagttctacgagaccctgcccgccgagatgagaaagttcaccccccagtacaagggcaagagccagctgctggagggcctgccccactggagaggcgacgtgagagacagaggccacggcagaccctggcagcccagcctggagcccagcctgccccccaccctgtgcttccccagcctgagcagcttcagcagcagctggcccagcgcccagcacctgacccccagcgtgttcaacccctggtag

SEQ ID NO: 85213 - DNA, 1233 bp, Artificial Sequence
  Description of Artificial Sequence: Synthetic coding sequence
atggtggtgcagaacagcgccgacgccggcgacatgagagccggcgtgcagctggagcccttcctgcaccaggtgggcggccacatgagcgtgatgaagtacgacgagcacaccgtgtgcaagcccctggtgagcagagagcagagattctacgagagcctgcccctggccatgaagagattcaccccccagtacaagggcaccgtgaccgtgcacctgtggaaggacagcaccggccacctgagcctggtggccaaccccgtgaaggagagccaggagcccttcaaggtgagcaccgagagcgccgccgtggccatctggcagaccctgcagcagaccaccggcagcaacggcagcgactgcaccctggcccagtggccccacgcccagctggccagaagccccaaggagagccccgccaaggccctgctgagaagcgagccccacctgaacacccccgccttcagcctggtggaggacaccaacggcaaccaggtggagagaaagagcttcaacccctggggcctgcagtgccaccaggcccacctgaccagactgtgcagcgagtaccccgagaacaagagacacagattcctgctgctggagaacgtggtgagccagtacacccacccctgcgtgctggacctgaagatgggcaccagacagcacggcgacgacgccagcgaggagaagaaggccagacacatgagaaagtgcgcccagagcaccagcgcctgcctgggcgtgagaatctgcggcatgcaggtgtaccagaccgacaagaagtacttcctgtgcaaggacaagtactacggcagaaagctgagcgtggagggcttcagacaggccctgtaccagttcctgcacaacggcagccacctgagaagagagctgctggagcccatcctgcaccagctgagagccctgctgagcgtgatcagaagccagagcagctacagattctacagcagcagcctgctggtgatctacgacggccaggagccccccgagagagcccccggcagcccccacccccacgaggccccccaggccgcccacggcagcagccccggcggcctgaccaaggtggacatcagaatgatcgacttcgcccacaccacctacaagggctactggaacgagcacaccacctacgacggccccgaccccggctacatcttcggcctggagaacctgatcagaatcctgcaggacatccaggagggcgagtag

SEQ ID NO: 85214 - DNA, 1233 bp, Artificial Sequence; identical to SEQ ID NO: 85213
  Description of Artificial Sequence: Synthetic coding sequence

SEQ ID NO: 85215 - DNA, 1080 bp, Artificial Sequence
  Description of Artificial Sequence: Synthetic coding sequence
atggcccccatgggcatcagactgagccccctgggcgtggccgtgttctgcctgctgggcctgggcgtgctgtaccacctgtacagcggcttcctggccggcagattcagcctgttcggcctgggcggcgagcccggcggcggcgccgccggccccgccgccgccgccgacggcggcaccgtggacctgagagagatgctggccgtgagcgtgctggccgccgtgagaggcggcgacgaggtgagaagagtgagagagagcaacgtgctgcacgagaagagcaagggcaagaccagagagggcgccgaggacaagatgaccagcggcgacgtgctgagcaacagaaagatgttctacctgctgaagaccgccttccccagcgtgcagatcaacaccgaggagcacgtggacgccgccgaccaggaggtgatcctgtgggaccacaagatccccgaggacatcctgaaggaggtgaccacccccaaggaggtgcccgccgagagcgtgaccgtgtggatcgaccccctggacgccacccaggagtacaccgaggacctgagaaagtacgtgaccaccatggtgtgcgtggccgtgaacggcaagcccatgctgggcgtgatccacaagcccttcagcgagtacaccgcctgggccatggtggacggcggcagcaacgtgaaggccagaagcagctacaacgagaagacccccagaatcgtggtgagcagaagccacagcggcatggtgaagcaggtggccctgcagaccttcggcaaccagaccaccatcatccccgccggcggcgccggctacaaggtgctggccctgctggacgtgcccgacaagagccaggagaaggccgacctgtacatccacgtgacctacatcaagaagtgggacatctgcgccggcaacgccatcctgaaggccctgggcggccacatgaccaccctgagcggcgaggagatcagctacaccggcagcgacggcatcgagggcggcctgctggccagcatcagaatgaaccaccaggccctggtgagaaagctgcccgacctggagaagaccggccacaagtag

SEQ ID NO: 85216 - DNA, 1251 bp, Artificial Sequence
  Description of Artificial Sequence: Synthetic coding sequence
atggccaccgagccccccagccccctgagagtggaggcccccggcccccccgagatgagaaccagccccgccatcgagagcacccccgagggcaccccccagcccgccggcggcagactgagattcctgaacggctgcgtgcccctgagccaccaggtggccggccacatgtacggcaaggacaaggtgggcatcctgcagcaccccgacggcaccgtgctgaagcagctgcagcccccccccagaggccccagagagctggagttctacaacatggtgtacgccgccgactgcttcgacggcgtgctgctggagctgagaaagtacctgcccaagtactacggcatctggagcccccccaccgcccccaacgacctgtacctgaagctggaggacgtgacccacaagttcaacaagccctgcatcatggacgtgaagatcggccagaagagctacgaccccttcgccagcagcgagaagatccagcagcaggtgagcaagtaccccctgatggaggagatcggcttcctggtgctgggcatgagagtgtaccacgtgcacagcgacagctacgagaccgagaaccagcactacggcagaagcctgaccaaggagaccatcaaggacggcgtgagcagattcttccacaacggctactgcctgagaaaggacgccgtggccgccagcatccagaagatcgagaagatcctgcagtggttcgagaaccagaagcagctgaacttctacgccagcagcctgctgttcgtgtacgagggcagcagccagcccaccaccaccaagctgaacgacagaaccctggccgagaagttcctgagcaagggccagctgagcgacaccgaggtgctggagtacaacaacaacttccacgtgctgagcagcaccgccaacggcaagatcgagagcagcgtgggcaagagcctgagcaagatgtacgccagacacagaaagatctacaccaagaagcaccacagccagaccagcctgaaggtggagaacctggagcaggacaacggctggaagagcatgagccaggagcacctgaacggcaacgtgctgagccagctggagaaggtgttctaccacctgcccaccggctgccaggagatcgccgaggtggaggtgagaatgatcgacttcgcccacgtgttccccagcaacaccatcgacgagggctacgtgtacggcctgaagcacctgatcagcgtgctgagaagcatcctggacaactag

SEQ ID NO: 85217 - DNA, 3777 bp, Artificial Sequence
  Description of Artificial Sequence: Synthetic coding sequence
atggccagcgcctgcggcgcccccggccccggcggcgccctgggcagccaggcccccagctggtaccacagagacctgagcagagccgccgccgaggagctgctggccagagccggcagagacggcagcttcctggtgagagacagcgagagcgtggccggcgccttcgccctgtgcgtgctgtaccagaagcacgtgcacacctacagaatcctgcccgacggcgaggacttcctggccgtgcagaccagccagggcgtgcccgtgagaagattccagaccctgggcgagctgatcggcctgtacgcccagcccaaccagggcctggtgtgcgccctgctgctgcccgtggagggcgagagagagcccgacccccccgacgacagagacgccagcgacggcgaggacgagaagccccccctgccccccagaagcggcagcaccagcatcagcgcccccaccggccccagcagccccctgcccgcccccgagacccccaccgcccccgccgccgagagcgcccccaacggcctgagcaccgtgagccacgactacctgaagggcagctacggcctggacctggaggccgtgagaggcggcgccagccacctgccccacctgaccagaaccctggccaccagctgcagaagactgcacagcgaggtggacaaggtgctgagcggcctggagatcctgagcaaggtgttcgaccagcagagcagccccatggtgaccagactgctgcagcagcagaacctgccccagaccggcgagcaggagctggagagcctggtgctgaagctgagcgtgctgaaggacttcctgagcggcatccagaagaaggccctgaaggccctgcaggacatgagcagcaccgccccccccgccccccagcccagcaccagaaaggccaagaccatccccgtgcaggccttcgaggtgaagctggacgtgaccctgggcgacctgaccaagatcggcaagagccagaagttcaccctgagcgtggacgtggagggcggcagactggtgctgctgagaagacagagagacagccaggaggactggaccaccttcacccacgacagaatcagacagctgatcaagagccagagagtgcagaacaagctgggcgtggtgttcgagaaggagaaggacagaacccagagaaaggacttcatcttcgtgagcgccagaaagagagaggccttctgccagctgctgcagctgatgaagaacaagcacagcaagcaggacgagcccgacatgatcagcgtgttcatcggcacctggaacatgggcagcgtgcccccccccaagaacgtgaccagctggttcaccagcaagggcctgggcaagaccctggacgaggtgaccgtgaccatcccccacgacatctacgtgttcggcacccaggagaacagcgtgggcgacagagagtggctggacctgctgagaggcggcctgaaggagctgaccgacctggactacagacccatcgccatgcagagcctgtggaacatcaaggtggccgtgctggtgaagcccgagcacgagaacagaatcagccacgtgagcaccagcagcgtgaagaccggcatcgccaacaccctgggcaacaagggcgccgtgggcgtgagcttcatgttcaacggcaccagcttcggcttcgtgaactgccacctgaccagcggcaacgagaagaccgccagaagaaaccagaactacctggacatcctgagactgctgagcctgggcgacagacagctgaacgccttcgacatcagcctgagattcacccacctgttctggttcggcgacctgaactacagactggacatggacatccaggagatcctgaactacatcagcagaaaggagttcgagcccctgctgagagtggaccagctgaacctggagagagagaagcacaaggtgttcctgagattcagcgaggaggagatcagcttcccccccacctacagatacgagagaggcagcagagacacctacgcctggcacaagcagaagcccaccggcgtgagaaccaacgtgcccagctggtgcgacagaatcctgtggaagagctaccccgagacccacatcatctgcaacagctacggctgcaccgacgacatcgtgaccagcgaccacagccccgtgttcggcaccttcgaggtgggcgtgaccagccagttcatcagcaagaagggcctgagcaagaccagcgaccaggcctacatcgagttcgagagcatcgaggccatcgtgaagaccgccagcagaaccaagttcttcatcgagttctacagcacctgcctggaggagtacaagaagagcttcgagaacgacgcccagagcagcgacaacatcaacttcctgaaggtgcagtggagcagcagacagctgcccaccctgaagcccatcctggccgacatcgagtacctgcaggaccagcacctgctgctgaccgtgaagagcatggacggctacgagagctacggcgagtgcgtggtggccctgaagagcatgatcggcagcaccgcccagcagttcctgaccttcctgagccacagaggcgaggagaccggcaacatcagaggcagcatgaaggtgagagtgcccaccgagagactgggcaccagagagagactgtacgagtggatcagcatcgacaaggacgaggccggcgccaagagcaaggcccccagcgtgagcagaggcagccaggagcccagaagcggcagcagaaagcccgccttcaccgaggccagctgccccctgagcagactgttcgaggagcccgagaagcccccccccaccggcagaccccccgccccccccagagccgcccccagagaggagcccctgacccccagactgaagcccgagggcgcccccgagcccgagggcgtggccgcccccccccccaagaacagcttcaacaaccccgcctactacgtgctggagggcgtgccccaccagctgctgccccccgagccccccagccccgccagagcccccgtgcccagcgccaccaagaacaaggtggccatcaccgtgcccgccccccagctgggccaccacagacaccccagagtgggcgagggcagcagcagcgacgaggagagcggcggcaccctgcccccccccgacttcccccccccccccctgcccgacagcgccatcttcctgccccccagcctggaccccctgcccggccccgtggtgagaggcagaggcggcgccgaggccagaggcccccccccccccaaggcccaccccagaccccccctgccccccggccccagccccgccagcaccttcctgggcgaggtggccagcggcgacgacagaagctgcagcgtgctgcagatggccaagaccctgagcgaggtggactacgcccccgccggccccgccagaagcgccctgctgcccggccccctggagctgcagccccccagaggcctgcccagcgactacggcagacccctgagcttccccccccccagaatcagagagagcatccaggaggacctggccgaggaggccccctgcctgcagggcggcagagccagcggcctgggcgaggccggcatgagcgcctggctgagagccatcggcctggagagatacgaggagggcctggtgcacaacggctgggacgacctggagttcctgagcgacatcaccgaggaggacctggaggaggccggcgtgcaggaccccgcccacaagagactgctgctggacaccctgcagctgagcaagtag

SEQ ID NO: 85218 - DNA, 105 bp, Artificial Sequence
  Description of Artificial Sequence: Synthetic coding sequence
atggtgaccagactgctgcagcagcagaacctgccccagaccggcgagcaggagctggagagcctggtgctgaagctgagcgtgctgaaggacttcctgagctag

SEQ ID NO: 85219 - DNA, 3051 bp, Artificial Sequence
  Description of Artificial Sequence: Synthetic coding sequence
atggtgaccagactgctgcagcagcagaacctgccccagaccggcgagcaggagctggagagcctggtgctgaagctgagcgtgctgaaggacttcctgagcggcatccagaagaaggccctgaaggccctgcaggacatgagcagcaccgccccccccgccccccagcccagcaccagaaaggccaagaccatccccgtgcaggccttcgaggtgaagctggacgtgaccctgggcgacctgaccaagatcggcaagagccagaagttcaccctgagcgtggacgtggagggcggcagactggtgctgctgagaagacagagagacagccaggaggactggaccaccttcacccacgacagaatcagacagctgatcaagagccagagagtgcagaacaagctgggcgtggtgttcgagaaggagaaggacagaacccagagaaaggacttcatcttcgtgagcgccagaaagagagaggccttctgccagctgctgcagctgatgaagaacaagcacagcaagcaggacgagcccgacatgatcagcgtgttcatcggcacctggaacatgggcagcgtgcccccccccaagaacgtgaccagctggttcaccagcaagggcctgggcaagaccctggacgaggtgaccgtgaccatcccccacgacatctacgtgttcggcacccaggagaacagcgtgggcgacagagagtggctggacctgctgagaggcggcctgaaggagctgaccgacctggactacagacccatcgccatgcagagcctgtggaacatcaaggtggccgtgctggtgaagcccgagcacgagaacagaatcagccacgtgagcaccagcagcgtgaagaccggcatcgccaacaccctgggcaacaagggcgccgtgggcgtgagcttcatgttcaacggcaccagcttcggcttcgtgaactgccacctgaccagcggcaacgagaagaccgccagaagaaaccagaactacctggacatcctgagactgctgagcctgggcgacagacagctgaacgccttcgacatcagcctgagattcacccacctgttctggttcggcgacctgaactacagactggacatggacatccaggagatcctgaactacatcagcagaaaggagttcgagcccctgctgagagtggaccagctgaacctggagagagagaagcacaaggtgttcctgagattcagcgaggaggagatcagcttcccccccacctacagatacgagagaggcagcagagacacctacgcctggcacaagcagaagcccaccggcgtgagaaccaacgtgcccagctggtgcgacagaatcctgtggaagagctaccccgagacccacatcatctgcaacagctacggctgcaccgacgacatcgtgaccagcgaccacagccccgtgttcggcaccttcgaggtgggcgtgaccagccagttcatcagcaagaagggcctgagcaagaccagcgaccaggcctacatcgagttcgagagcatcgaggccatcgtgaagaccgccagcagaaccaagttcttcatcgagttctacagcacctgcctggaggagtacaagaagagcttcgagaacgacgcccagagcagcgacaacatcaacttcctgaaggtgcagtggagcagcagacagctgcccaccctgaagcccatcctggccgacatcgagtacctgcaggaccagcacctgctgctgaccgtgaagagcatggacggctacgagagctacggcgagtgcgtggtggccctgaagagcatgatcggcagcaccgcccagcagttcctgaccttcctgagccacagaggcgaggagaccggcaacatcagaggcagcatgaaggtgagagtgcccaccgagagactgggcaccagagagagactgtacgagtggatcagcatcgacaaggacgaggccggcgccaagagcaaggcccccagcgtgagcagaggcagccaggagcccagaagcggcagcagaaagcccgccttcaccgaggccagctgccccctgagcagactgttcgaggagcccgagaagcccccccccaccggcagaccccccgccccccccagagccgcccccagagaggagcccctgacccccagactgaagcccgagggcgcccccgagcccgagggcgtggccgcccccccccccaagaacagcttcaacaaccccgcctactacgtgctggagggcgtgccccaccagctgctgccccccgagccccccagccccgccagagcccccgtgcccagcgccaccaagaacaaggtggccatcaccgtgcccgccccccagctgggccaccacagacaccccagagtgggcgagggcagcagcagcgacgaggagagcggcggcaccctgcccccccccgacttcccccccccccccctgcccgacagcgccatcttcctgccccccagcctggaccccctgcccggccccgtggtgagaggcagaggcggcgccgaggccagaggcccccccccccccaaggcccaccccagaccccccctgccccccggccccagccccgccagcaccttcctgggcgaggtggccagcggcgacgacagaagctgcagcgtgctgcagatggccaagaccctgagcgaggtggactacgcccccgccggccccgccagaagcgccctgctgcccggccccctggagctgcagccccccagaggcctgcccagcgactacggcagacccctgagcttccccccccccagaatcagagagagcatccaggaggacctggccgaggaggccccctgcctgcagggcggcagagccagcggcctgggcgaggccggcatgagcgcctggctgagagccatcggcctggagagatacgaggagggcctggtgcacaacggctgggacgacctggagttcctgagcgacatcaccgaggaggacctggaggaggccggcgtgcaggaccccgcccacaagagactgctgctggacaccctgcagctgagcaagtag

SEQ ID NO: 85220 - DNA, 69 bp, Artificial Sequence
  Description of Artificial Sequence: Synthetic coding sequence
atggccagcgcctgcggcgcccccggccccggcggcgccctgggcagccaggcccccagctggtactag

SEQ ID NO: 85221 - DNA, 3051 bp, Artificial Sequence; identical to SEQ ID NO: 85219
  Description of Artificial Sequence: Synthetic coding sequence

SEQ ID NO: 85222 - DNA, 57 bp, Artificial Sequence
  Description of Artificial Sequence: Synthetic coding sequence
atggccagcgcctgcggcgcccccggccccggcggcgccctgggcagccaggcctag

SEQ ID NO: 85223 - DNA, 474 bp, Artificial Sequence
  Description of Artificial Sequence: Synthetic coding sequence
atggtgaccagactgctgcagcagcagaacctgccccagaccggcgagcaggagctggagagcctggtgctgaagctgagcgtgctgaaggacttcctgagcggcatccagaagaaggccctgaaggccctgcaggacatgagcagcaccgccccccccgccccccagcccagcaccagaaaggccaagaccatccccgtgcaggccttcgaggtgaagctggacgtgaccctgggcgacctgaccaagatcggcaagagccagaagttcaccctgagcgtggacgtggagggcggcagactggtgctgctgagaagacagagagacagccaggaggactggaccaccttcacccacgacagaatcagacagctgatcaagagccagagagtgcagaacaagctgggcgtggtgttcgagaaggagaaggacagaacccagagaaaggacttcatcttcgtgagcgccagatag

SEQ ID NO: 85224 - DNA, 1200 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgccccaggacatcctgggcatctgggtggaccccatcgacagcacctaccagtacatcaagggcagcgccgacatcaagagcaaccagggcatcttcccctgcggcctgcagtgcgtgaccatcctgatcggcgtgtacgacatccagaccggcgtgcccctgatgggcgtgatcaaccagcccttcgtgagcagagaccccaacaccctgagatggaagggccagtgctactggggcctgagctacatgggcaccaacatgcacagcctgcagctgaccatcagcagaagaaacggcagcgagacccacaccggcaacaccggcagcgaggccgccttcagccccagcttcagcgccgtgatcagcaccagcgagaaggagaccatcaaggccgccctgagcagagtgtgcggcgacagaatcttcggcgccgccggcgccggctacaagagcctgtgcgtggtgcagggcctggtggacatctacatcttcagcgaggacaccaccttcaagtgggacagctgcgccgcccacgccatcctgagagccatgggcggcggcatcgtggacctgaaggagtgcctggagagaaaccccgagaccggcctggacctgccccagctggtgtaccacgtggagaacgagggcgccgccggcgtggacagatgggccaacaagggcggcctgatcgcctacagaagcagaaagagactggagaccttcctgagcctgctggtgcagaacctggcccccgccgagacccacacctag

SEQ ID NO: 85225 - DNA, 1200 bp, Artificial Sequence; identical to SEQ ID NO: 85224
  Description of Artificial Sequence: Synthetic coding sequence

SEQ ID NO: 85226 - DNA, 468 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgccccaggacatcctgggcatctgggtggaccccatctag

SEQ ID NO: 85227 - DNA, 267 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggtag

SEQ ID NO: 85228 - DNA, 639 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgccccaggacatcctgggcatctgggtggaccccatcgacagcacctaccagtacatcaagggcagcgccgacatcaagagcaaccagggcatcttcccctgcggcctgcagtgcgtgaccatcctgatcggcgtgtacgacatccagaccggcgtgcccctgatgggcgtgatcaaccagcccttcgtgagcagagaccccaacacctag

SEQ ID NO: 85229 - DNA, 30 bp, Artificial Sequence
  Description of Artificial Sequence: Synthetic coding sequence
atgagcgacatcctgagagagctgctgtag

SEQ ID NO: 85230 - DNA, 642 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgccccaggacatcctgggcatctgggtggaccccatcgacagcacctaccagtacatcaagggcagcgccgacatcaagagcaaccagggcatcttcccctgcggcctgcagtgcgtgaccatcctgatcggcgtgtacgacatccagaccggcgtgcccctgatgggcgtgatcaaccagcccttcgtgagcagagaccccaacaccctgtag

SEQ ID NO: 85231 - DNA, 573 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgccccaggacatcctgggcatctgggtggaccccatcgacagcacctaccagtacatcaagggcagcgccgacatcaagagcaaccagggcatcttcccctgcggcctgcagtgcgtgaccatcctgatcggcgtgtacgactag

SEQ ID NO: 85232 - DNA, 93 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagtag

SEQ ID NO: 85233 - DNA, 207 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagtag

SEQ ID NO: 85234 - DNA, 432 bp, Artificial Sequence
  Description of Artificial Sequence: Synthetic coding sequence
atgagcgacatcctgagagagctgctgtgcgtgagcgagaaggccgccaacatcgccagagcctgcagacagcaggaggccctgttccagctgctgatcgaggagaagaaggagggcgagaagaacaagaagttcgccgtggacttcaagaccctggccgacgtgctggtgcaggaggtgatcaagcagaacatggagaacaagttccccggcctggagaagaacatcttcggcgaggagagcaacgagttcaccaacgactggggcgagaagatcaccctgagactgtgcagcaccgaggaggagaccgccgagctgctgagcaaggtgctgaacggcaacaaggtggccagcgaggccctggccagagtggtgcaccaggacgtggccttcaccgaccccaccctggacagcaccgagatcaacgtgtag

SEQ ID NO: 85235 - DNA, 1200 bp, Artificial Sequence; identical to SEQ ID NO: 85224
  Description of Artificial Sequence: Synthetic coding sequence

SEQ ID NO: 85236 - DNA, 2934 bp, Artificial Sequence
  Description of Artificial Sequence: Synthetic coding sequence
atgaccgccagagagcacagccccagacacggcgccagagccagagccatgcagagagccagcaccatcgacgtggccgccgacatgctgggcctgagcctggccggcaacatccaggaccccgacgagcccatcctggagttcagcctggcctgcagcgagctgcacacccccagcctggacagaaagcccaacagcttcgtggccgtgagcgtgaccacccccccccaggccttctggaccaagcacgcccagaccgagatcatcgagggcaccaacaaccccatcttcctgagcagcatcgccttcttccaggacagcctgatcaaccagatgacccaggtgaagctgagcgtgtacgacgtgaaggacagaagccagggcaccatgtacctgctgggcagcggcaccttcatcgtgaaggacctgctgcaggacagacaccacagactgcacctgaccctgagaagcgccgagagcgacagagtgggcaacatcaccgtgatcggctggcagatggaggagaagagcgaccagagaccccccgtgaccagaagcgtggacaccgtgaacggcagaatggtgctgcccgtggacgagagcctgaccgaggccctgggcatcagaagcaagtacgccagcctgagaaaggacaccctgctgaagagcgtgttcggcggcgccatctgcagaatgtacagattccccaccaccgacggcaaccacctgagaatcctggagcagatggccgagagcgtgctgagcctgcacgtgcccagacagttcgtgaagctgctgctggaggaggacgccgccagagtgtgcgagctggaggagctgggcgagctgagcccctgctgggagagcctgagaagacagatcgtgacccagtaccagaccatcatcctgacctaccaggagaacctgaccgacctgcaccagtacagaggccccagcttcaaggccagcagcctgaaggccgacaagaagctggagttcgtgcccaccaacctgcacatccagagaatgagagtgcaggacgacggcggcagcgaccagaactacgacatcgtgaccatcggcgcccccgccgcccactgccagggcttcaagagcggcggcctgagaaagaagctgcacaagttcgaggagaccaagaagcacttcgaggagtgctgcaccagcagcggctgccagagcatcatctacatcccccaggacgtggtgagagccaaggagatcatcgcccagatcaacaccctgaagacccaggtgagctactacgccgagagactgagcagagccgccaaggacagaagcgccaccggcctggagagaaccctggccatcctggccgacaagaccagacagctggtgaccgtgtgcgactgcaagctgctggccaacagcatccacggcctgaacgccgccagacccgactacatcgccagcaaggccagccccaccagcaccgaggaggagcaggtgatgctgagaaacgaccaggacaccctgatggccagatggaccggcagaaacagcagaagcagcctgcaggtggactggcacgaggaggagtgggagaaggtgtggctgaacgtggacaagagcctggagtgcatcatccagagagtggacaagctgctgcagaaggagagactgcacggcgagggctgcgaggacgtgttcccctgcgccggcagctgcaccagcaagaagggcaaccccgacagccacgcctactggatcagacccgaggaccccttctgcgacgtgcccagcagcccctgccccagcaccatgcccagcaccgcctgccacccccacctgaccacccactgcagccccccccccgaggagagcagccccggcgagtggagcgaggccctgtaccccctgctgaccaccctgaccgactgcgtggccatgatgagcgacaaggccaagaaggccatggtgttcctgctgatgcaggacagcgcccccaccatcgccacctacctgagcctgcagtacagaagagacgtggtgttctgccagaccctgaccgccctgatctgcggcttcatcatcaagctgagaaactgcctgcacgacgacggcttcctgagacagctgtacaccatcggcctgctggcccagttcgagagcctgctgagcacctacggcgaggagctggccatgctggaggacatgagcctgggcatcatggacctgagaaacgtgaccttcaaggtgacccaggccaccagcagcgccagcgccgacatgctgcccgtgatcaccggcaacagagacggcttcaacgtgagagtgcccctgcccggccccctgttcgacgccctgcccagagagatccagagcggcatgctgctgagagtgcagcccgtgctgttcaacgtgggcatcaacgagcagcagaccctggccgagagattcggcgacaccagcctgcaggaggtgatcaacgtggagagcctggtgagactgaacagctacttcgagcagttcaaggaggtgctgcccgaggactgcctgcccagaagcagaagccagacctgcctgcccgagctgctgagattcctgggccagaacgtgcacgccagaaagaacaagaacgtggacatcctgtggcaggccgccgagatctgcagaagactgaacggcgtgagattcaccagctgcaagagcgccaaggacagaaccgccatgagcgtgaccctggagcagtgcctgatcctgcagcacgagcacggcatggccccccaggtgttcacccaggccctggagtgcatgagaagcgagggctgcagaagagagaacaccatgaagaacgtgggcagcagaaagtacgccttcaacagcctgcagctgaaggccttccccaagcactacagaccccccgagggcacctacggcaaggtggagacctag

SEQ ID NO: 85237 - DNA, 2817 bp, Artificial Sequence
  Description of Artificial Sequence: Synthetic coding sequence
atgaccgccagagagcacagccccagacacggcgccagagccagagccatgcagagagccagcaccatcgacgtggccgccgacatgctgggcctgagcctggccggcaacatccaggaccccgacgagcccatcctggagttcagcctggcctgcagcgagctgcacacccccagcctggacagaaagcccaacagcttcgtggccgtgagcgtgaccacccccccccaggccttctggaccaagcacgcccagaccgagatcatcgagggcaccaacaaccccatcttcctgagcagcatcgccttcttccaggacagcctgatcaaccagatgacccaggtgaagctgagcgtgtacgacgtgaaggacagaagccagggcaccatgtacctgctgggcagcggcaccttcatcgtgaaggacctgctgcaggacagacaccacagactgcacctgaccctgagaagcgccgagagcgacagagtgggcaacatcaccgtgatcggctggcagatggaggagaagagcgaccagagaccccccgtgaccagaagcgtggacaccgtgaacggcagaatggtgctgcccgtggacgagagcctgaccgaggccctgggcatcagaagcaagtacgccagcctgagaaaggacaccctgctgaagagcgtgttcggcggcgccatctgcagaatgtacagattccccaccaccgacggcaaccacctgagaatcctggagcagatggccgagagcgtgctgagcctgcacgtgcccagacagttcgtgaagctgctgctggaggaggacgccgccagagtgtgcgagctggaggagctgggcgagctgagcccctgctgggagagcctgagaagacagatcgtgacccagtaccagaccatcatcctgacctaccaggagaacctgaccgacctgcaccagtacagaggccccagcttcaaggccagcagcctgaaggccgacaagaagctggagttcgtgcccaccaacctgcacatccagagaatgagagtgcaggacgacggcggcagcgaccagaactacgacatcgtgaccatcggcgcccccgccgcccactgccagggcttcaagagcggcggcctgagaaagaagctgcacaagttcgaggagaccaagaagcacttcgaggagtgctgcaccagcagcggctgccagagcatcatctacatcccccaggacgtggtgagagccaaggagatcatcgcccagatcaacaccctgaagacccaggtgagctactacgccgagagactgagcagagccgccaaggacagaagcgccaccggcctggagagaaccctggccatcctggccgacaagaccagacagctggtgaccgtgtgcgactgcaagctgctggccaacagcatccacggcctgaacgccgccagacccgactacatcgccagcaaggccagccccaccagcaccgaggaggagcaggtgatgctgagaaacgaccaggacaccctgatggccagatggaccggcagaaacagcagaagcagcctgcaggtggactggcacgaggaggagtgggagaaggtgtggctgaacgtggacaagagcctggagtgcatcatccagagagtggacaagctgctgcagaaggagagactgcacggcgagggctgcgaggacgtgttcccctgcgccggcagctgcaccagcaagaaggactgcagccccccccccgaggagagcagccccggcgagtggagcgaggccctgtaccccctgctgaccaccctgaccgactgcgtggccatgatgagcgacaaggccaagaaggccatggtgttcctgctgatgcaggacagcgcccccaccatcgccacctacctgagcctgcagtacagaagagacgtggtgttctgccagaccctgaccgccctgatctgcggcttcatcatcaagctgagaaactgcctgcacgacgacggcttcctgagacagctgtacaccatcggcctgctggcccagttcgagagcctgctgagcacctacggcgaggagctggccatgctggaggacatgagcctgggcatcatggacctgagaaacgtgaccttcaaggtgacccaggccaccagcagcgccagcgccgacatgctgcccgtgatcaccggcaacagagacggcttcaacgtgagagtgcccctgcccggccccctgttcgacgccctgcccagagagatccagagcggcatgctgctgagagtgcagcccgtgctgttcaacgtgggcatcaacgagcagcagaccctggccgagagattcggcgacaccagcctgcaggaggtgatcaacgtggagagcctggtgagactgaacagctacttcgagcagttcaaggaggtgctgcccgaggactgcctgcccagaagcagaagccagacctgcctgcccgagctgctgagattcctgggccagaacgtgcacgccagaaagaacaagaacgtggacatcctgtggcaggccgccgagatctgcagaagactgaacggcgtgagattcaccagctgcaagagcgccaaggacagaaccgccatgagcgtgaccctggagcagtgcctgatcctgcagcacgagcacggcatggccccccaggtgttcacccaggccctggagtgcatgagaagcgagggctgcagaagagagaacaccatgaagaacgtgggcagcagaaagtacgccttcaacagcctgcagctgaaggccttccccaagcactacagaccccccgagggcacctacggcaaggtggagacctag

SEQ ID NO: 85238 - DNA, 2865 bp, Artificial Sequence
  Description of Artificial Sequence: Synthetic coding sequence
atgaccgccagagagcacagccccagacacggcgccagagccagagccatgcagagagccagcaccatcgacgtggccgccgacatgctgggcctgagcctggccggcaacatccaggaccccgacgagcccatcctggagttcagcctggcctgcagcgagctgcacacccccagcctggacagaaagcccaacagcttcgtggccgtgagcgtgaccacccccccccaggccttctggaccaagcacgcccagaccgagatcatcgagggcaccaacaaccccatcttcctgagcagcatcgccttcttccaggacagcctgatcaaccagatgacccaggtgaagctgagcgtgtacgacgtgaaggacagaagccagggcaccatgtacctgctgggcagcggcaccttcatcgtgaaggacctgctgcaggacagacaccacagactgcacctgaccctgagaagcgccgagagcgacagagtgggcaacatcaccgtgatcggctggcagatggaggagaagagcgaccagagaccccccgtgaccagaagcgtggacaccgtgaacggcagaatggtgctgcccgtggacgagagcctgaccgaggccctgggcatcagaagcaagtacgccagcctgagaaaggacaccctgctgaagagcgtgttcggcggcgccatctgcagaatgtacagattccccaccaccgacggcaaccacctgagaatcctggagcagatggccgagagcgtgctgagcctgcacgtgcccagacagttcgtgaagctgctgctggaggaggacgccgccagagtgtgcgagctggaggagctgggcgagctgagcccctgctgggagagcctgagaagacagatcgtgacccagtaccagaccatcatcctgacctaccaggagaacctgaccgacctgcaccagtacagaggccccagcttcaaggccagcagcctgaaggccgacaagaagctggagttcgtgcccaccaacctgcacatccagagaatgagagtgcaggacgacggcggcagcgaccagaactacgacatcgtgaccatcggcgcccccgccgcccactgccagggcttcaagagcggcggcctgagaaagaagctgcacaagttcgaggagaccaagaagcacttcgaggagtgctgcaccagcagcggctgccagagcatcatctacatcccccaggacgtggtgagagccaaggagatcatcgcccagatcaacaccctgaagacccaggtgagctactacgccgagagactgagcagagccgccaaggacagaagcgccaccggcctggagagaaccctggccatcctggccgacaagaccagacagctggtgaccgtgtgcgactgcaagctgctggccaacagcatccacggcctgaacgccgccagacccgactacatcgccagcaaggccagccccaccagcaccgaggaggagcaggtgatgctgagaaacgaccaggacaccctgatggccagatggaccggcagaaacagcagaagcagcctgcaggtggactggcacgaggaggagtgggagaaggtgtggctgaacgtggacaagagcctggagtgcatcatccagagagtggacaagctgctgcagaaggagagactgcacggcgagggctgcgaggacgtgttcccctgcgccggcagctgcaccagcaagaaggactgcagccccccccccgaggagagcagccccggcgagtggagcgaggccctgtaccccctgctgaccaccctgaccgactgcgtggccatgatgagcgacaaggccaagaaggccatggtgttcctgctgatgcaggacagcgcccccaccatcgccacctacctgagcctgcagtacagaagagacgtggtgttctgccagaccctgaccgccctgatctgcggcttcatcatcaagctgagaaactgcctgcacgacgacggcttcctgagacagctgtacaccatcggcctgctggcccagttcgagagcctgctgagcacctacggcgaggagctggccatgctggaggacatgagcctgggcatcatggacctgagaaacgtgaccttcaaggtgacccaggccaccagcagcgccagcgccgacatgctgcccgtgatcaccggcaacagagacggcttcaacgtgagagtgcccctgcccggccccctgttcgacgccctgcccagagagatccagagcggcatgctgctgagagtgcagcccgtgctgttcaacgtgggcatcaacgagcagcagaccctggccgagagattcggcgacaccagcctgcaggaggtgatcaacgtggagagcctggtgagactgaacagctacttcgagcagttcaaggaggtgctgcccgaggactgcctgcccagaagcagaagccagacctgcctgcccgagctgctgagattcctgggccagaacgtgcacgccagaaagaacaagaacgtggacatcctgtggcaggccgccgagatctgcagaagactgaacggcgtgagattcaccagctgcaagagcgccaaggacagaaccgccatgagcgtgaccctggagcagtgcctgatcctgcagcacgagcacggcatggccccccaggtgttcacccaggccctggagtgcatgagaagcatcggcaccagagaggtggtgacccagaagaacctgagcggcctggtgcccatcagagacctgagactggaccccagcctgctgtgcagcatccccctgctggccctgagccccaacctgctgatcgtgtggctgttcctgagcatcgcctacctggtgaccaagctgagatgcaagtag

SEQ ID NO: 85239 - DNA, 2919 bp, Artificial Sequence
  Description of Artificial Sequence: Synthetic coding sequence
atgaccgccagagagcacagccccagacacggcgccagagccagagccatgcagagagccagcaccatcgacgtggccgccgacatgctgggcctgagcctggccggcaacatccaggaccccgacgagcccatcctggagttcagcctggcctgcagcgagctgcacacccccagcctggacagaaagcccaacagcttcgtggccgtgagcgtgaccacccccccccaggccttctggaccaagcacgcccagaccgagatcatcgagggcaccaacaaccccatcttcctgagcagcatcgccttcttccaggacagcctgatcaaccagatgacccaggtgaagctgagcgtgtacgacgtgaaggacagaagccagggcaccatgtacctgctgggcagcggcaccttcatcgtgaaggacctgctgcaggacagacaccacagactgcacctgaccctgagaagcgccgagagcgacagagtgggcaacatcaccgtgatcggctggcagatggaggagaagagcgaccagagaccccccgtgaccagaagcgtggacaccgtgaacggcagaatggtgctgcccgtggacgagagcctgaccgaggccctgggcatcagaagcaagtacgccagcctgagaaaggacaccctgctgaagagcgtgttcggcggcgccatctgcagaatgtacagattccccaccaccgacggcaaccacctgagaatcctggagcagatggccgagagcgtgctgagcctgcacgtgcccagacagttcgtgaagctgctgctggaggaggacgccgccagagtgtgcgagctggaggagctgggcgagctgagcccctgctgggagagcctgagaagacagatcgtgacccagtaccagaccatcatcctgacctaccaggagaacctgaccgacctgcaccagtacagaggccccagcttcaaggccagcagcctgaaggccgacaagaagctggagttcgtgcccaccaacctgcacatccagagaatgagagtgcaggacgacggcggcagcgaccagaactacgacatcgtgaccatcggcgcccccgccgcccactgccagggcttcaagagcggcggcctgagaaagaagctgcacaagttcgaggagaccaagaagcacaccagcagcggctgccagagcatcatctacatcccccaggacgtggtgagagccaaggagatcatcgcccagatcaacaccctgaagacccaggtgagctactacgccgagagactgagcagagccgccaaggacagaagcgccaccggcctggagagaaccctggccatcctggccgacaagaccagacagctggtgaccgtgtgcgactgcaagctgctggccaacagcatccacggcctgaacgccgccagacccgactacatcgccagcaaggccagccccaccagcaccgaggaggagcaggtgatgctgagaaacgaccaggacaccctgatggccagatggaccggcagaaacagcagaagcagcctgcaggtggactggcacgaggaggagtgggagaaggtgtggctgaacgtggacaagagcctggagtgcatcatccagagagtggacaagctgctgcagaaggagagactgcacggcgagggctgcgaggacgtgttcccctgcgccggcagctgcaccagcaagaagggcaaccccgacagccacgcctactggatcagacccgaggaccccttctgcgacgtgcccagcagcccctgccccagcaccatgcccagcaccgcctgccacccccacctgaccacccactgcagccccccccccgaggagagcagccccggcgagtggagcgaggccctgtaccccctgctgaccaccctgaccgactgcgtggccatgatgagcgacaaggccaagaaggccatggtgttcctgctgatgcaggacagcgcccccaccatcgccacctacctgagcctgcagtacagaagagacgtggtgttctgccagaccctgaccgccctgatctgcggcttcatcatcaagctgagaaactgcctgcacgacgacggcttcctgagacagctgtacaccatcggcctgctggcccagttcgagagcctgctgagcacctacggcgaggagctggccatgctggaggacatgagcctgggcatcatggacctgagaaacgtgaccttcaaggtgacccaggccaccagcagcgccagcgccgacatgctgcccgtgatcaccggcaacagagacggcttcaacgtgagagtgcccctgcccggccccctgttcgacgccctgcccagagagatccagagcggcatgctgctgagagtgcagcccgtgctgttcaacgtgggcatcaacgagcagcagaccctggccgagagattcggcgacaccagcctgcaggaggtgatcaacgtggagagcctggtgagactgaacagctacttcgagcagttcaaggaggtgctgcccgaggactgcctgcccagaagcagaagccagacctgcctgcccgagctgctgagattcctgggccagaacgtgcacgccagaaagaacaagaacgtggacatcctgtggcaggccgccgagatctgcagaagactgaacggcgtgagattcaccagctgcaagagcgccaaggacagaaccgccatgagcgtgaccctggagcagtgcctgatcctgcagcacgagcacggcatggccccccaggtgttcacccaggccctggagtgcatgagaagcgagggctgcagaagagagaacaccatgaagaacgtgggcagcagaaagtacgccttcaacagcctgcagctgaaggccttccccaagcactacagaccccccgagggcacctacggcaaggtggagacctag

SEQ ID NO: 85240 - DNA, 2934 bp, Artificial Sequence; identical to SEQ ID NO: 85236
  Description of Artificial Sequence: Synthetic coding sequence

SEQ ID NO: 85241 - DNA, 2817 bp, Artificial Sequence
  Description of Artificial Sequence: Synthetic coding sequence
atgaccgccagagagcacagccccagacacggcgccagagccagagccatgcagagagccagcaccatcgacgtggccgccgacatgctgggcctgagcctggccggcaacatccaggaccccgacgagcccatcctggagttcagcctggcctgcagcgagctgcacacccccagcctggacagaaagcccaacagcttcgtggccgtgagcgtgaccacccccccccaggccttctggaccaagcacgcccagaccgagatcatcgagggcaccaacaaccccatcttcctgagcagcatcgccttcttccaggacagcctgatcaaccagatgacccaggtgaagctgagcgtgtacgacgtgaaggacagaagccagggcaccatgtacctgctgggcagcggcaccttcatcgtgaaggacctgctgcaggacagacaccacagactgcacctgaccctgagaagcgccgagagcgacagagtgggcaacatcaccgtgatcggctggcagatggaggagaagagcgaccagagaccccccgtgaccagaagcgtggacaccgtgaacggcagaatggtgctgcccgtggacgagagcctgaccgaggccctgggcatcagaagcaagtacgccagcctgagaaaggacaccctgctgaagagcgtgttcggcggcgccatctgcagaatgtacagattccccaccaccgacggcaaccacctgagaatcctggagcagatggccgagagcgtgctgagcctgcacgtgcccagacagttcgtgaagctgctgctggaggaggacgccgccagagtgtgcgagctggaggagctgggcgagctgagcccctgctgggagagcctgagaagacagatcgtgacccagtaccagaccatcatcctgacctaccaggagaacctgaccgacctgcaccagtacagaggccccagcttcaaggccagcagcctgaaggccgacaagaagctggagttcgtgcccaccaacctgcacatccagagaatgagagtgcaggacgacggcggcagcgaccagaactacgacatcgtgaccatcggcgcccccgccgcccactgccagggcttcaagagcggcggcctgagaaagaagctgcacaagttcgaggagaccaagaagcagcaggaggagagcagaaccagcagcggctgccagagcatcatctacatcccccaggacgtggtgagagccaaggagatcatcgcccagatcaacaccctgaagacccaggtgagctactacgccgagagactgagcagagccgccaaggacagaagcgccaccggcctggagagaaccctggccatcctggccgacaagaccagacagctggtgaccgtgtgcgactgcaagctgctggccaacagcatccacggcctgaacgccgccagacccgactacatcgccagcaaggccagccccaccagcaccgaggaggagcaggtgatgctgagaaacgaccaggacaccctgatggccagatggaccggcagaaacagcagaagcagcctgcaggtggactggcacgaggaggagtgggagaaggtgtggctgaacgtggacaagagcctggagtgcatcatccagagagtggacaagctgctgcagaaggagagactgcacggcgagggctgcgaggacgtgttcccctgcgccggcagctgcaccagcaagaaggactgcagccccccccccgaggagagcagccccggcgagtggagcgaggccctgtaccccctgctgaccaccctgaccgactgcgtggccatgatgagcgacaaggccaagaaggccatggtgttcctgctgatgcaggacagcgcccccaccatcgccacctacctgagcctgcagtacagaagagacgtggtgttctgccagaccctgaccgccctgatctgcggcttcatcatcaagctgagaaactgcctgcacgacgacggcttcctgagacagctgtacaccatcggcctgctggcccagttcgagagcctgctgagcacctacggcgaggagctggccatgctggaggacatgagcctgggcatcatggacctgagaaacgtgaccttcaaggtgacccaggccaccagcagcgccagcgccgacatgctgcccgtgatcaccggcaacagagacggcttcaacgtgagagtgcccctgcccggccccctgttcgacgccctgcccagagagatccagagcggcatgctgctgagagtgcagcccgtgctgttcaacgtgggcatcaacgagcagcagaccctggccgagagattcggcgacaccagcctgcaggaggtgatcaacgtggagagcctggtgagactgaacagctacttcgagcagttcaaggaggtgctgcccgaggactgcctgcccagaagcagaagccagacctgcctgcccgagctgctgagattcctgggccagaacgtgcacgccagaaagaacaagaacgtggacatcctgtggcaggccgccgagatctgcagaagactgaacggcgtgagattcaccagctgcaagagcgccaaggacagaaccgccatgagcgtgaccctggagcagtgcctgatcctgcagcacgagcacggcatggccccccaggtgttcacccaggccctggagtgcatgagaagcgagggctgcagaagagagaacaccatgaagaacgtgggcagcagaaagtacgccttcaacagcctgcagctgaaggccttccccaagcactacagaccccccgagggcacctacggcaaggtggagacctag

SEQ ID NO: 85242 - DNA, 3021 bp, Artificial Sequence
  Description of Artificial Sequence: Synthetic coding sequence
atggagggccagagcagcagaggcagcagaagacccggcaccagagccggcctgggcagcctgcccatgccccagggcgtggcccagaccggcgcccccagcaaggtggacagcagcttccagctgcccgccaagaagaacgccgccctgggccccagcgagcccagactggccctggcccccgtgggccccagagccgccatgagcgccagcagcgagggccccagactggccctggccagccccagacccatcctggcccccctgtgcacccccgagggccagaagaccgccaccgcccacagaagcagcagcctggcccccaccagcgtgggccagctggtgatgagcgccagcgccggccccaagcccccccccgccaccaccggcagcgtgctggcccccaccagcctgggcctggtgatgcccgccagcgccggccccagaagcccccccgtgaccctgggccccaacctggcccccaccagcagagaccagaagcaggagccccccgccagcgtgggccccaagcccaccctggccgccagcggcctgagcctggccctggccagcgaggagcagccccccgagctgcccagcacccccagccccgtgcccagccccgtgctgagccccacccaggagcaggccctggcccccgccagcaccgccagcggcgccgccagcgtgggccagaccagcgccagaaagagagacgcccccgcccccagacccctgcccgccagcgagggccacctgcagccccccgcccagaccagcggccccaccggcagccccccctgcatccagaccagccccgaccccagactgagccccagcttcagagccagacccgaggccctgcacagcagccccgaggaccccgtgctgcccagacccccccagaccctgcccctggacgtgggccagggccccagcgagcccggcacccacagccccggcctgctgagccccaccttcagacccggcgcccccagcggccagaccgtgcccccccccctgcccaagccccccagaagccccagcagaagccccagccacagccccaacagaagcccctgcgtgccccccgcccccgacatggccctgcccagactgggcacccagagcaccggccccggcagatgcctgagccccaacctgcaggcccaggaggcccccgcccccgtgaccaccagcagcagcaccagcaccctgagcagcagcccctggagcgcccagcccacctggaagagcgaccccggcttcagaatcaccgtggtgacctggaacgtgggcaccgccatgccccccgacgacgtgaccagcctgctgcacctgggcggcggcgacgacagcgacggcgccgacatgatcgccatcggcctgcaggaggtgaacagcatgctgaacaagagactgaaggacgccctgttcaccgaccagtggagcgagctgttcatggacgccctgggccccttcaacttcgtgctggtgagcagcgtgagaatgcagggcgtgatcctgctgctgttcgccaagtactaccacctgcccttcctgagagacgtgcagaccgactgcaccagaaccggcctgggcggctactggggcaacaagggcggcgtgagcgtgagactggccgccttcggccacatgctgtgcttcctgaactgccacctgcccgcccacatggacaaggccgagcagagaaaggacaacttccagaccatcctgagcctgcagcagttccagggccccggcgcccagggcatcctggaccacgacctggtgttctggttcggcgacctgaacttcagaatcgagagctacgacctgcacttcgtgaagttcgccatcgacagcgaccagctgcaccagctgtgggagaaggaccagctgaacatggccaagaacacctggcccatcctgaagggcttccaggagggccccctgaacttcgcccccaccttcaagttcgacgtgggcaccaacaagtacgacaccagcgccaagaagagaaagcccgcctggaccgacagaatcctgtggaaggtgaaggcccccggcggcggccccagccccagcggcagaaagagccacagactgcaggtgacccagcacagctacagaagccacatggagtacaccgtgagcgaccacaagcccgtggccgcccagttcctgctgcagttcgccttcagagacgacatgcccctggtgagactggaggtggccgacgagtgggtgagacccgagcaggccgtggtgagatacagaatggagaccgtgttcgccagaagcagctgggactggatcggcctgtacagagtgggcttcagacactgcaaggactacgtggcctacgtgtgggccaagcacgaggacgtggacggcaacacctaccaggtgaccttcagcgaggagagcctgcccaagggccacggcgacttcatcctgggctactacagccacaaccacagcatcctgatcggcatcaccgagcccttccagatcagcctgcccagcagcgagctggccagcagcagcaccgacagcagcggcaccagcagcgagggcgaggacgacagcaccctggagctgctggcccccaagagcagaagccccagccccggcaagagcaagagacacagaagcagaagccccggcctggccagattccccggcctggccctgagacccagcagcagagagagaagaggcgccagcagaagccccagcccccagagcagaagactgagcagagtggcccccgacagaagcagcaacggcagcagcagaggcagcagcgaggagggccccagcggcctgcccggcccctgggccttcccccccgccgtgcccagaagcctgggcctgctgcccgccctgagactggagaccgtggaccccggcggcggcggcagctggggccccgacagagaggccctggcccccaacagcctgagccccagcccccagggccacagaggcctggaggagggcggcctgggcccctag

SEQ ID NO: 85243 - DNA, 1920 bp, Artificial Sequence
  Description of Artificial Sequence: Synthetic coding sequence
atggccctgcccagactgggcacccagagcaccggccccggcagatgcctgagccccaacctgcaggcccaggaggcccccgcccccgtgaccaccagcagcagcaccagcaccctgagcagcagcccctggagcgcccagcccacctggaagagcgaccccggcttcagaatcaccgtggtgacctggaacgtgggcaccgccatgccccccgacgacgtgaccagcctgctgcacctgggcggcggcgacgacagcgacggcgccgacatgatcgccatcggcctgcaggaggtgaacagcatgctgaacaagagactgaaggacgccctgttcaccgaccagtggagcgagctgttcatggacgccctgggccccttcaacttcgtgctggtgagcagcgtgagaatgcagggcgtgatcctgctgctgttcgccaagtactaccacctgcccttcctgagagacgtgcagaccgactgcaccagaaccggcctgggcggctactggggcaacaagggcggcgtgagcgtgagactggccgccttcggccacatgctgtgcttcctgaactgccacctgcccgcccacatggacaaggccgagcagagaaaggacaacttccagaccatcctgagcctgcagcagttccagggccccggcgcccagggcatcctggaccacgacctggtgttctggttcggcgacctgaacttcagaatcgagagctacgacctgcacttcgtgaagttcgccatcgacagcgaccagctgcaccagctgtgggagaaggaccagctgaacatggccaagaacacctggcccatcctgaagggcttccaggagggccccctgaacttcgcccccaccttcaagttcgacgtgggcaccaacaagtacgacaccagcgccaagaagagaaagcccgcctggaccgacagaatcctgtggaaggtgaaggcccccggcggcggccccagccccagcggcagaaagagccacagactgcaggtgacccagcacagctacagaagccacatggagtacaccgtgagcgaccacaagcccgtggccgcccagttcctgctgcagttcgccttcagagacgacatgcccctggtgagactggaggtggccgacgagtgggtgagacccgagcaggccgtggtgagatacagaatggagaccgtgttcgccagaagcagctgggactggatcggcctgtacagagtgggcttcagacactgcaaggactacgtggcctacgtgtgggccaagcacgaggacgtggacggcaacacctaccaggtgaccttcagcgaggagagcctgcccaagggccacggcgacttcatcctgggctactacagccacaaccacagcatcctgatcggcatcaccgagcccttccagatcagcctgcccagcagcgagctggccagcagcagcaccgacagcagcggcaccagcagcgagggcgaggacgacagcaccctggagctgctggcccccaagagcagaagccccagccccggcaagagcaagagacacagaagcagaagccccggcctggccagattccccggcctggccctgagacccagcagcagagagagaagaggcgccagcagaagccccagcccccagagcagaagactgagcagagtggcccccgacagaagcagcaacggcagcagcagaggcagcagcgaggagggccccagcggcctgcccggcccctgggccttcccccccgccgtgcccagaagcctgggcctgctgcccgccctgagactggagaccgtggaccccggcggcggcggcagctggggccccgacagagaggccctggcccccaacagcctgagccccagcccccagggccacagaggcctggaggagggcggcctgggcccctag

SEQ ID NO: 85244 - DNA, 1917 bp, Artificial Sequence
  Description of Artificial Sequence: Synthetic coding sequence
atggagggccagagcagcagaggcagcagaagacccggcaccagagccggcctgggcagcctgcccatgccccagggcgtggcccagaccggcgcccccagcaaggtggacagcagcttccagctgcccgccaagaagaacgccgccctgggccccagcgagcccagaatcaccgtggtgacctggaacgtgggcaccgccatgccccccgacgacgtgaccagcctgctgcacctgggcggcggcgacgacagcgacggcgccgacatgatcgccatcggcctgcaggaggtgaacagcatgctgaacaagagactgaaggacgccctgttcaccgaccagtggagcgagctgttcatggacgccctgggccccttcaacttcgtgctggtgagcagcgtgagaatgcagggcgtgatcctgctgctgttcgccaagtactaccacctgcccttcctgagagacgtgcagaccgactgcaccagaaccggcctgggcggctactggggcaacaagggcggcgtgagcgtgagactggccgccttcggccacatgctgtgcttcctgaactgccacctgcccgcccacatggacaaggccgagcagagaaaggacaacttccagaccatcctgagcctgcagcagttccagggccccggcgcccagggcatcctggaccacgacctggtgttctggttcggcgacctgaacttcagaatcgagagctacgacctgcacttcgtgaagttcgccatcgacagcgaccagctgcaccagctgtgggagaaggaccagctgaacatggccaagaacacctggcccatcctgaagggcttccaggagggccccctgaacttcgcccccaccttcaagttcgacgtgggcaccaacaagtacgacaccagcgccaagaagagaaagcccgcctggaccgacagaatcctgtggaaggtgaaggcccccggcggcggccccagccccagcggcagaaagagccacagactgcaggtgacccagcacagctacagaagccacatggagtacaccgtgagcgaccacaagcccgtggccgcccagttcctgctgcagttcgccttcagagacgacatgcccctggtgagactggaggtggccgacgagtgggtgagacccgagcaggccgtggtgagatacagaatggagaccgtgttcgccagaagcagctgggactggatcggcctgtacagagtgggcttcagacactgcaaggactacgtggcctacgtgtgggccaagcacgaggacgtggacggcaacacctaccaggtgaccttcagcgaggagagcctgcccaagggccacggcgacttcatcctgggctactacagccacaaccacagcatcctgatcggcatcaccgagcccttccagatcagcctgcccagcagcgagctggccagcagcagcaccgacagcagcggcaccagcagcgagggcgaggacgacagcaccctggagctgctggcccccaagagcagaagccccagccccggcaagagcaagagacacagaagcagaagccccggcctggccagattccccggcctggccctgagacccagcagcagagagagaagaggcgccagcagaagccccagcccccagagcagaagactgagcagagtggcccccgacagaagcagcaacggcagcagcagaggcagcagcgaggagggccccagcggcctgcccggcccctgggccttcccccccgccgtgcccagaagcctgggcctgctgcccgccctgagactggagaccgtggaccccggcggcggcggcagctggggccccgacagagaggccctggcccccaacagcctgagccccagcccccagggccacagaggcctggaggagggcggcctgggcccctag

SEQ ID NO: 85245 - DNA, 1920 bp, Artificial Sequence; identical to SEQ ID NO: 85243
  Description of Artificial Sequence: Synthetic coding sequence

SEQ ID NO: 85246 - DNA, 2820 bp, Artificial Sequence
  Description of Artificial Sequence: Synthetic coding sequence
atgagcgccagcagcgagggccccagactggccctggccagccccagacccatcctggcccccctgtgcacccccgagggccagaagaccgccaccgcccacagaagcagcagcctggcccccaccagcgtgggccagctggtgatgagcgccagcgccggccccaagcccccccccgccaccaccggcagcgtgctggcccccaccagcctgggcctggtgatgcccgccagcgccggccccagaagcccccccgtgaccctgggccccaacctggcccccaccagcagagaccagaagcaggagccccccgccagcgtgggccccaagcccaccctggccgccagcggcctgagcctggccctggccagcgaggagcagccccccgagctgcccagcacccccagccccgtgcccagccccgtgctgagccccacccaggagcaggccctggcccccgccagcaccgccagcggcgccgccagcgtgggccagaccagcgccagaaagagagacgcccccgcccccagacccctgcccgccagcgagggccacctgcagccccccgcccagaccagcggccccaccggcagccccccctgcatccagaccagccccgaccccagactgagccccagcttcagagccagacccgaggccctgcacagcagccccgaggaccccgtgctgcccagacccccccagaccctgcccctggacgtgggccagggccccagcgagcccggcacccacagccccggcctgctgagccccaccttcagacccggcgcccccagcggccagaccgtgcccccccccctgcccaagccccccagaagccccagcagaagccccagccacagccccaacagaagcccctgcgtgccccccgcccccgacatggccctgcccagactgggcacccagagcaccggccccggcagatgcctgagccccaacctgcaggcccaggaggcccccgcccccgtgaccaccagcagcagcaccagcaccctgagcagcagcccctggagcgcccagcccacctggaagagcgaccccggcttcagaatcaccgtggtgacctggaacgtgggcaccgccatgccccccgacgacgtgaccagcctgctgcacctgggcggcggcgacgacagcgacggcgccgacatgatcgccatcggcctgcaggaggtgaacagcatgctgaacaagagactgaaggacgccctgttcaccgaccagtggagcgagctgttcatggacgccctgggccccttcaacttcgtgctggtgagcagcgtgagaatgcagggcgtgatcctgctgctgttcgccaagtactaccacctgcccttcctgagagacgtgcagaccgactgcaccagaaccggcctgggcggctactggggcaacaagggcggcgtgagcgtgagactggccgccttcggccacatgctgtgcttcctgaactgccacctgcccgcccacatggacaaggccgagcagagaaaggacaacttccagaccatcctgagcctgcagcagttccagggccccggcgcccagggcatcctggaccacgacctggtgttctggttcggcgacctgaacttcagaatcgagagctacgacctgcacttcgtgaagttcgccatcgacagcgaccagctgcaccagctgtgggagaaggaccagctgaacatggccaagaacacctggcccatcctgaagggcttccaggagggccccctgaacttcgcccccaccttcaagttcgacgtgggcaccaacaagtacgacaccagcgccaagaagagaaagcccgcctggaccgacagaatcctgtggaaggtgaaggcccccggcggcggccccagccccagcggcagaaagagccacagactgcaggtgacccagcacagctacagaagccacatggagtacaccgtgagcgaccacaagcccgtggccgcccagttcctgctgcagttcgccttcagagacgacatgcccctggtgagactggaggtggccgacgagtgggtgagacccgagcaggccgtggtgagatacagaatggagaccgtgttcgccagaagcagctgggactggatcggcctgtacagagtgggcttcagacactgcaaggactacgtggcctacgtgtgggccaagcacgaggacgtggacggcaacacctaccaggtgaccttcagcgaggagagcctgcccaagggccacggcgacttcatcctgggctactacagccacaaccacagcatcctgatcggcatcaccgagcccttccagatcagcctgcccagcagcgagctggccagcagcagcaccgacagcagcggcaccagcagcgagggcgaggacgacagcaccctggagctgctggcccccaagagcagaagccccagccccggcaagagcaagagacacagaagcagaagccccggcctggccagattccccggcctggccctgagacccagcagcagagagagaagaggcgccagcagaagccccagcccccagagcagaagactgagcagagtggcccccgacagaagcagcaacggcagcagcagaggcagcagcgaggagggccccagcggcctgcccggcccctgggccttcccccccgccgtgcccagaagcctgggcctgctgcccgccctgagactggagaccgtggaccccggcggcggcggcagctggggccccgacagagaggccctggcccccaacagcctgagccccagcccccagggccacagaggcctggaggagggcggcctgggcccctag

SEQ ID NO: 85247 - DNA, 3534 bp, Artificial Sequence
  Description of Artificial Sequence: Synthetic coding sequence
atggtgccctgctggaaccacggcaacatcaccagaagcaaggccgaggagctgctgagcagaaccggcaaggacggcagcttcctggtgagagccagcgagagcatcagcagagcctacgccctgtgcgtgctgtacagaaactgcgtgtacacctacagaatcctgcccaacgaggacgacaagttcaccgtgcaggccagcgagggcgtgagcatgagattcttcaccaagctggaccagctgatcgagttctacaagaaggagaacatgggcctggtgacccacctgcagtaccccgtgcccctggaggaggaggacaccggcgacgaccccgaggaggacaccgtggagagcgtggtgagcccccccgagctgccccccagaaacatccccctgaccgccagcagctgcgaggccaaggaggtgcccttcagcaacgagaaccccagagccaccgagaccagcagacccagcctgagcgagaccctgttccagagactgcagagcatggacaccagcggcctgcccgaggagcacctgaaggccatccaggactacctgagcacccagctggcccaggacagcgagttcgtgaagaccggcagcagcagcctgccccacctgaagaagctgaccaccctgctgtgcaaggagctgtacggccagatgctgagaaccgtgcccggcatcggcaaggtgaaggaggaggaccacgtgcccggcgaggccaaccccatcaacatggtgagcaagctgagccagctgaccagcctgctgagcagcatcgaggacaaggtgaaggccctgctgcacgagggccccgagagcccccacagacccagcctgatcccccccgtgaccttcgaggtgaaggccgagagcctgggcatcccccagaagatgcagctgaaggtggacgtggagagcggcaagctgatcatcaagaagagcaaggacggcagcgaggacaagttctacagccacaagaagatcctgcagctgatcaagagccagaagttcctgaacaagctggtgatcctggtggagaccgagaaggagaagatcctgagaaaggagtacgtgttcgccgacagcaagaagagagagggcttctgccagctgctgcagcagatgaagaacaagcacagcgagcagcccgagcccgacatgatcaccatcttcatcggcacctggaacatgggcaacgcccccccccccaagaagatcaccagctggttcctgagcaagggccagggcaagaccagagacgacagcgccgactacatcccccacgacatctacgtgatcggcacccaggaggaccccctgagcgagaaggagtggctggagatcctgaagcacagcctgcaggagatcaccagcgtgaccttcaagaccgtggccatccacaccctgtggaacatcagaatcgtggtgctggccaagcccgagcacgagaacagaatcagccacatctgcaccgacaacgtgaagaccggcatcgccaacaccctgggcaacaagggcgccgtgggcgtgagcttcatgttcaacggcaccagcctgggcttcgtgaacagccacctgaccagcggcagcgagaagaagctgagaagaaaccagaactacatgaacatcctgagattcctggccctgggcgacaagaagctgagccccttcaacatcacccacagattcacccacctgttctggttcggcgacctgaactacagagtggacctgcccacctgggaggccgagaccatcatccagaagatcaagcagcagcagtacgccgacctgctgagccacgaccagctgctgaccgagagaagagagcagaaggtgttcctgcacttcgaggaggaggagatcaccttcgcccccacctacagattcgagagactgaccagagacaagtacgcctacaccaagcagaaggccaccggcatgaagtacaacctgcccagctggtgcgacagagtgctgtggaagagctaccccctggtgcacgtggtgtgccagagctacggcagcaccagcgacatcatgaccagcgaccacagccccgtgttcgccaccttcgaggccggcgtgaccagccagttcgtgagcaagaacggccccggcaccgtggacagccagggccagatcgagttcctgagatgctacgccaccctgaagaccaagagccagaccaagttctacctggagttccacagcagctgcctggagagcttcgtgaagagccaggagggcgagaacgaggagggcagcgagggcgagctggtggtgaagttcggcgagaccctgcccaagctgaagcccatcatcagcgaccccgagtacctgctggaccagcacatcctgatcagcatcaagagcagcgacagcgacgagagctacggcgagggctgcatcgccctgagactggaggccaccgagacccagctgcccatctacacccccctgacccaccacggcgagctgaccggccacttccagggcgagatcaagctgcagaccagccagggcaagaccagagagaagctgtacgacttcgtgaagaccgagagagacgagagcagcggccccaagaccctgaagagcctgaccagccacgaccccatgaagcagtgggaggtgaccagcagagcccccccctgcagcggcagcagcatcaccgagatcatcaaccccaactacatgggcgtgggccccttcggcccccccatgcccctgcacgtgaagcagaccctgagccccgaccagcagcccaccgcctggagctacgaccagccccccaaggacagccccctgggcccctgcagaggcgagagcccccccaccccccccggccagccccccatcagccccaagaagttcctgcccagcaccgccaacagaggcctgccccccagaacccaggagagcagacccagcgacctgggcaagaacgccggcgacaccctgccccaggaggacctgcccctgaccaagcccgagatgttcgagaaccccctgtacggcagcctgagcagcttccccaagcccgcccccagaaaggaccaggagagccccaagatgcccagaaaggagccccccccctgccccgagcccggcatcctgagccccagcatcgtgctgaccaaggcccaggaggccgacagaggcgagggccccggcaagcaggtgcccgcccccagactgagaagcttcacctgcagcagcagcgccgagggcagagccgccggcggcgacaagagccagggcaagcccaagacccccgtgagcagccaggcccccgtgcccgccaagagacccatcaagcccagcagaagcgagatcaaccagcagaccccccccacccccacccccagaccccccctgcccgtgaagagccccgccgtgctgcacctgcagcacagcaagggcagagactacagagacaacaccgagctgccccaccacggcaagcacagacccgaggagggcccccccggccccctgggcagaaccgccatgcagtag

SEQ ID NO: 85248 - DNA, 2433 bp, Artificial Sequence
  Description of Artificial Sequence: Synthetic coding sequence
aagagagagggcttctgccagctgctgcagcagatgaagaacaagcacagcgagcagcccgagcccgacatgatcaccatcttcatcggcacctggaacatgggcaacgcccccccccccaagaagatcaccagctggttcctgagcaagggccagggcaagaccagagacgacagcgccgactacatcccccacgacatctacgtgatcggcacccaggaggaccccctgagcgagaaggagtggctggagatcctgaagcacagcctgcaggagatcaccagcgtgaccttcaagaccgtggccatccacaccctgtggaacatcagaatcgtggtgctggccaagcccgagcacgagaacagaatcagccacatctgcaccgacaacgtgaagaccggcatcgccaacaccctgggcaacaagggcgccgtgggcgtgagcttcatgttcaacggcaccagcctgggcttcgtgaacagccacctgaccagcggcagcgagaagaagctgagaagaaaccagaactacatgaacatcctgagattcctggccctgggcgacaagaagctgagccccttcaacatcacccacagattcacccacctgttctggttcggcgacctgaactacagagtggacctgcccacctgggaggccgagaccatcatccagaagatcaagcagcagcagtacgccgacctgctgagccacgaccagctgctgaccgagagaagagagcagaaggtgttcctgcacttcgaggaggaggagatcaccttcgcccccacctacagattcgagagactgaccagagacaagtacgcctacaccaagcagaaggccaccggcatgaagtacaacctgcccagctggtgcgacagagtgctgtggaagagctaccccctggtgcacgtggtgtgccagagctacggcagcaccagcgacatcatgaccagcgaccacagccccgtgttcgccaccttcgaggccggcgtgaccagccagttcgtgagcaagaacggccccggcaccgtggacagccagggccagatcgagttcctgagatgctacgccaccctgaagaccaagagccagaccaagttctacctggagttccacagcagctgcctggagagcttcgtgaagagccaggagggcgagaacgaggagggcagcgagggcgagctggtggtgaagttcggcgagaccctgcccaagctgaagcccatcatcagcgaccccgagtacctgctggaccagcacatcctgatcagcatcaagagcagcgacagcgacgagagctacggcgagggctgcatcgccctgagactggaggccaccgagacccagctgcccatctacacccccctgacccaccacggcgagctgaccggccacttccagggcgagatcaagctgcagaccagccagggcaagaccagagagaagctgtacgacttcgtgaagaccgagagagacgagagcagcggccccaagaccctgaagagcctgaccagccacgaccccatgaagcagtgggaggtgaccagcagagcccccccctgcagcggcagcagcatcaccgagatcatcaaccccaactacatgggcgtgggccccttcggcccccccatgcccctgcacgtgaagcagaccctgagccccgaccagcagcccaccgcctggagctacgaccagccccccaaggacagccccctgggcccctgcagaggcgagagcccccccaccccccccggccagccccccatcagccccaagaagttcctgcccagcaccgccaacagaggcctgccccccagaacccaggagagcagacccagcgacctgggcaagaacgccggcgacaccctgccccaggaggacctgcccctgaccaagcccgagatgttcgagaaccccctgtacggcagcctgagcagcttccccaagcccgcccccagaaaggaccaggagagccccaagatgcccagaaaggagccccccccctgccccgagcccggcatcctgagccccagcatcgtgctgaccaaggcccaggaggccgacagaggcgagggccccggcaagcaggtgcccgcccccagactgagaagcttcacctgcagcagcagcgccgagggcagagccgccggcggcgacaagagccagggcaagcccaagacccccgtgagcagccaggcccccgtgcccgccaagagacccatcaagcccagcagaagcgagatcaaccagcagaccccccccacccccacccccagaccccccctgcccgtgaagagccccgccgtgctgcacctgcagcacagcaagggcagagactacagagacaacaccgagctgccccaccacggcaagcacagacccgaggagggcccccccggccccctgggcagaaccgccatgcagtag

SEQ ID NO: 85249 - DNA, 666 bp, Artificial Sequence
  Description of Artificial Sequence: Synthetic coding sequence
atggtgccctgctggaaccacggcaacatcaccagaagcaaggccgaggagctgctgagcagaaccggcaaggacggcagcttcctggtgagagccagcgagagcatcagcagagcctacgccctgtgcgtgctgtacagaaactgcgtgtacacctacagaatcctgcccaacgaggacgacaagttcaccgtgcaggccagcgagggcgtgagcatgagattcttcaccaagctggaccagctgatcgagttctacaagaaggagaacatgggcctggtgacccacctgcagtaccccgtgcccctggaggaggaggacaccggcgacgaccccgaggaggacaccgagagcgtggtgagcccccccgagctgccccccagaaacatccccctgaccgccagcagctgcgaggccaaggaggtgcccttcagcaacgagaaccccagagccaccgagaccagcagacccagcctgagcgagaccctgttccagagactgcagagcatggacaccagcggcctgcccgaggagcacctgaaggccatccaggactacctgagcacccagctggcccaggacagcgagttcgtgaagaccggcagcagcagcctgccccacctgaagaagctgaccaccctgctgtgcaaggagctgtacggctag

SEQ ID NO: 85250 - DNA, 2433 bp, Artificial Sequence; identical to SEQ ID NO: 85248
  Description of Artificial Sequence: Synthetic coding sequence

SEQ ID NO: 85251 - DNA, 2433 bp, Artificial Sequence; identical to SEQ ID NO: 85248
  Description of Artificial Sequence: Synthetic coding sequence

SEQ ID NO: 85252 - DNA, 2826 bp, Artificial Sequence
  Description of Artificial Sequence: Synthetic coding sequence
agaccccaggtgcccggcgaggccaaccccatcaacatggtgagcaagctgagccagctgaccagcctgctgagcagcatcgaggacaaggtgaaggccctgctgcacgagggccccgagagcccccacagacccagcctgatcccccccgtgaccttcgaggtgaaggccgagagcctgggcatcccccagaagatgcagctgaaggtggacgtggagagcggcaagctgatcatcaagaagagcaaggacggcagcgaggacaagttctacagccacaagaagatcctgcagctgatcaagagccagaagttcctgaacaagctggtgatcctggtggagaccgagaaggagaagatcctgagaaaggagtacgtgttcgccgacagcaagaagagagagggcttctgccagctgctgcagcagatgaagaacaagcacagcgagcagcccgagcccgacatgatcaccatcttcatcggcacctggaacatgggcaacgcccccccccccaagaagatcaccagctggttcctgagcaagggccagggcaagaccagagacgacagcgccgactacatcccccacgacatctacgtgatcggcacccaggaggaccccctgagcgagaaggagtggctggagatcctgaagcacagcctgcaggagatcaccagcgtgaccttcaagaccgtggccatccacaccctgtggaacatcagaatcgtggtgctggccaagcccgagcacgagaacagaatcagccacatctgcaccgacaacgtgaagaccggcatcgccaacaccctgggcaacaagggcgccgtgggcgtgagcttcatgttcaacggcaccagcctgggcttcgtgaacagccacctgaccagcggcagcgagaagaagctgagaagaaaccagaactacatgaacatcctgagattcctggccctgggcgacaagaagctgagccccttcaacatcacccacagattcacccacctgttctggttcggcgacctgaactacagagtggacctgcccacctgggaggccgagaccatcatccagaagatcaagcagcagcagtacgccgacctgctgagccacgaccagctgctgaccgagagaagagagcagaaggtgttcctgcacttcgaggaggaggagatcaccttcgcccccacctacagattcgagagactgaccagagacaagtacgcctacaccaagcagaaggccaccggcatgaagtacaacctgcccagctggtgcgacagagtgctgtggaagagctaccccctggtgcacgtggtgtgccagagctacggcagcaccagcgacatcatgaccagcgaccacagccccgtgttcgccaccttcgaggccggcgtgaccagccagttcgtgagcaagaacggccccggcaccgtggacagccagggccagatcgagttcctgagatgctacgccaccctgaagaccaagagccagaccaagttctacctggagttccacagcagctgcctggagagcttcgtgaagagccaggagggcgagaacgaggagggcagcgagggcgagctggtggtgaagttcggcgagaccctgcccaagctgaagcccatcatcagcgaccccgagtacctgctggaccagcacatcctgatcagcatcaagagcagcgacagcgacgagagctacggcgagggctgcatcgccctgagactggaggccaccgagacccagctgcccatctacacccccctgacccaccacggcgagctgaccggccacttccagggcgagatcaagctgcagaccagccagggcaagaccagagagaagctgtacgacttcgtgaagaccgagagagacgagagcagcggccccaagaccctgaagagcctgaccagccacgaccccatgaagcagtgggaggtgaccagcagagcccccccctgcagcggcagcagcatcaccgagatcatcaaccccaactacatgggcgtgggccccttcggcccccccatgcccctgcacgtgaagcagaccctgagccccgaccagcagcccaccgcctggagctacgaccagccccccaaggacagccccctgggcccctgcagaggcgagagcccccccaccccccccggccagccccccatcagccccaagaagttcctgcccagcaccgccaacagaggcctgccccccagaacccaggagagcagacccagcgacctgggcaagaacgccggcgacaccctgccccaggaggacctgcccctgaccaagcccgagatgttcgagaaccccctgtacggcagcctgagcagcttccccaagcccgcccccagaaaggaccaggagagccccaagatgcccagaaaggagccccccccctgccccgagcccggcatcctgagccccagcatcgtgctgaccaaggcccaggaggccgacagaggcgagggccccggcaagcaggtgcccgcccccagactgagaagcttcacctgcagcagcagcgccgagggcagagccgccggcggcgacaagagccagggcaagcccaagacccccgtgagcagccaggcccccgtgcccgccaagagacccatcaagcccagcagaagcgagatcaaccagcagaccccccccacccccacccccagaccccccctgcccgtgaagagccccgccgtgctgcacctgcagcacagcaagggcagagactacagagacaacaccgagctgccccaccacggcaagcacagacccgaggagggcccccccggccccctgggcagaaccgccatgcagtag

SEQ ID NO: 85253 - DNA, 669 bp, Artificial Sequence
  Description of Artificial Sequence: Synthetic coding sequence
atggtgccctgctggaaccacggcaacatcaccagaagcaaggccgaggagctgctgagcagaaccggcaaggacggcagcttcctggtgagagccagcgagagcatcagcagagcctacgccctgtgcgtgctgtacagaaactgcgtgtacacctacagaatcctgcccaacgaggacgacaagttcaccgtgcaggccagcgagggcgtgagcatgagattcttcaccaagctggaccagctgatcgagttctacaagaaggagaacatgggcctggtgacccacctgcagtaccccgtgcccctggaggaggaggacaccggcgacgaccccgaggaggacaccgtggagagcgtggtgagcccccccgagctgccccccagaaacatccccctgaccgccagcagctgcgaggccaaggaggtgcccttcagcaacgagaaccccagagccaccgagaccagcagacccagcctgagcgagaccctgttccagagactgcagagcatggacaccagcggcctgcccgaggagcacctgaaggccatccaggactacctgagcacccagctggcccaggacagcgagttcgtgaagaccggcagcagcagcctgccccacctgaagaagctgaccaccctgctgtgcaaggagctgtacggctag

SEQ ID NO: 85254 - DNA, 2826 bp, Artificial Sequence
  Description of Artificial Sequence: Synthetic coding sequence
cccccccaggtgcccggcgaggccaaccccatcaacatggtgagcaagctgagccagctgaccagcctgctgagcagcatcgaggacaaggtgaaggccctgctgcacgagggccccgagagcccccacagacccagcctgatcccccccgtgaccttcgaggtgaaggccgagagcctgggcatcccccagaagatgcagctgaaggtggacgtggagagcggcaagctgatcatcaagaagagcaaggacggcagcgaggacaagttctacagccacaagaagatcctgcagctgatcaagagccagaagttcctgaacaagctggtgatcctggtggagaccgagaaggagaagatcctgagaaaggagtacgtgttcgccgacagcaagaagagagagggcttctgccagctgctgcagcagatgaagaacaagcacagcgagcagcccgagcccgacatgatcaccatcttcatcggcacctggaacatgggcaacgcccccccccccaagaagatcaccagctggttcctgagcaagggccagggcaagaccagagacgacagcgccgactacatcccccacgacatctacgtgatcggcacccaggaggaccccctgagcgagaaggagtggctggagatcctgaagcacagcctgcaggagatcaccagcgtgaccttcaagaccgtggccatccacaccctgtggaacatcagaatcgtggtgctggccaagcccgagcacgagaacagaatcagccacatctgcaccgacaacgtgaagaccggcatcgccaacaccctgggcaacaagggcgccgtgggcgtgagcttcatgttcaacggcaccagcctgggcttcgtgaacagccacctgaccagcggcagcgagaagaagctgagaagaaaccagaactacatgaacatcctgagattcctggccctgggcgacaagaagctgagccccttcaacatcacccacagattcacccacctgttctggttcggcgacctgaactacagagtggacctgcccacctgggaggccgagaccatcatccagaagatcaagcagcagcagtacgccgacctgctgagccacgaccagctgctgaccgagagaagagagcagaaggtgttcctgcacttcgaggaggaggagatcaccttcgcccccacctacagattcgagagactgaccagagacaagtacgcctacaccaagcagaaggccaccggcatgaagtacaacctgcccagctggtgcgacagagtgctgtggaagagctaccccctggtgcacgtggtgtgccagagctacggcagcaccagcgacatcatgaccagcgaccacagccccgtgttcgccaccttcgaggccggcgtgaccagccagttcgtgagcaagaacggccccggcaccgtggacagccagggccagatcgagttcctgagatgctacgccaccctgaagaccaagagccagaccaagttctacctggagttccacagcagctgcctggagagcttcgtgaagagccaggagggcgagaacgaggagggcagcgagggcgagctggtggtgaagttcggcgagaccctgcccaagctgaagcccatcatcagcgaccccgagtacctgctggaccagcacatcctgatcagcatcaagagcagcgacagcgacgagagctacggcgagggctgcatcgccctgagactggaggccaccgagacccagctgcccatctacacccccctgacccaccacggcgagctgaccggccacttccagggcgagatcaagctgcagaccagccagggcaagaccagagagaagctgtacgacttcgtgaagaccgagagagacgagagcagcggccccaagaccctgaagagcctgaccagccacgaccccatgaagcagtgggaggtgaccagcagagcccccccctgcagcggcagcagcatcaccgagatcatcaaccccaactacatgggcgtgggccccttcggcccccccatgcccctgcacgtgaagcagaccctgagccccgaccagcagcccaccgcctggagctacgaccagccccccaaggacagccccctgggcccctgcagaggcgagagcccccccaccccccccggccagccccccatcagccccaagaagttcctgcccagcaccgccaacagaggcctgccccccagaacccaggagagcagacccagcgacctgggcaagaacgccggcgacaccctgccccaggaggacctgcccctgaccaagcccgagatgttcgagaaccccctgtacggcagcctgagcagcttccccaagcccgcccccagaaaggaccaggagagccccaagatgcccagaaaggagccccccccctgccccgagcccggcatcctgagccccagcatcgtgctgaccaaggcccaggaggccgacagaggcgagggccccggcaagcaggtgcccgcccccagactgagaagcttcacctgcagcagcagcgccgagggcagagccgccggcggcgacaagagccagggcaagcccaagacccccgtgagcagccaggcccccgtgcccgccaagagacccatcaagcccagcagaagcgagatcaaccagcagaccccccccacccccacccccagaccccccctgcccgtgaagagccccgccgtgctgcacctgcagcacagcaagggcagagactacagagacaacaccgagctgccccaccacggcaagcacagacccgaggagggcccccccggccccctgggcagaaccgccatgcagtag

SEQ ID NO: 85255 - DNA, 1791 bp, Artificial Sequence
  Description of Artificial Sequence: Synthetic coding sequence
atggtgccctgctggaaccacggcaacatcaccagaagcaaggccgaggagctgctgagcagaaccggcaaggacggcagcttcctggtgagagccagcgagagcatcagcagagcctacgccctgtgcgtgctgtacagaaactgcgtgtacacctacagaatcctgcccaacgaggacgacaagttcaccgtgcaggccagcgagggcgtgagcatgagattcttcaccaagctggaccagctgatcgagttctacaagaaggagaacatgggcctggtgacccacctgcagtaccccgtgcccctggaggaggaggacaccggcgacgaccccgaggaggacaccgtggagagcgtggtgagcccccccgagctgccccccagaaacatccccctgaccgccagcagctgcgaggccaaggaggtgcccttcagcaacgagaaccccagagccaccgagaccagcagacccagcctgagcgagaccctgttccagagactgcagagcatggacaccagcggcctgcccgaggagcacctgaaggccatccaggactacctgagcacccagctggcccaggacagcgagttcgtgaagaccggcagcagcagcctgccccacctgaagaagctgaccaccctgctgtgcaaggagctgtacggctactgcctggaggtgctgctgagctaccccctgagcctgctgagccaggtgcccggcgaggccaaccccatcaacatggtgagcaagctgagccagctgaccagcctgctgagcagcatcgaggacaaggtgaaggccctgctgcacgagggccccgagagcccccacagacccagcctgatcccccccgtgaccttcgaggtgaaggccgagagcctgggcatcccccagaagatgcagctgaaggtggacgtggagagcggcaagctgatcatcaagaagagcaaggacggcagcgaggacaagttctacagccacaagaagatcctgcagctgatcaagagccagaagttcctgaacaagctggtgatcctggtggagaccgagaaggagaagatcctgagaaaggagtacgtgttcgccgacagcaagaagagagagggcttctgccagctgctgcagcagatgaagaacaagcacagcgagcagcccgagcccgacatgatcaccatcttcatcggcacctggaacatgggcaacgcccccccccccaagaagatcaccagctggttcctgagcaagggccagggcaagaccagagacgacagcgccgactacatcccccacgacatctacgtgatcggcacccaggaggaccccctgagcgagaaggagtggctggagatcctgaagcacagcctgcaggagatcaccagcgtgaccttcaagaccgtggccatccacaccctgtggaacatcagaatcgtggtgctggccaagcccgagcacgagaacagaatcagccacatctgcaccgacaacgtgaagaccggcatcgccaacaccctgggcaacaagggcgccgtgggcgtgagcttcatgttcaacggcaccagcctgggcttcgtgaacagccacctgaccagcggcagcgagaagaagctgagaagaaaccagaactacatgaacatcctgagattcctggccctgggcgacaagaagctgagccccttcaacatcacccacagattcacccacctgttctggttcggcgacctgaactacagagtggacctgcccacctgggaggccgagaccatcatccagaagatcaagcagcagtag

SEQ ID NO: 85256 - DNA, 837 bp, Artificial Sequence
  Description of Artificial Sequence: Synthetic coding sequence
tgacagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggacagaatcatcgaccagagattcgagaaggtgagctacttcgtgttcggcgacttcaacttcagactggacagcaagagcgtggtggagctgctggagttcgacaaggagctgagcgtgttcaaggacagactgtacgagctggacatcagcttcccccccagctacccctacagcgaggacgccagacagggcgagcagtacatgaacaccagatgccccgcctggtgcgacagaatcctgatgagccccagcgccaaggagctggtgctgagatag

SEQ ID NO: 85257 - DNA, 1164 bp, Artificial Sequence
  Description of Artificial Sequence: Synthetic coding sequence
atggccggcaaggccgccgcccccggcaccgccgtgctgctggtgaccgccaacgtgggcagcctgttcgacgaccccgagaacctgcagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggacagaatcatcgaccagagattcgagaaggtgagctacttcgtgttcggcgacttcaacttcagactggacagcaagagcgtggtggagaccctgtgcaccaaggccaccatgcagaccgtgagagccgccgacaccaacgaggtggtgaagctgatcttcagagagagcgacaacgacagaaaggtgatgctgcagctggagaagaagctgttcgactacttcaaccaggaggtgttcagagacaacaacggcaccgccctgctggagttcgacaaggagctgagcgtgttcaaggacagactgtacgagctggacatcagcttcccccccagctacccctacagcgaggacgccagacagggcgagcagtacatgaacaccagatgccccgcctggtgcgacagaatcctgatgagccccagcgccaaggagctggtgctgagagtgagcgtgtgctgccccagccccggccacagaggcatgtggagcgccggcagcggcctggcccagccctggtag

SEQ ID NO: 85258 - DNA, 1239 bp, Artificial Sequence
  Description of Artificial Sequence: Synthetic coding sequence
atggccggcaaggccgccgcccccggcaccgccgtgctgctggtgaccgccaacgtgggcagcctgttcgacgaccccgagaacctgcagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggacagaatcatcgaccagagattcgagaaggtgagctacttcgtgttcggcgacttcaacttcagactggacagcaagagcgtggtggagaccctgtgcaccaaggccaccatgcagaccgtgagagccgccgacaccaacgaggtggtgaagctgatcttcagagagagcgacaacgacagaaaggtgatgctgcagctggagaagaagctgttcgactacttcaaccaggaggtgttcagagacaacaacggcaccgccctgctggagttcgacaaggagctgagcgtgttcaaggacagactgtacgagctggacatcagcttcccccccagctacccctacagcgaggacgccagacagggcgagcagtacatgaacaccagatgccccgcctggtgcgacagaatcctgatgagccccagcgccaaggagctggtgctgagaagcgagagcgaggagaaggtggtgacctacgaccacatcggccccaacgtgtgcatgggcgaccacaagcccgtgttcctggccttcagaatcatgcccggcgccggcaagccccacgcccacgtgcacaagtgctgcgtggtgcagtag

SEQ ID NO: 85259 - DNA, 558 bp, Artificial Sequence
  Description of Artificial Sequence: Synthetic coding sequence
atggccggcaaggccgccgcccccggcaccgccgtgctgctggtgaccgccaacgtgggcagcctgttcgacgaccccgagaacctgcagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagagacacgtgccccacaccagcctggaggccctgctgatcctgcacgaggacccccagctgcccgacccccacctgcccctgtag

SEQ ID NO: 85260 - DNA, 1068 bp, Artificial Sequence
  Description of Artificial Sequence: Synthetic coding sequence
atggccggcaaggccgccgcccccggcaccgccgtgctgctggtgaccgccaacgtgggcagcctgttcgacgaccccgagaacctgcagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggacagaatcatcgaccagagattcgagaaggtgagctacttcgtgttcggcgacttcaacttcagactggacagcaagagcgtggtggagctgctggagttcgacaaggagctgagcgtgttcaaggacagactgtacgagctggacatcagcttcccccccagctacccctacagcgaggacgccagacagggcgagcagtacatgaacaccagatgccccgcctggtgcgacagaatcctgatgagccccagcgccaaggagctggtgctgagaagcgagagcgaggagaaggtggtgacctacgaccacatcggccccaacgtgtgcatgggcgaccacaagcccgtgttcctggccttcagaatcatgcccggcgccggcaagccccacgcccacgtgcacaagtgctgcgtggtgcagtag

SEQ ID NO: 85261 - DNA, 417 bp, Artificial Sequence
  Description of Artificial Sequence: Synthetic coding sequence
gtgaccgccaacgtgggcagcctgttcgacgaccccgagaacctgcagaagaactggctgagagagttctaccaggccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggactag

SEQ ID NO: 85262 - DNA, 990 bp, Artificial Sequence
  Description of Artificial Sequence: Synthetic coding sequence
atgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttccccctgctgcccagagtgcagatggtgaagaagagactgcaccccgacgaggtgatcgccgactgcgccttcgacctggtgaacatccacctgttccacgacgccagcaacctggtggcctgggagaccagccccagcgtgtacagcggcatcagacacaaggccctgggctacgtgctggacagaatcatcgaccagagattcgagaaggtgagctacttcgtgttcggcgacttcaacttcagactggacagcaagagcgtggtggagaccctgtgcaccaaggccaccatgcagaccgtgagagccgccgacaccaacgaggtggtgaagctgatcttcagagagagcgacaacgacagaaaggtgatgctgcagctggagaagaagctgttcgactacttcaaccaggaggtgttcagagacaacaacggcaccgccctgctggagttcgacaaggagctgagcgtgttcaaggacagactgtacgagctggacatcagcttcccccccagctacccctacagcgaggacgccagacagggcgagcagtacatgaacaccagatgccccgcctggtgcgacagaatcctgatgagccccagcgccaaggagctggtgctgagaagcgagagcgaggagaaggtggtgacctacgaccacatcggccccaacgtgtgcatgggcgaccacaagcccgtgttcctggccttcagaatcatgcccggcgccggcaagccccacgcccacgtgcacaagtgctgcgtggtgcagtag

SEQ ID NO: 85263 - DNA, 315 bp, Artificial Sequence
  Description of Artificial Sequence: Synthetic coding sequence
ctggacatcagcttcccccccagctacccctacagcgaggacgccagacagggcgagcagtacatgaacaccagatgccccgcctggtgcgacagaatcctgatgagccccagcgccaaggagctggtgctgagaagcgagagcgaggagaaggtggtgacctacgaccacatcggccccaacgtgtgcatgggcgaccacaagcccgtgttcctggccttcagaatcatgcccggcgccggcaagagatgccagagacacgagagaaccctgagagagcccccctgcagcagaggccccaacacccacagctag

SEQ ID NO: 85264 - DNA, 546 bp, Artificial Sequence
  Description of Artificial Sequence: Synthetic coding sequence
gccgccgcccccggcaccgccgtgctgctggtgaccgccaacgtgggcagcctgttcgacgaccccgagaacctgcagaagaactggctgagagagttctaccaggtggtgcacacccacaagccccacttcatggccctgcactgccaggagttcggcggcaagaactacgaggccagcatgagccacgtggacaagttcgtgaaggagctgctgagcagcgacgccatgaaggagtacaacagagccagagtgtacctggacgagaactacaagagccaggagcacttcaccgccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagagacacgtgccccacaccagcctggaggccctgctgatcctgcacgaggacccccagctgcccgacccccacctgcccctgtag

SEQ ID NO: 85265 - DNA, 459 bp, Artificial Sequence
  Description of Artificial Sequence: Synthetic coding sequence
atggccggcaaggccgccgcccccggcaccgccgtgctgctggtgaccgccaacgtgggcagcctgttcgacgaccccgagaacctgcagaagaactggctgagagagttctaccaggccctgggcagcttctacttcctgcacgagagcctgaagaacatctaccagttcgacttcaaggccaagaagtacagaaaggtggccggcaaggagatctacagcgacaccctggagagcacccccatgctggagaaggagaagttcccccaggactacttccccgagtgcaagtggagcagaaagggcttcatcagaaccagatggtgcatcgccgactgcgccttcgacctggtgaacatccacctgttccacgacgccagcaacctggtggcctgggagaccagccccagcgtgtacagcggcatcagacacaaggccctgggctacgtgctggactag

SEQ ID NO: 85266 - DNA, 1935 bp, Artificial Sequence
  Description of Artificial Sequence: Synthetic coding sequence
atgcccagcaaggccgagaacctgagacccagcgagcccgccccccagccccccgagggcagaaccctgcagggccagctgcccggcgccccccccgcccagagagccggcagcccccccgacgcccccggcagcgagagccccgccctggcctgcagcacccccgccacccccagcggcgaggacccccccgccagagccgcccccatcgcccccagaccccccgccagacccagactggagagagccctgagcctggacgacaagggctggagaagaagaagattcagaggcagccaggaggacctggaggccagaaacggcaccagccccagcagaggcagcgtgcagagcgagggccccggcgcccccgcccacagctgcagccccccctgcctgagcaccagcctgcaggagatccccaagagcagaggcgtgctgagcagcgagagaggcagccccagcagcggcggcaaccccctgagcggcgtggccagcagcagccccaacctgccccacagagacgccgccgtggccggcagcagccccagactgcccagcctgctgccccccagacccccccccgccctgagcctggacatcgccagcgacagcctgagaaccgccaacaaggtggacagcgacctggccgactacaagctgagagcccagcccctgctggtgagagcccacagcagcctgggccccggcagacccagaagccccctggcctgcgacgactgcagcctgagaagcgccaagagcagcttcagcctgctggcccccatcagaagcaaggacgtgagaagcagaagctacctggagggcagcctgctggccagcggcgccctgctgggcgccgacgagctggccagatacttccccgacagaaacgtggccctgttcgtggccacctggaacatgcagggccagaaggagctgccccccagcctggacgagttcctgctgcccgccgaggccgactacgcccaggacctgtacgtgatcggcgtgcaggagggctgcagcgacagaagagagtgggagaccagactgcaggagaccctgggcccccactacgtgctgctgagcagcgccgcccacggcgtgctgtacatgagcctgttcatcagaagagacctgatctggttctgcagcgaggtggagtgcagcaccgtgaccaccagaatcgtgagccagatcaagaccaagggcgccctgggcatcagcttcaccttcttcggcaccagcttcctgttcatcaccagccacttcaccagcggcgacggcaaggtggccgagagactgctggactacaccagaaccgtgcaggccctggtgctgcccagaaacgtgcccgacaccaacccctacagaagcagcgccgccgacgtgaccaccagattcgacgaggtgttctggttcggcgacttcaacttcagactgagcggcggcagaaccgtggtggacgccctgctgtgccagggcctggtggtggacgtgcccgccctgctgcagcacgaccagctgatcagagagatgagaaagggcagcatcttcaagggcttccaggagcccgacatccacttcctgcccagctacaagttcgacatcggcaaggacacctacgacagcaccagcaagcagagaacccccagctacaccgacagagtgctgtacagaagcagacacaagggcgacatctgccccgtgagctacagcagctgccccggcatcaagaccagcgaccacagacccgtgtacggcctgttcagagtgaaggtgagacccggcagagacaacatccccctggccgccggcaagttcgacagagagctgtacctgctgggcatcaagagaagaatcagcaaggagatccagagacagcaggccctgcagagccagaacagcagcaccatctgcagcgtgagctag

SEQ ID NO: 85267 - DNA, 960 bp, Artificial Sequence
  Description of Artificial Sequence: Synthetic coding sequence
atggaccagagcgtggccatccaggagaccctggccgagggcgagtactgcgtgatcgccgtgcagggcgtgctgtgcgagggcgacagcagacagagcagactgctgggcctggtgagatacagactggagcacggcggccaggagcacgccctgttcctgtacacccacagaagaatggccatcaccggcgacgacgtgagcctggaccagatcgtgcccgtgagcagagacttcaccctggaggaggtgagccccgacggcgagctgtacatcctgggcagcgacgtgaccgtgcagctggacaccgccgagctgagcctggtgttccagctgcccttcggcagccagaccagaatgttcctgcacgaggtggccagagcctgccccggcttcgacagcgccaccagagaccccgagttcctgtggctgagcagatacagatgcgccgagctggagctggagatgcccacccccagaggctgcaacagcgccctggtgacctggcccggctacgccaccatcggcggcggcagataccccagcagaaagaagagatggggcctggaggaggccagaccccagggcgccggcagcgtgctgttctggggcggcgccatggagaagaccggcttcagactgatggagagagcccacggcggcggcttcgtgtggggcagaagcgccagagacggcagaagagacgaggagctggaggaggccggcagagagatgagcgccgccgccggcagcagagagagaaacaccgccggcagcgccggcggcggcaagctgggctggggcgccggccccggcgccgccgtgagacccgccctgggctgggccggcagcgccgtgtggcccgtggacgccagaggcgaggaccagagccccggcggccccctggaggccggcaccctgggccagaagttctgcgacgtgctgctgagaagagcctag

SEQ ID NO: 85268 - DNA, 2982 bp, Artificial Sequence
  Description of Artificial Sequence: Synthetic coding sequence
atggaccagagcgtggccatccaggagaccctggccgagggcgagtactgcgtgatcgccgtgcagggcgtgctgtgcgagggcgacagcagacagagcagactgctgggcctggtgagatacagactggagcacggcggccaggagcacgccctgttcctgtacacccacagaagaatggccatcaccggcgacgacgtgagcctggaccagatcgtgcccgtgagcagagacttcaccctggaggaggtgagccccgacggcgagctgtacatcctgggcagcgacgtgaccgtgcagctggacaccgccgagctgagcctggtgttccagctgcccttcggcagccagaccagaatgttcctgcacgaggtggccagagcctgccccggcttcgacagcgccaccagagaccccgagttcctgtggctgagcagatacagatgcgccgagctggagctggagatgcccacccccagaggctgcaacagcgccctggtgacctggcccggctacgccaccatcggcggcggcagataccccagcagaaagaagagatggggcctggaggaggccagaccccagggcgccggcagcgtgctgttctggggcggcgccatggagaagaccggcttcagactgatggagagagcccacggcggcggcttcgtgtggggcagaagcgccagagacggcagaagagacgaggagctggaggaggccggcagagagatgagcgccgccgccggcagcagagagagaaacaccgccggcggcagcaacttcgacggcctgagacccaacggcaagggcgtgcccatggaccagagcagcagaggccaggacaagcccgagagcctgcagcccagacagaacaagagcaagagcgagatcaccgacatggtgagaagcagcaccatcaccgtgagcgacaaggcccacatcctgagcatgcagaagttcggcctgagagacaccatcgtgaagagccacctgctgcagaaggaggaggactacacctacatccagaacttcagattcttcgccggcacctacaacgtgaacggccagagccccaaggagtgcctgagactgtggctgagcaacggcatccaggcccccgacgtgtactgcgtgggcttccaggagctggacctgagcaaggaggccttcttcttccacgacacccccaaggaggaggagtggttcaaggccgtgagcgagggcctgcaccccgacgccaagtacgccaaggtgaagctgatcagactggtgggcatcatgctgctgctgtacgtgaagcaggagcacgccgcctacatcagcgaggtggaggccgagaccgtgggcaccggcatcatgggcagaatgggcaacaagggcggcgtggccatcagattccagttccacaacaccagcatctgcgtggtgaacagccacctggccgcccacatcgaggagtacgagagaagaaaccaggactacaaggacatctgcagcagaatgcagttctgccagcccgaccccagcctgccccccctgaccatcagcaaccacgacgtgatcctgtggctgggcgacctgaactacagaatcgaggagctggacgtggagaaggtgaagaagctgatcgaggagaaggacttccagatgctgtacgcctacgaccagctgaagatccaggtggccgccaagaccgtgttcgagggcttcaccgagggcgagctgaccttccagcccacctacaagtacgacaccggcagcgacgactgggacaccagcgagaagtgcagagcccccgcctggtgcgacagaatcctgtggaagggcaagaacatcacccagctgagctaccagagccacatggccctgaagaccagcgaccacaagcccgtgagcagcgtgttcgacatcggcgtgagagtggtgaacgacgagctgtacagaaagaccctggaggagatcgtgagaagcctggacaagatggagaacgccaacatccccagcgtgagcctgagcaagagagagttctgcttccagaacgtgaagtacatgcagctgaaggtggagagcttcaccatccacaacggccaggtgccctgccacttcgagttcatcaacaagcccgacgaggagagctactgcaagcagtggctgaacgccaaccccagcagaggcttcctgctgcccgacagcgacgtggagatcgacctggagctgttcgtgaacaagatgaccgccaccaagctgaacagcggcgaggacaagatcgaggacatcctggtgctgcacctggacagaggcaaggactacttcctgagcgtgagcggcaactacctgcccagctgcttcggcagccccatccacaccctgtgctacatgagagagcccatcctggacctgcccctggagaccatcagcgagctgaccctgatgcccgtgtggaccggcgacgacggcagccagctggacagccccatggagatccccaaggagctgtggatgatggtggactacctgtacagaaacgccgtgcagcaggaggacctgttccagcagcccggcctgagaagcgagttcgagcacatcagagactgcctggacaccggcatgatcgacaacctgagcgccagcaaccacagcgtggccgaggccctgctgctgttcctggagagcctgcccgagcccgtgatctgctacagcacctaccacaactgcctggagtgcagcggcaactacaccgccagcaagcaggtgatcagcaccctgcccatcttccacaagaacgtgttccactacctgatggccttcctgagagagctgctgaagaacagcgccaagaaccacctggacgagaacatcctggccagcatcttcggcagcctgctgctgagaaaccccgccggccaccagaagctggacatgaccgagaagaagaaggcccaggagttcatccaccagttcctgtgcaaccccctgtag

SEQ ID NO: 85269 - DNA, 2742 bp, Artificial Sequence
  Description of Artificial Sequence: Synthetic coding sequence
atggaccagagcgtggccatccaggagaccctggccgagggcgagtactgcgtgatcgccgtgcagggcgtgctgtgcgagggcgacagcagacagagcagactgctgggcctggtgagatacagactggagcacggcggccaggagcacgccctgttcctgtacacccacagaagaatggccatcaccggcgacgacgtgagcctggaccagatcgtgcccgtgagcagagacttcaccctggaggaggtgagccccgacggcgagctgtacatcctgggcagcgacgtgaccgtgcagctggacaccgccgagctgagcctggtgttccagctgcccttcggcagccagaccagaatgttcctgcacgaggtggccagagcctgccccggcttcgacagcgccaccagagaccccgagttcctgtggctgagcagatacagatgcgccgagctggagctggagatgcccacccccagaggctgcaacagcgccctggtgacctggcccggctacgccaccatcggcggcggcggcagcaacttcgacggcctgagacccaacggcaagggcgtgcccatggaccagagcagcagaggccaggacaagcccgagagcctgcagcccagacagaacaagagcaagagcgagatcaccgacatggtgagaagcagcaccatcaccgtgagcgacaaggcccacatcctgagcatgcagaagttcggcctgagagacaccatcgtgaagagccacctgctgcagaaggaggaggactacacctacatccagaacttcagattcttcgccggcacctacaacgtgaacggccagagccccaaggagtgcctgagactgtggctgagcaacggcatccaggcccccgacgtgtactgcgtgggcttccaggagctggacctgagcaaggaggccttcttcttccacgacacccccaaggaggaggagtggttcaaggccgtgagcgagggcctgcaccccgacgccaagtacgccaaggtgaagctgatcagactggtgggcatcatgctgctgctgtacgtgaagcaggagcacgccgcctacatcagcgaggtggaggccgagaccgtgggcaccggcatcatgggcagaatgggcaacaagggcggcgtggccatcagattccagttccacaacaccagcatctgcgtggtgaacagccacctggccgcccacatcgaggagtacgagagaagaaaccaggactacaaggacatctgcagcagaatgcagttctgccagcccgaccccagcctgccccccctgaccatcagcaaccacgacgtgatcctgtggctgggcgacctgaactacagaatcgaggagctggacgtggagaaggtgaagaagctgatcgaggagaaggacttccagatgctgtacgcctacgaccagctgaagatccaggtggccgccaagaccgtgttcgagggcttcaccgagggcgagctgaccttccagcccacctacaagtacgacaccggcagcgacgactgggacaccagcgagaagtgcagagcccccgcctggtgcgacagaatcctgtggaagggcaagaacatcacccagctgagctaccagagccacatggccctgaagaccagcgaccacaagcccgtgagcagcgtgttcgacatcggcgtgagagtggtgaacgacgagctgtacagaaagaccctggaggagatcgtgagaagcctggacaagatggagaacgccaacatccccagcgtgagcctgagcaagagagagttctgcttccagaacgtgaagtacatgcagctgaaggtggagagcttcaccatccacaacggccaggtgccctgccacttcgagttcatcaacaagcccgacgaggagagctactgcaagcagtggctgaacgccaaccccagcagaggcttcctgctgcccgacagcgacgtggagatcgacctggagctgttcgtgaacaagatgaccgccaccaagctgaacagcggcgaggacaagatcgaggacatcctggtgctgcacctggacagaggcaaggactacttcctgagcgtgagcggcaactacctgcccagctgcttcggcagccccatccacaccctgtgctacatgagagagcccatcctggacctgcccctggagaccatcagcgagctgaccctgatgcccgtgtggaccggcgacgacggcagccagctggacagccccatggagatccccaaggagctgtggatgatggtggactacctgtacagaaacgccgtgcagcaggaggacctgttccagcagcccggcctgagaagcgagttcgagcacatcagagactgcctggacaccggcatgatcgacaacctgagcgccagcaaccacagcgtggccgaggccctgctgctgttcctggagagcctgcccgagcccgtgatctgctacagcacctaccacaactgcctggagtgcagcggcaactacaccgccagcaagcaggtgatcagcaccctgcccatcttccacaagaacgtgttccactacctgatggccttcctgagagagctgctgaagaacagcgccaagaaccacctggacgagaacatcctggccagcatcttcggcagcctgctgctgagaaaccccgccggccaccagaagctggacatgaccgagaagaagaaggcccaggagttcatccaccagttcctgtgcaaccccctgtag

SEQ ID NO: 85270 - DNA, 2982 bp, Artificial Sequence; identical to SEQ ID NO: 85268
  Description of Artificial Sequence: Synthetic coding sequence

SEQ ID NO: 85271 - DNA, 2250 bp, Artificial Sequence
  Description of Artificial Sequence: Synthetic coding sequence
atgagcgccgccgccggcagcagagagagaaacaccgccggcggcagcaacttcgacggcctgagacccaacggcaagggcgtgcccatggaccagagcagcagaggccaggacaagcccgagagcctgcagcccagacagaacaagagcaagagcgagatcaccgacatggtgagaagcagcaccatcaccgtgagcgacaaggcccacatcctgagcatgcagaagttcggcctgagagacaccatcgtgaagagccacctgctgcagaaggaggaggactacacctacatccagaacttcagattcttcgccggcacctacaacgtgaacggccagagccccaaggagtgcctgagactgtggctgagcaacggcatccaggcccccgacgtgtactgcgtgggcttccaggagctggacctgagcaaggaggccttcttcttccacgacacccccaaggaggaggagtggttcaaggccgtgagcgagggcctgcaccccgacgccaagtacgccaaggtgaagctgatcagactggtgggcatcatgctgctgctgtacgtgaagcaggagcacgccgcctacatcagcgaggtggaggccgagaccgtgggcaccggcatcatgggcagaatgggcaacaagggcggcgtggccatcagattccagttccacaacaccagcatctgcgtggtgaacagccacctggccgcccacatcgaggagtacgagagaagaaaccaggactacaaggacatctgcagcagaatgcagttctgccagcccgaccccagcctgccccccctgaccatcagcaaccacgacgtgatcctgtggctgggcgacctgaactacagaatcgaggagctggacgtggagaaggtgaagaagctgatcgaggagaaggacttccagatgctgtacgcctacgaccagctgaagatccaggtggccgccaagaccgtgttcgagggcttcaccgagggcgagctgaccttccagcccacctacaagtacgacaccggcagcgacgactgggacaccagcgagaagtgcagagcccccgcctggtgcgacagaatcctgtggaagggcaagaacatcacccagctgagctaccagagccacatggccctgaagaccagcgaccacaagcccgtgagcagcgtgttcgacatcggcgtgagagtggtgaacgacgagctgtacagaaagaccctggaggagatcgtgagaagcctggacaagatggagaacgccaacatccccagcgtgagcctgagcaagagagagttctgcttccagaacgtgaagtacatgcagctgaaggtggagagcttcaccatccacaacggccaggtgccctgccacttcgagttcatcaacaagcccgacgaggagagctactgcaagcagtggctgaacgccaaccccagcagaggcttcctgctgcccgacagcgacgtggagatcgacctggagctgttcgtgaacaagatgaccgccaccaagctgaacagcggcgaggacaagatcgaggacatcctggtgctgcacctggacagaggcaaggactacttcctgagcgtgagcggcaactacctgcccagctgcttcggcagccccatccacaccctgtgctacatgagagagcccatcctggacctgcccctggagaccatcagcgagctgaccctgatgcccgtgtggaccggcgacgacggcagccagctggacagccccatggagatccccaaggagctgtggatgatggtggactacctgtacagaaacgccgtgcagcaggaggacctgttccagcagcccggcctgagaagcgagttcgagcacatcagagactgcctggacaccggcatgatcgacaacctgagcgccagcaaccacagcgtggccgaggccctgctgctgttcctggagagcctgcccgagcccgtgatctgctacagcacctaccacaactgcctggagtgcagcggcaactacaccgccagcaagcaggtgatcagcaccctgcccatcttccacaagaacgtgttccactacctgatggccttcctgagagagctgctgaagaacagcgccaagaaccacctggacgagaacatcctggccagcatcttcggcagcctgctgctgagaaaccccgccggccaccagaagctggacatgaccgagaagaagaaggcccaggagttcatccaccagttcctgtgcaaccccctgtag

SEQ ID NO: 85272 - DNA, 2487 bp, Artificial Sequence
  Description of Artificial Sequence: Synthetic coding sequence
atggaccagagcgtggccatccaggagaccctggccgagggcgagtactgcgtgatcgccgtgcagggcgtgctgtgcgagggcgacagcagacagagcagactgctgggcctggtgagatacagactggagcacggcggccaggagcacgccctgttcctgtacacccacagaagaatggccatcaccggcgacgacgtgagcctggaccagatcgtgcccgtgagcagagacttcaccctggaggaggtgagccccgacggcgagctgtacatcctgggcagcgacgtgaccgtgcagctggacaccgccgagctgagcctggtgttccagctgcccttcggcagccagaccagaatgttcctgcacgaggtggccagagcctgccccggcttcgacagcgccaccagagaccccgagttcctgtggctgagcagatacagatgcgccgagctggagctggagatgcccacccccagaggctgcaacagcgccctggtgacctggcccggctacgccaccatcggcggcggcagataccccagcagaaagaagagatggggcctggaggaggccagaccccagggcgccggcagcgtgctgttctggggcggcgccatggagaagaccggcttcagactgatggagagagcccacggcggcggcttcgtgtggggcagaagcgccagagacggcagaagagacgaggagctggaggaggccggcagagagatgagcgccgccgccggcagcagagagagaaacaccgccggcggcagcaacttcgacggcctgagacccaacggcaagggcgtgcccatggaccagagcagcagaggccaggacaagcccgagagcctgcagcccagacagaacaagagcaagagcgagatcaccgacatggtgagaagcagcaccatcaccgtgagcgacaaggcccacatcctgagcatgcagaagttcggcctgagagacaccatcgtgaagagccacctgctgcagaaggaggaggactacacctacatccagaacttcagattcttcgccggcacctacaacgtgaacggccagagccccaaggagtgcctgagactgtggctgagcaacggcatccaggcccccgacgtgtactgcgtgggcttccaggagctggacctgagcaaggaggccttcttcttccacgacacccccaaggaggaggagtggttcaaggccgtgagcgagggcctgcaccccgacgccaagtacgccaaggtgaagctgatcagactggtgggcatcatgctgctgctgtacgtgaagcaggagcacgccgcctacatcagcgaggtggaggccgagaccgtgggcaccggcatcatgggcagaatgggcaacaagggcggcgtggccatcagattccagttccacaacaccagcatctgcgtggtgaacagccacctggccgcccacatcgaggagtacgagagaagaaaccaggactacaaggacatctgcagcagaatgcagttctgccagcccgaccccagcctgccccccctgaccatcagcaaccacgacgtgatcctgtggctgggcgacctgaactacagaatcgaggagctggacgtggagaaggtgaagaagctgatcgaggagaaggacttccagatgctgtacgcctacgaccagctgaagatccaggtggccgccaagaccgtgttcgagggcttcaccgagggcgagctgaccttccagcccacctacaagtacgacaccggcagcgacgactgggacaccagcgagaagtgcagagcccccgcctggtgcgacagaatcctgtggaagggcaagaacatcacccagctgagctaccagagccacatggccctgaagaccagcgaccacaagcccgtgagcagcgtgttcgacatcggcgtgagagtggtgaacgacgagctgtacagaaagaccctggaggagatcgtgagaagcctggacaagatggagaacgccaacatccccagcgtgagcctgagcaagagagagttctgcttccagaacgtgaagtacatgcagctgaaggtggagagcttcaccatccacaacggccaggtgccctgccacttcgagttcatcaacaagcccgacgaggagagctactgcaagcagtggctgaacgccaaccccagcagaggcttcctgctgcccgacagcgacgtggagatcgacctggagctgttcgtgaacaagatgaccgccaccaagctgaacagcggcgaggacaagatcgaggacatcctggtgctgcacctggacagaggcaaggactacttcctgagcgtgagcggcaactacctgcccagctgcttcggcagccccatccacaccctgtgctacatgagagagcccatcctggacctgcccctggagaccatcagcgagctgctggcctacctggccgcctactgcttcgagacccagctggtgaccaagagcctgatctag

SEQ ID NO: 85273 - DNA, 528 bp, Artificial Sequence
  Description of Artificial Sequence: Synthetic coding sequence
atgcagaagttcggcctgagagacaccatcgtgaagagccacctgctgcagaaggaggaggactacacctacatccagaacttcagattcttcgccggcacctacaacgtgaacggccagagccccaaggagtgcctgagactgtggctgagcaacggcatccaggcccccgacgtgtactgcgtgggcttccaggagctggacctgagcaaggaggccttcttcttccacgacacccccaaggaggaggagtggttcaaggccgtgagcgagggcctgcaccccgacgccaagtacgccaaggtgaagctgatcagactggtgggcatcatgctgctgctgtacgtgaagcaggagcacgccgcctacatcagcgaggtggaggccgagaccgtgggcaccggcatcatgggcagaatgtgcgacctggtggccggcggcccccagctgcaggacagaagagccggctgcggcaagagcgagaaggcccacagaagagagggcctgagcaacgccgtgtgcatctag

SEQ ID NO: 85274 - DNA, 834 bp, Artificial Sequence
  Description of Artificial Sequence: Synthetic coding sequence
atggccgacccctggcaggagtgcatggactacgccgtgaccctggccagacaggccggcgaggtggtgtgcgaggccatcaagaacgagatgaacgtgatgctgaagagcagccccgtggacctggtgaccgccaccgaccagaaggtggagaagatgctgatcagcagcatcaaggagaagtaccccagccacagcttcatcggcgaggagagcgtggccgccggcgagaagagcatcctgaccgacaaccccacctggatcatcgaccccatcgacggcaccaccaacttcgtgcacagattccccttcgtggccgtgagcatcggcttcgccgtgaacaagaagatcgagttcggcgtggtgtacagctgcgtggagggcaagatgtacaccgccagaaagggcaagggcgccttctgcaacggccagaagctgcaggtgagccagcaggaggacatcaccaagagcctgctggtgaccgagctgggcagcagcagaacccccgagaccgtgagaatggtgctgagcaacatggagaagctgttctgcatccccgtgcacggcatcagaagcgtgggcaccgccgccgtgaacatgtgcctggtggccaccggcggcgccgacgcctactacgagatgggcatccactgctgggacgtggccggcgccggcatcatcgtgaccgaggccggcggcgtgctgatggacgtgaccggcggccccttcgacctgatgagcagaagagtgatcgccgccaacaacagaatcctggccgagagaatcgccaaggagatccaggtgatccccctgcagagagacgacgaggactag

SEQ ID NO: 85275 - DNA, 597 bp, Artificial Sequence
  Description of Artificial Sequence: Synthetic coding sequence
atggccgacccctggcaggagtgcatggactacgccgtgaccctggccagacaggccggcgaggtggtgtgcgaggccatcaagaacgagatgaacgtgatgctgaagagcagccccgtggacctggtgaccgccaccgaccagaaggtggagaagatgctgatcagcagcatcaaggagaagtaccccagccacagcttcatcggcgaggagagcgtggccgccggcgagaagagcatcctgaccgacaaccccacctggatcatcgaccccatcgacggcaccaccaacttcgtgcacagattccccttcgtggccgtgagcatcggcttcgccgtgaacaagaagatcgagttcggcgtggtgtacagctgcgtggagggcaagatgtacaccgccagaaagggcaagggcgccttctgcaacggccagaagctgcaggtgagccagcaggagggcagcggcgtgctggagcagcagctgctgatctgcgccctgtggcagctggccgagcagatgcacatcatgaagtgggagttcaccgccggcatgctgcaggagctggccctgctgctgctgaagctggtggcctgctag

SEQ ID NO: 85276 - DNA, 1011 bp, Artificial Sequence
  Description of Artificial Sequence: Synthetic coding sequence
atgggccagagacccggccccgtgctgcccgccgtggccgtgctgggccaggtggccaagagaaaggtggcctggctgctgagatggaaggccgtgaccagaaccgagaccgccggcaacagcagcggcgtgtacggcttcggcaagatgaagatcttcgtgaagtacttccagaagatggccgacccctggcaggagtgcatggactacgccgtgaccctggccagacaggccggcgaggtggtgtgcgaggccatcaagaacgagatgaacgtgatgctgaagagcagccccgtggacctggtgaccgccaccgaccagaaggtggagaagatgctgatcagcagcatcaaggagaagtaccccagccacagcttcatcggcgaggagagcgtggccgccggcgagaagagcatcctgaccgacaaccccacctggatcatcgaccccatcgacggcaccaccaacttcgtgcacagattccccttcgtggccgtgagcatcggcttcgccgtgaacaagaagatcgagttcggcgtggtgtacagctgcgtggagggcaagatgtacaccgccagaaagggcaagggcgccttctgcaacggccagaagctgcaggtgagccagcaggaggacatcaccaagagcctgctggtgaccgagctgggcagcagcagaacccccgagaccgtgagaatggtgctgagcaacatggagaagctgttctgcatccccgtgcacggcatcagaagcgtgggcaccgccgccgtgaacatgtgcctggtggccaccggcggcgccgacgcctactacgagatgggcatccactgctgggacgtggccggcgccggcatcatcgtgaccgaggccggcggcgtgctgatggacgtgaccggcggccccttcgacctgatgagcagaagagtgatcgccgccaacaacagaatcctggccgagagaatcgccaaggagatccaggtgatccccctgcagagagacgacgaggactag

SEQ ID NO: 85277 - DNA, 462 bp, Artificial Sequence
  Description of Artificial Sequence: Synthetic coding sequence
atggccgacccctggcaggagtgcatggactacgccgtgaccctggccagacaggccggcgaggtggtgtgcgaggccatcaagaacgagatgaacgtgatgctgaagagcagccccgtggacctggtgaccgccaccgaccagaaggtggagaagatgctgatcagcagcatcaaggagaagtaccccagccacagattccccttcgtggccgtgagcatcggcttcgccgtgaacaagaagatcgagttcggcgtggtgtacagctgcgtggagggcaagatgtacaccgccagaaagggcaagggcgccttctgcaacggccagaagctgcaggtgagccagcaggaggacatcaccaagagcctgctggtgaccgagctgggcagcagcagaacccccgagaccgtgagaatggtgctgagcaacatggagaagctgttctgcatccccgtgcactag

SEQ ID NO: 85278 - DNA, 636 bp, Artificial Sequence
  Description of Artificial Sequence: Synthetic coding sequence
atgggccagagacccggccccgtgctgcccgccgtggccgtgctgggccaggtggccaagagaaaggtggcctggctgctgagatggaaggccgtgaccagaaccgagaccgccggcaacagcagcggcgtgtacggcttcggcaagatgaagatcttcgtgaagtacttccagaagatggccgacccctggcaggagtgcatggactacgccgtgaccctggccagacaggccggcgaggtggtgtgcgaggccatcaagaacgagatgaacgtgatgctgaagagcagccccgtggacctggtgaccgccaccgaccagaaggtggagaagatgctgatcagcagcatcaaggagaagtaccccagccacagcttcatcggcgaggagagcgtggccgccggcgagaagagcatcctgaccgacaaccccacctggatcatcgaccccatcgacggcaccaccaacttcgtgcacagattccccttcgtggccgtgagcatcggcttcgccgtgaacaagaagatcgagttcggcgtggtgtacagctgcgtggagggcaagatgtacaccgccagaaagggcaagggcgccttctgcaacggccagaagctgcaggtgagccagcaggagtag

SEQ ID NO: 85279 - DNA, 867 bp, Artificial Sequence
  Description of Artificial Sequence: Synthetic coding sequence
atgaagcccagcggcgaggaccaggccgccctggccgccggcccctgggaggagtgcttccaggccgccgtgcagctggccctgagagccggccagatcatcagaaaggccctgaccgaggagaagagagtgagcaccaagaccagcgccgccgacctggtgaccgagaccgaccacctggtggaggacctgatcatcagcgagctgagagagagattccccagccacagattcatcgccgaggaggccgccgccagcggcgccaagtgcgtgctgacccacagccccacctggatcatcgaccccatcgacggcacctgcaacttcgtgcacagattccccaccgtggccgtgagcatcggcttcgccgtgagacaggagctggagttcggcgtgatctaccactgcaccgaggagagactgtacaccggcagaagaggcagaggcgccttctgcaacggccagagactgagagtgagcggcgagaccgacctgagcaaggccctggtgctgaccgagatcggccccaagagagaccccgccaccctgaagctgttcctgagcaacatggagagactgctgcacgccaaggcccacggcgtgagagtgatcggcagcagcaccctggccctgtgccacctggccagcggcgccgccgacgcctactaccagttcggcctgcactgctgggacctggccgccgccaccgtgatcatcagagaggccggcggcatcgtgatcgacaccagcggcggccccctggacctgatggcctgcagagtggtggccgccagcaccagagagatggccatgctgatcgcccaggccctgcagaccatcaactacggcagagacgacgagaagtag

SEQ ID NO: 85280 - DNA, 258 bp, Artificial Sequence
  Description of Artificial Sequence: Synthetic coding sequence
atgaagcccagcggcgaggaccaggccgccctggccgccggcccctgggaggagtgcttccaggccgccgtgcagctggccctgagagccggccagatcatcagaaaggccctgaccgaggagaagagagtgagcaccaagaccagcgccgccgacctggtgaccgagaccgaccacctggtggaggacctgatcatcagcgagctgagagagagattccccagccacagaagccccttcagcctggtgcacatgtag

SEQ ID NO: 85281 - DNA, 1071 bp, Artificial Sequence
  Description of Artificial Sequence: Synthetic coding sequence
atgctggagcagatcagaagagacatcagagacttcagaagcagcgccggcctggacaaggtgatcgtgctgtggaccgccaacaccgagagattctgcgaggtgatccccggcctgaacgacaccgccgagaacctgctgagaaccatcgagctgggcctggaggtgagccccagcaccctgttcgccgtggccagcatcctggagggctgcgccttcctgaacggcagcccccagaacaccctggtgcccggcgccctggagctggcctggcagcacagagtgttcgtgggcggcgacgacttcaagagcggccagaccaaggtgaagagcgtgctggtggacttcctgatcggcagcggcctgaagaccatgagcatcgtgagctacaaccacctgggcaacaacgacggcgagaacctgagcgcccccctgcagttcagaagcaaggaggtgagcaagagcaacgtggtggacgacatggtgcagagcaaccccgtgctgtacacccccggcgaggagcccgaccactgcgtggtgatcaagtacgtgccctacgtgggcgacagcaagagagccctggacgagtacaccagcgagctgatgctgggcggcaccaacaccctggtgctgcacaacacctgcgaggacagcctgctggccgcccccatcatgctggacctggccctgctgaccgagctgtgccagagagtgagcttctgcaccgacatggaccccgagccccagaccttccaccccgtgctgagcctgctgagcttcctgttcaaggcccccctggtgccccccggcagccccgtggtgaacgccctgttcagacagagaagctgcatcgagaacatcctgagagcctgcgtgggcctgcccccccagaaccacatgctgctggagcacaagatggagagacccggccccagcctgaagagagtgggccccgtggccgccacctaccccatgctgaacaagaagggccccgtgcccgccgccaccaacggctgcaccggcgacgccaacggccacctgcaggaggagccccccatgcccaccacctag

SEQ ID NO: 85282 - DNA, 1677 bp, Artificial Sequence
  Description of Artificial Sequence: Synthetic coding sequence
atggaggccgccgcccagttcttcgtggagagccccgacgtggtgtacggccccgaggccatcgaggcccagtacgagtacagaaccaccagagtgagcagagagggcggcgtgctgaaggtgcaccccaccagcaccagattcaccttcagaaccgccagacaggtgcccagactgggcgtgatgctggtgggctggggcggcaacaacggcagcaccctgaccgccgccgtgctggccaacagactgagactgagctggcccaccagaagcggcagaaaggaggccaactactacggcagcctgacccaggccggcaccgtgagcctgggcctggacgccgagggccaggaggtgttcgtgcccttcagcgccgtgctgcccatggtggcccccaacgacctggtgttcgacggctgggacatcagcagcctgaacctggccgaggccatgagaagagccaaggtgctggactggggcctgcaggagcagctgtggccccacatggaggccctgagacccagacccagcgtgtacatccccgagttcatcgccgccaaccagagcgccagagccgacaacctgatccccggcagcagagcccagcagctggagcagatcagaagagacatcagagacttcagaagcagcgccggcctggacaaggtgatcgtgctgtggaccgccaacaccgagagattctgcgaggtgatccccggcctgaacgacaccgccgagaacctgctgagaaccatcgagctgggcctggaggtgagccccagcaccctgttcgccgtggccagcatcctggagggctgcgccttcctgaacggcagcccccagaacaccctggtgcccggcgccctggagctggcctggcagcacagagtgttcgtgggcggcgacgacttcaagagcggccagaccaaggtgaagagcgtgctggtggacttcctgatcggcagcggcctgaagaccatgagcatcgtgagctacaaccacctgggcaacaacgacggcgagaacctgagcgcccccctgcagttcagaagcaaggaggtgagcaagagcaacgtggtggacgacatggtgcagagcaaccccgtgctgtacacccccggcgaggagcccgaccactgcgtggtgatcaagtacgtgccctacgtgggcgacagcaagagagccctggacgagtacaccagcgagctgatgctgggcggcaccaacaccctggtgctgcacaacacctgcgaggacagcctgctggccgcccccatcatgctggacctggccctgctgaccgagctgtgccagagagtgagcttctgcaccgacatggaccccgagccccagaccttccaccccgtgctgagcctgctgagcttcctgttcaaggcccccctggtgccccccggcagccccgtggtgaacgccctgttcagacagagaagctgcatcgagaacatcctgagagcctgcgtgggcctgcccccccagaaccacatgctgctggagcacaagatggagagacccggccccagcctgaagagagtgggccccgtggccgccacctaccccatgctgaacaagaagggccccgtgcccgccgccaccaacggctgcaccggcgacgccaacggccacctgcaggaggagccccccatgcccaccacctag

SEQ ID NO: 85283 - DNA, 1515 bp, Artificial Sequence
  Description of Artificial Sequence: Synthetic coding sequence
atggaggccgccgcccagttcttcgtggagagccccgacgtggtgtacggccccgaggccatcgaggcccagtacgagtacagaaccaccagagtgagcagagagggcggcgtgctgaaggaggccaactactacggcagcctgacccaggccggcaccgtgagcctgggcctggacgccgagggccaggaggtgttcgtgcccttcagcgccgtgctgcccatggtggcccccaacgacctggtgttcgacggctgggacatcagcagcctgaacctggccgaggccatgagaagagccaaggtgctggactggggcctgcaggagcagctgtggccccacatggaggccctgagacccagacccagcgtgtacatccccgagttcatcgccgccaaccagagcgccagagccgacaacctgatccccggcagcagagcccagcagctggagcagatcagaagagacatcagagacttcagaagcagcgccggcctggacaaggtgatcgtgctgtggaccgccaacaccgagagattctgcgaggtgatccccggcctgaacgacaccgccgagaacctgctgagaaccatcgagctgggcctggaggtgagccccagcaccctgttcgccgtggccagcatcctggagggctgcgccttcctgaacggcagcccccagaacaccctggtgcccggcgccctggagctggcctggcagcacagagtgttcgtgggcggcgacgacttcaagagcggccagaccaaggtgaagagcgtgctggtggacttcctgatcggcagcggcctgaagaccatgagcatcgtgagctacaaccacctgggcaacaacgacggcgagaacctgagcgcccccctgcagttcagaagcaaggaggtgagcaagagcaacgtggtggacgacatggtgcagagcaaccccgtgctgtacacccccggcgaggagcccgaccactgcgtggtgatcaagtacgtgccctacgtgggcgacagcaagagagccctggacgagtacaccagcgagctgatgctgggcggcaccaacaccctggtgctgcacaacacctgcgaggacagcctgctggccgcccccatcatgctggacctggccctgctgaccgagctgtgccagagagtgagcttctgcaccgacatggaccccgagccccagaccttccaccccgtgctgagcctgctgagcttcctgttcaaggcccccctggtgccccccggcagccccgtggtgaacgccctgttcagacagagaagctgcatcgagaacatcctgagagcctgcgtgggcctgcccccccagaaccacatgctgctggagcacaagatggagagacccggccccagcctgaagagagtgggccccgtggccgccacctaccccatgctgaacaagaagggccccgtgcccgccgccaccaacggctgcaccggcgacgccaacggccacctgcaggaggagccccccatgcccaccacctag

SEQ ID NO: 85284 - DNA, 1227 bp, Artificial Sequence
  Description of Artificial Sequence: Synthetic coding sequence
atgagaagagccaaggtgctggactggggcctgcaggagcagctgtggccccacatggaggccctgagacccagacccagcgtgtacatccccgagttcatcgccgccaaccagagcgccagagccgacaacctgatccccggcagcagagcccagcagctggagcagatcagaagagacatcagagacttcagaagcagcgccggcctggacaaggtgatcgtgctgtggaccgccaacaccgagagattctgcgaggtgatccccggcctgaacgacaccgccgagaacctgctgagaaccatcgagctgggcctggaggtgagccccagcaccctgttcgccgtggccagcatcctggagggctgcgccttcctgaacggcagcccccagaacaccctggtgcccggcgccctggagctggcctggcagcacagagtgttcgtgggcggcgacgacttcaagagcggccagaccaaggtgaagagcgtgctggtggacttcctgatcggcagcggcctgaagaccatgagcatcgtgagctacaaccacctgggcaacaacgacggcgagaacctgagcgcccccctgcagttcagaagcaaggaggtgagcaagagcaacgtggtggacgacatggtgcagagcaaccccgtgctgtacacccccggcgaggagcccgaccactgcgtggtgatcaagtacgtgccctacgtgggcgacagcaagagagccctggacgagtacaccagcgagctgatgctgggcggcaccaacaccctggtgctgcacaacacctgcgaggacagcctgctggccgcccccatcatgctggacctggccctgctgaccgagctgtgccagagagtgagcttctgcaccgacatggaccccgagccccagaccttccaccccgtgctgagcctgctgagcttcctgttcaaggcccccctggtgccccccggcagccccgtggtgaacgccctgttcagacagagaagctgcatcgagaacatcctgagagcctgcgtgggcctgcccccccagaaccacatgctgctggagcacaagatggagagacccggccccagcctgaagagagtgggccccgtggccgccacctaccccatgctgaacaagaagggccccgtgcccgccgccaccaacggctgcaccggcgacgccaacggccacctgcaggaggagccccccatgcccaccacctag

SEQ ID NO: 85285 - DNA, 1386 bp, Artificial Sequence
  Description of Artificial Sequence: Synthetic coding sequence
atgaccctgcccggcggccccaccggcatggccagacccggcggcgccagaccctgcagccccggcctggagagagcccccagaagaagcgtgggcgagctgagactgctgttcgaggccagatgcgccgccgtggccgccgccgccgccgccggcgagcccagagccagaggcgccaagagaagaggcggccaggtgcccaacggcctgcccagagccccccccgcccccgtgatcccccagctgaccgtgaccgccgaggagcccgacgtgccccccaccagccccggcccccccgagagagagagagactgcctgcccgccgccggcagcagccacctgcagcagcccagaagactgagcaccagcagcgtgagcagcaccggcagcagcagcctgctggaggacagcgaggacgacctgctgagcgacagcgagagcagaagcagaggcaacgtgcagctggaggccggcgaggacgtgggccagaagaaccactggcagaagatcagaaccatggtgaacctgcccgtgatcagccccttcaagaagagatacgcctgggtgcagctggccggccacaccggcagcttcaaggccgccggcaccagcggcctgatcctgaagagatgcagcgagcccgagagatactgcctggccagactgatggccgacgccctgagaggctgcgtgcccgccttccacggcgtggtggagagagacggcgagagctacctgcagctgcaggacctgctggacggcttcgacggcccctgcgtgctggactgcaagatgggcgtgagaacctacctggaggaggagctgaccaaggccagagagagacccaagctgagaaaggacatgtacaagaagatgctggccgtggaccccgaggcccccaccgaggaggagcacgcccagagagccgtgaccaagcccagatacatgcagtggagagagggcatcagcagcagcaccaccctgggcttcagaatcgagggcatcaagaaggccgacggcagctgcagcaccgacttcaagaccaccagaagcagagagcaggtgctgagagtgttcgaggagttcgtgcagggcgacgaggaggtgctgagaagatacctgaacagactgcagcagatcagagacaccctggaggtgagcgagttcttcagaagacacgaggtgatcggcagcagcctgctgttcgtgcacgaccactgccacagagccggcgtgtggctgatcgacttcggcaagaccacccccctgcccgacggccagatcctggaccacagaagaccctgggaggagggcaacagagaggacggctacctgctgggcctggacaacctgatcggcatcctggccagcctggccgagagatag

SEQ ID NO: 85286 - DNA, 2841 bp, Artificial Sequence
  Description of Artificial Sequence: Synthetic coding sequence
atggccgtgtactgctacgccctgaacagcctggtgatcatgaacagcgccaacgagatgaagagcggcggcggccccggccccagcggcagcgagaccccccccccccccagaagagccgtgctgagccccggcagcgtgttcagccccggcagaggcgccagcttcctgttcccccccgccgagagcctgagccccgaggagcccagaagccccggcggctggagaagcggcagaagaagactgaacagcagcagcggcagcggcagcggcagcagcggcagcagcgtgagcagccccagctgggccggcagactgagaggcgacagacagcaggtggtggccgccggcaccctgagcccccccggccccgaggaggccaagagaaagctgagaatcctgcagagagagctgcagaacgtgcaggtgaaccagaaggtgggcatgttcgaggcccacatccaggcccagagcagcgccatccaggcccccagaagccccagactgggcagagccagaagccccagcccctgccccttcagaagcagcagccagccccccggcagagtgctggtgcagggcgccagaagcgaggagagaagaaccaagagctggggcgagcagtgccccgagaccagcggcaccgacagcggcagaaagggcggccccagcctgtgcagcagccaggtgaagaagggcatgccccccctgcccggcagagccgcccccaccggcagcgaggcccagggccccagcgccttcgtgagaatggagaagggcatccccgccagccccagatgcggcagccccaccgccatggagatcgacaagagaggcagccccacccccggcaccagaagctgcctggcccccagcctgggcctgttcggcgccagcctgaccatggccaccgaggtggccgccagagtgaccagcaccggcccccacagaccccaggacctggccctgaccgagcccagcggcagagccagagagctggaggacctgcagccccccgaggccctggtggagagacagggccagttcctgggcagcgagaccagccccgcccccgagagaggcggccccagagacggcgagccccccggcaagatgggcaagggctacctgccctgcggcatgcccggcagcggcgagcccgaggtgggcaagagacccgaggagaccaccgtgagcgtgcagagcgccgagagcagcgacagcctgagctggagcagactgcccagagccctggccagcgtgggccccgaggaggccagaagcggcgcccccgtgggcggcggcagatggcagctgagcgacagagtggagggcggcagccccaccctgggcctgctgggcggcagccccagcgcccagcccggcaccggcaacgtggaggccggcatccccagcggcagaatgctggagcccctgccctgctgggacgccgccaaggacctgaaggagccccagtgcccccccggcgacagagtgggcgtgcagcccggcaacagcagagtgtggcagggcaccatggagaaggccggcctggcctggaccagaggcaccggcgtgcagagcgagggcacctgggagagccagagacaggacagcgacgccctgcccagccccgagctgctgccccaggaccccgacaagcccttcctgagaaaggcctgcagccccagcaacatccccgccgtgatcatcaccgacatgggcacccaggaggacggcgccctggaggagacccagggcagccccagaggcaacctgcccctgagaaagctgagcagcagcagcgccagcagcaccggcttcagcagcagctacgaggacagcgaggaggacatcagcagcgaccccgagagaaccctggaccccaacagcgccttcctgcacaccctggaccagcagaagcccagagtgagcaagagctggagaaagatcaagaacatggtgcactggagccccttcgtgatgagcttcaagaagaagtacccctggatccagctggccggccacgccggcagcttcaaggccgccgccaacggcagaatcctgaagaagcactgcgagagcgagcagagatgcctggacagactgatggtggacgtgctgagacccttcgtgcccgcctaccacggcgacgtggtgaaggacggcgagagatacaaccagatggacgacctgctggccgacttcgacagcccctgcgtgatggactgcaagatgggcatcagaacctacctggaggaggagctgaccaaggccagaaagaagcccagcctgagaaaggacatgtaccagaagatgatcgaggtggaccccgaggcccccaccgaggaggagaaggcccagagagccgtgaccaagcccagatacatgcagtggagagagaccatcagcagcaccgccaccctgggcttcagaatcgagggcatcaagaaggaggacggcaccgtgaacagagacttcaagaagaccaagaccagagagcaggtgaccgaggccttcagagagttcaccaagggcaaccacaacatcctgatcgcctacagagacagactgaaggccatcagaaccaccctggaggtgagccccttcttcaagtgccacgaggtgatcggcagcagcctgctgttcatccacgacaagaaggagcaggccaaggtgtggatgatcgacttcggcaagaccacccccctgcccgagggccagaccctgcagcacgacgtgccctggcaggagggcaacagagaggacggctacctgagcggcctgaacaacctggtggacatcctgaccgagatgagccaggacgcccccctggcctag

SEQ ID NO: 85287 - DNA, 1935 bp, Artificial Sequence
  Description of Artificial Sequence: Synthetic coding sequence
atggccgtgtactgctacgccctgaacagcctggtgatcatgaacagcgccaacgagatgaagagcggcggcggccccggccccagcggcagcgagaccccccccccccccagaagagccgtgctgagccccggcagcgtgttcagccccggcagaggcgccagcttcctgttcccccccgccgagagcctgagccccgaggagcccagaagccccggcggctggagaagcggcagaagaagactgaacagcagcagcggcagcggcagcggcagcagcggcagcagcgtgagcagccccagctgggccggcagactgagaggcgacagacagcaggtggtggccgccggcaccctgagcccccccggccccgaggaggccaagagaaagctgagaatcctgcagagagagctgcagaacgtgcaggtgaaccagaaggtgggcatgttcgaggcccacatccaggcccagagcagcgccatccaggcccccagaagccccagactgggcagagccagaagccccagcccctgccccttcagaagcagcagccagccccccggcagagtgctggtgcagggcgccagaagcgaggagagaagaaccaagagctggggcgagcagtgccccgagaccagcggcaccgacagcggcagaaagggcggccccagcctgtgcagcagccaggtgaagaagggcatgccccccctgcccggcagagccgcccccaccggcagcgaggcccagggccccagcgccttcgtgagaatggagaagggcatccccgccagccccagatgcggcagccccaccgccatggagatcgacaagagaggcagccccacccccggcaccagaagctgcctggcccccagcctgggcctgttcggcgccagcctgaccatggccaccgaggtggccgccagagtgaccagcaccggcccccacagaccccaggacctggccctgaccgagcccagcggcagagccagagagctggaggacctgcagccccccgaggccctggtggagagacagggccagttcctgggcagcgagaccagccccgcccccgagagaggcggccccagagacggcgagccccccggcaagatgggcaagggctacctgccctgcggcatgcccggcagcggcgagcccgaggtgggcaagagacccgaggagaccaccgtgagcgtgcagagcgccgagagcagcgacagcctgagctggagcagactgcccagagccctggccagcgtgggccccgaggaggccagaagcggcgcccccgtgggcggcggcagatggcagctgagcgacagagtggagggcggcagccccaccctgggcctgctgggcggcagccccagcgcccagcccggcaccggcaacgtggaggccggcatccccagcggcagaatgctggagcccctgccctgctgggacgccgccaaggacctgaaggagccccagtgcccccccggcgacagagtgggcgtgcagcccggcaacagcagagtgtggcagggcaccatggagaaggccggcctggcctggaccagaggcaccggcgtgcagagcgagggcacctgggagagccagagacaggacagcgacgccctgcccagccccgagctgctgccccaggaccccgacaagcccttcctgagaaaggcctgcagccccagcaacatccccgccgtgatcatcaccgacatgggcacccaggaggacggcgccctggaggagacccagggcagccccagaggcaacctgcccctgagaaagctgagcagcagcagcgccagcagcaccggcttcagcagcagctacgaggacagcgaggaggacatcagcagcgaccccgagagaaccctggaccccaacagcgccttcctgcacaccctggaccagcagaagcccagagtgtag

SEQ ID NO: 85288 - DNA, 2841 bp, Artificial Sequence; identical to SEQ ID NO: 85286
  Description of Artificial Sequence: Synthetic coding sequence

SEQ ID NO: 85289 - DNA, 2052 bp, Artificial Sequence
  Description of Artificial Sequence: Synthetic coding sequence
atgagaagatgcccctgcagaggcagcctgaacgaggccgaggccggcgccctgcccgccgccgccagaatgggcctggaggcccccagaggcggcagaagaagacagcccggccagcagagacccggccccggcgccggcgcccccgccggcagacccgagggcggcggcccctgggccagaaccgagggcagcagcctgcacagcgagcccgagagagccggcctgggccccgcccccggcaccgagagcccccaggccgagttctggaccgacggccagaccgagcccgccgccgccggcctgggcgtggagaccgagagacccaagcagaagaccgagcccgacagaagcagcctgagaacccacctggagtggagctggagcgagctggagaccacctgcctgtggaccgagaccggcaccgacggcctgtggaccgacccccacagaagcgacctgcagttccagcccgaggaggccagcccctggacccagcccggcgtgcacggcccctggaccgagctggagacccacggcagccagacccagcccgagagagtgaagagctgggccgacaacctgtggacccaccagaacagcagcagcctgcagacccaccccgagggcgcctgccccagcaaggagcccagcgccgacggcagctggaaggagctgtacaccgacggcagcagaacccagcaggacatcgagggcccctggaccgagccctacaccgacggcagccagaagaagcaggacaccgaggccgccagaaagcagcccggcaccggcggcttccagatccagcaggacaccgacggcagctggacccagcccagcaccgacggcagccagaccgcccccggcaccgactgcctgctgggcgagcccgaggacggccccctggaggagcccgagcccggcgagctgctgacccacctgtacagccacctgaagtgcagccccctgtgccccgtgcccagactgatcatcacccccgagacccccgagcccgaggcccagcccgtgggcccccccagcagagtggagggcggcagcggcggcttcagcagcgccagcagcttcgacgagagcgaggacgacgtggtggccggcggcggcggcgccagcgaccccgaggacagaagcggcagcaagccctggaagaagctgaagaccgtgctgaagtacagccccttcgtggtgagcttcagaaagcactacccctgggtgcagctgagcggccacgccggcaacttccaggccggcgaggacggcagaatcctgaagagattctgccagtgcgagcagagaagcctggagcagctgatgaaggaccccctgagacccttcgtgcccgcctactacggcatggtgctgcaggacggccagaccttcaaccagatggaggacctgctggccgacttcgagggccccagcatcatggactgcaagatgggcagcagaacctacctggaggaggagctggtgaaggccagagagagacccagacccagaaaggacatgtacgagaagatggtggccgtggaccccggcgcccccacccccgaggagcacgcccagggcgccgtgaccaagcccagatacatgcagtggagagagaccatgagcagcaccagcaccctgggcttcagaatcgagggcatcaagaaggccgacggcacctgcaacaccaacttcaagaagacccaggccctggagcaggtgaccaaggtgctggaggacttcgtggacggcgaccacgtgatcctgcagaagtacgtggcctgcctggaggagctgagagaggccctggagatcagccccttcttcaagacccacgaggtggtgggcagcagcctgctgttcgtgcacgaccacaccggcctggccaaggtgtggatgatcgacttcggcaagaccgtggccctgcccgaccaccagaccctgagccacagactgccctgggccgagggcaacagagaggacggctacctgtggggcctggacaacatgatctgcctgctgcagggcctggcccagagctag

SEQ ID NO: 85290 - DNA, 1740 bp, Artificial Sequence
  Description of Artificial Sequence: Synthetic coding sequence
atgagaagaccccccggcaacggcgaggccgccagcgagggccccggcggctggggcctgtggggcgtgcaggagagcagaagactgtgctgcgccggccacgacagatgcaagcaggccctgctgcagatcggcatcaacatgatggccctgcccggcggcagacacctggacagcgtgaccctgcccggccagagactgcacctgatgcaggtggacagcgtgcagagatggatggaggacctgaagctgatgaccgagtgcgagtgcatgtgcgtgctgcaggccaagcccatcagcctggaggaggacgcccagggcgacctgatcctggccggcggccccggccccggcgaccccctgcagctgctgctgaagagaggctgggtgatcagcaccgagctgagaagaatcggccagaagctggcccaggacagatgggccagagtgcacagcatgagcgtgagactgacctgccacgccagaagcatggtgagcgagtacagcgccgtgagcagaaacagcctgaaggagatgggcgagatcgagaagctgctgatggagaagtgcagcgagctgagcgccgtgaccgagagatgcctgcaggtggagaacgagcacgtgctgaagagcatgaaggcctgcgtgagcgagaccctgagcatgctgggccagcacttcggccagctgctggagctggccctgaccagagaggtgcaggccctggtgagaaagatcgacgccagcgacaacatctacaccaccgagagcaccaccggcaacctgttcagcctgacccaggagggcgcccccctgtgcagaatcatcgccaaggagggcggcgtggtggccctgttcaaggtgtgcagacaggacagcttcagatgcctgtacccccaggccctgagaaccctggccagcatctgctgcgtggaggagggcgtgcaccagctggagaaggtggacggcgtgctgtgcctggccgacatcctgaccgacaacagccacagcgaggccaccagagccgaggccgccgccgtggtggcccaggtgaccagcccccacctgcccgtgacccagcacctgagcagcttcctggagagcatggaggagatcgtgaccgccctggtgaagctgtgccaggaggccagcagcggcgaggtgttcctgctggccagcgccgccctggccaacatcaccttcttcgacaccatggcctgcgagatgctgctgcagctgaacgccatcagagtgctgctggaggcctgcagcgacaagcagagagtggacaccccctacaccagagaccagatcgtgaccatcctggccaacatgagcgtgctggagcagtgcgccagcgacatcatccaggagaacggcgtgcagctgatcatgggcatgctgagcgagaagcccagaagcggcacccccgccgaggtggccgcctgcgagagagtgcagcagaaggccgccgtgaccctggccagactgagcagagaccccgacgtggccagagaggccgtgagactgagctgcatgagcagactgatcgagctgtgcagaagccccagcgagagaaacagcagcgacgccgtgctggtggcctgcctggccgccctgagaagactggccggcgtgtgccccgagggcctgcaggacagcgacttccagcagctggtgcagcccagactggtggacagcttcctgctgtgcagcaacatggaggagagcttcgtgtag

SEQ ID NO: 85291 - DNA, 1599 bp, Artificial Sequence
  Description of Artificial Sequence: Synthetic coding sequence
atgatggccctgcccggcggcagacacctggacagcgtgaccctgcccggccagagactgcacctgatgcaggtggacagcgtgcagagatggatggaggacctgaagctgatgaccgagtgcgagtgcatgtgcgtgctgcaggccaagcccatcagcctggaggaggacgcccagggcgacctgatcctggccggcggccccggccccggcgaccccctgcagctgctgctgaagagaggctgggtgatcagcaccgagctgagaagaatcggccagaagctggcccaggacagatgggccagagtgcacagcatgagcgtgagactgacctgccacgccagaagcatggtgagcgagtacagcgccgtgagcagaaacagcctgaaggagatgggcgagatcgagaagctgctgatggagaagtgcagcgagctgagcgccgtgaccgagagatgcctgcaggtggagaacgagcacgtgctgaagagcatgaaggcctgcgtgagcgagaccctgagcatgctgggccagcacttcggccagctgctggagctggccctgaccagagaggtgcaggccctggtgagaaagatcgacgccagcgacaacatctacaccaccgagagcaccaccggcaacctgttcagcctgacccaggagggcgcccccctgtgcagaatcatcgccaaggagggcggcgtggtggccctgttcaaggtgtgcagacaggacagcttcagatgcctgtacccccaggccctgagaaccctggccagcatctgctgcgtggaggagggcgtgcaccagctggagaaggtggacggcgtgctgtgcctggccgacatcctgaccgacaacagccacagcgaggccaccagagccgaggccgccgccgtggtggcccaggtgaccagcccccacctgcccgtgacccagcacctgagcagcttcctggagagcatggaggagatcgtgaccgccctggtgaagctgtgccaggaggccagcagcggcgaggtgttcctgctggccagcgccgccctggccaacatcaccttcttcgacaccatggcctgcgagatgctgctgcagctgaacgccatcagagtgctgctggaggcctgcagcgacaagcagagagtggacaccccctacaccagagaccagatcgtgaccatcctggccaacatgagcgtgctggagcagtgcgccagcgacatcatccaggagaacggcgtgcagctgatcatgggcatgctgagcgagaagcccagaagcggcacccccgccgaggtggccgcctgcgagagagtgcagcagaaggccgccgtgaccctggccagactgagcagagaccccgacgtggccagagaggccgtgagactgagctgcatgagcagactgatcgagctgtgcagaagccccagcgagagaaacagcagcgacgccgtgctggtggcctgcctggccgccctgagaagactggccggcgtgtgccccgagggcctgcaggacagcgacttccagcagctggtgcagcccagactggtggacagcttcctgctgtgcagcaacatggaggagagcttcgtgtag

SEQ ID NO: 85292 - DNA, 927 bp, Artificial Sequence
  Description of Artificial Sequence: Synthetic coding sequence
atgatggccctgcccggcggcagacacctggacagcgtgaccctgcccggccagagactgcacctgatgcaggtggacagcgtgcagagatggatggaggacctgaagctgatgaccgagtgcgagtgcatgtgcgtgctgcaggccaagcccatcagcctggaggaggacgcccagggcgacctgatcctggccggcggccccggccccggcgaccccctgcagctgctgctgaagagaggctgggtgatcagcaccgagctgagaagaatcggccagaagctggcccaggacagatgggccagagtgcacagcatgagcgtgagactgacctgccacgccagaagcatggtgagcgagtacagcgccgtgagcagaaacagcctgaaggagatgggcgagatcgagaagctgctgatggagaagtgcagcgagctgagcgccgtgaccgagagatgcctgcaggtggagaacgagcacgtgctgaagagcatgaaggcctgcgtgagcgagaccctgagcatgctgggccagcacttcggccagctgctggagctggccctgaccagagaggtgcaggtggagagccacagcgtgaccagactggagtgcagcggcgccatcagcgcccagtgcaacctgagactgctgggcagcagcgacagccccgccagcgccagccaggccctggtgagaaagatcgacgccagcgacaacatctacaccaccgagagcaccaccggcaacctgttcagcctgacccaggagggcgcccccctgtgcagaatcatcgccaaggagggcggcgtggtggccctgttcaaggtgtgcagacaggacagcttcagatgcctgtacccccaggccctgagaaccctggccagcatctgctgcgtggaggagggcgtgcaccagctggagaagtag

SEQ ID NO: 85293 - DNA, 1473 bp, Artificial Sequence
  Description of Artificial Sequence: Synthetic coding sequence
atgatggccctgcccggcggcagacacctggacagcgtgaccctgcccggccagagactgcacctgatgcaggtggacagcgtgcagagatggatggaggacctgaagctgatgaccgagtgcgagtgcatgtgcgtgctgcaggccaagcccatcagcctggaggaggacgcccagggcgacctgatcctggccggcggccccggccccggcgaccccctgcagctgctgctgaagagaggctgggtgatcagcaccgagctgagaagaatcggccagaagctggcccaggacagatgggccagagtgcacagcatgagcgtgagactgacctgccacgccagaagcatggtgagcgagtacagcgccgtgagcagaaacagcctgaaggagatgggcgagatcgagaagctgctgatggagaagtgcagcgagctgagcgccgtgaccgagagatgcctgcaggtggagaacgagcacgtgctgaagagcatgaaggcctgcgtgagcgagaccctgagcatgctgggccagcacttcggccagctgctggagctggccctgaccagagaggtgcaggccctggtgagaaagatcgacgccagcgacaacatctacaccaccgagagcaccaccggcaacctgttcagcctgacccaggagggcgcccccctgtgcagaatcatcgccaaggtggacggcgtgctgtgcctggccgacatcctgaccgacaacagccacagcgaggccaccagagccgaggccgccgccgtggtggcccaggtgaccagcccccacctgcccgtgacccagcacctgagcagcttcctggagagcatggaggagatcgtgaccgccctggtgaagctgtgccaggaggccagcagcggcgaggtgttcctgctggccagcgccgccctggccaacatcaccttcttcgacaccatggcctgcgagatgctgctgcagctgaacgccatcagagtgctgctggaggcctgcagcgacaagcagagagtggacaccccctacaccagagaccagatcgtgaccatcctggccaacatgagcgtgctggagcagtgcgccagcgacatcatccaggagaacggcgtgcagctgatcatgggcatgctgagcgagaagcccagaagcggcacccccgccgaggtggccgcctgcgagagagtgcagcagaaggccgccgtgaccctggccagactgagcagagaccccgacgtggccagagaggccgtgagactgagctgcatgagcagactgatcgagctgtgcagaagccccagcgagagaaacagcagcgacgccgtgctggtggcctgcctggccgccctgagaagactggccggcgtgtgccccgagggcctgcaggacagcgacttccagcagctggtgcagcccagactggtggacagcttcctgctgtgcagcaacatggaggagagcttcgtgtag

SEQ ID NO: 85294 - DNA, 1473 bp, Artificial Sequence; identical to SEQ ID NO: 85293
  Description of Artificial Sequence: Synthetic coding sequence

SEQ ID NO: 85295 - DNA, 1599 bp, Artificial Sequence; identical to SEQ ID NO: 85291
  Description of Artificial Sequence: Synthetic coding sequence

SEQ ID NO: 85296 - DNA, 834 bp, Artificial Sequence
  Description of Artificial Sequence: Synthetic coding sequence
atgcccagactgcacgaccacttctggagctgcagctgcgcccacagcgccagaagaagaggcccccccagagccagcgccgccggcctggccgccaaggtgggcgagatgatcaacgtgagcgtgagcggccccagcctgctggccgcccacggcgcccccgacgccgaccccgcccccagaggcagaagcgccgccatgagcggccccgagcccggcagcccctaccccaacacctggcaccacagactgctgcagagaagcctggtgctgttcagcgtgggcgtggtgctggccctggtgctgaacctgctgcagatccagagaaacgtgaccctgttccccgaggaggtgatcgccaccatcttcagcagcgcctggtgggtgcccccctgctgcggcaccgccgccgccgtggtgggcctgctgtacccctgcatcgacagccacctgggcgagccccacaagttcaagagagagtgggccagcgtgatgagatgcatcgccgtgttcgtgggcatcaaccacgccagcgccaagctggacttcgccaacaacgtgcagctgagcctgaccctggccgccctgagcctgggcctgtggtggaccttcgacagaagcagaagcggcctgggcctgggcatcaccatcgccttcctggccaccctgatcacccagttcctggtgtacaacggcgtgtaccagtacaccagccccgacttcctgtacatcagaagctggctgccctgcatcttcttcagcggcggcgtgaccgtgggcaacatcggcagacagctggccatgggcgtgcccgagaagccccacagcgactag

SEQ ID NO: 85297 - DNA, 537 bp, Artificial Sequence
  Description of Artificial Sequence: Synthetic coding sequence
atgcccagactgcacgaccacttctggagctgcagctgcgcccacagcgccagaagaagaggcccccccagagccagcgccaagctggacttcgccaacaacgtgcagctgagcctgaccctggccgccctgagcctgggcctgtggtggaccttcgacagaagcagaagcggcctgggcctgggcatcaccatcgccttcctggccaccctgatcacccagttcctggtgtacaacggcgtgtaccagtacaccagccccgacttcctgtacatcagaagctggctgccctgcatcttcttcagcggcggcgtgaccgtgggcaacatcggcagacagctggccatgctgatccccttctgcgaggagctgaacctgaagaccacctggctgttccacaagaccagaagcaactacagagtgttcctgaagagccccatcgtgatcgagagcagcaagccccccatcctgagagccagaaagatcctggaggagaacctgaccgtggactacgacaaggactacctgttcagctag

SEQ ID NO: 85298 - DNA, 372 bp, Artificial Sequence
  Description of Artificial Sequence: Synthetic coding sequence
atgcccagactgcacgaccacttctggagctgcagctgcgcccacagcgccagaagaagaggcccccccagagccagcgccgccggcctggccgccaaggtgggcgagatgatcaacgtgagcgtgagcggccccagcctgctggccgcccacggcgcccccgacgccgaccccgcccccagaggcagaagcgccgccatgagcggccccgagcccggcagcccctaccccaacacctggcaccacagactgctgcagagaagcctggtgctgttcagcgtgggcgtggtgctggccctggtgctgaacctgctgcagatccagagaaacgtgaccctgttccccgaggaggtgatcgccaccatcttctag

SEQ ID NO: 85299 - DNA, 495 bp, Artificial Sequence
  Description of Artificial Sequence: Synthetic coding sequence
atgcccagactgcacgaccacttctggagctgcagctgcgcccacagcgccagaagaagaggcccccccagagccagcgccgccggcctggccgccaaggtgggcgagatgatcaacgtgagcgtgagcggccccagcctgctggccgcccacggcgcccccgacgccgaccccgcccccagaggcagaagcgccgccatgagcggccccgagcccggcagcccctaccccaacacctggcaccacagactgctgcagagaagcctggtgctgttcagcgtgggcgtggtgctggccctggtgctgaacctgctgcagatccagagaaacgtgaccctgttccccgaggaggtgatcgccaccatcttcagcagcgcctggtgggtgcccccctgctgcggcaccgccgccggcatccacccccagatcagcagcatcttcgtgctgggcagcctggtgtacttcagccaggaggccagcagatggggcacctag

SEQ ID NO: 85300 - DNA, 678 bp, Artificial Sequence
  Description of Artificial Sequence: Synthetic coding sequence
atggccgagggcgagaccgagagccccggccccaagaagtgcggcccctacatcagcagcgtgaccagccagagcgtgaacctgatgatcagaggcgtggtgctgttcttcatcggcgtgttcctggccctggtgctgaacctgctgcagatccagagaaacgtgaccctgttcccccccgacgtgatcgccagcatcttcagcagcgcctggtgggtgcccccctgctgcggcaccgccagcgccgtgatcggcctgctgtacccctgcatcgacagacacctgggcgagccccacaagttcaagagagagtggagcagcgtgatgagatgcgtggccgtgttcgtgggcatcaaccacgccagcgccaaggtggacttcgacaacaacatccagctgagcctgaccctggccgccctgagcatcggcctgtggtggaccttcgacagaagcagaagcggcttcggcctgggcgtgggcatcgccttcctggccaccgtggtgacccagctgctggtgtacaacggcgtgtaccagtacaccagccccgacttcctgtacgtgagaagctggctgccctgcatcttcttcgccggcggcatcaccatgggcaacatcggcagacagctggccatgtacgagtgcaaggtgatcgccgagaagagccaccaggagtag

SEQ ID NO: 85301 - DNA, 4149 bp, Artificial Sequence
  Description of Artificial Sequence: Synthetic coding sequence
atggccaccggcggcagaagaggcgccgccgccgcccccctgctggtggccgtggccgccctgctgctgggcgccgccggccacctgtaccccggcgaggtgtgccccggcatggacatcagaaacaacctgaccagactgcacgagctggagaactgcagcgtgatcgagggccacctgcagatcctgctgatgttcaagaccagacccgaggacttcagagacctgagcttccccaagctgatcatgatcaccgactacctgctgctgttcagagtgtacggcctggagagcctgaaggacctgttccccaacctgaccgtgatcagaggcagcagactgttcttcaactacgccctggtgatcttcgagatggtgcacctgaaggagctgggcctgtacaacctgatgaacatcaccagaggcagcgtgagaatcgagaagaacaacgagctgtgctacctggccaccatcgactggagcagaatcctggacagcgtggaggacaactacatcgtgctgaacaaggacgacaacgaggagtgcggcgacatctgccccggcaccgccaagggcaagaccaactgccccgccaccgtgatcaacggccagttcgtggagagatgctggacccacagccactgccagaaggtgtgccccaccatctgcaagagccacggctgcaccgccgagggcctgtgctgccacagcgagtgcctgggcaactgcagccagcccgacgaccccaccaagtgcgtggcctgcagaaacttctacctggacggcagatgcgtggagacctgcccccccccctactaccacttccaggactggagatgcgtgaacttcagcttctgccaggacctgcaccacaagtgcaagaacagcagaagacagggctgccaccagtacgtgatccacaacaacaagtgcatccccgagtgccccagcggctacaccatgaacagcagcaacctgctgtgcaccccctgcctgggcccctgccccaaggtgtgccacctgctggagggcgagaagaccatcgacagcgtgaccagcgcccaggagctgagaggctgcaccgtgatcaacggcagcctgatcatcaacatcagaggcggcaacaacctggccgccgagctggaggccaacctgggcctgatcgaggagatcagcggctacctgaagatcagaagaagctacgccctggtgagcctgagcttcttcagaaagctgagactgatcagaggcgagaccctggagatcggcaactacagcttctacgccctggacaaccagaacctgagacagctgtgggactggagcaagcacaacctgaccatcacccagggcaagctgttcttccactacaaccccaagctgtgcctgagcgagatccacaagatggaggaggtgagcggcaccaagggcagacaggagagaaacgacatcgccctgaagaccaacggcgaccaggccagctgcgagaacgagctgctgaagttcagctacatcagaaccagcttcgacaagatcctgctgagatgggagccctactggccccccgacttcagagacctgctgggcttcatgctgttctacaaggaggccccctaccagaacgtgaccgagttcgacggccaggacgcctgcggcagcaacagctggaccgtggtggacatcgacccccccctgagaagcaacgaccccaagagccagaaccaccccggctggctgatgagaggcctgaagccctggacccagtacgccatcttcgtgaagaccctggtgaccttcagcgacgagagaagaacctacggcgccaagagcgacatcatctacgtgcagaccgacgccaccaaccccagcgtgcccctggaccccatcagcgtgagcaacagcagcagccagatcatcctgaagtggaagccccccagcgaccccaacggcaacatcacccactacctggtgttctgggagagacaggccgaggacagcgagctgttcgagctggactactgcctgaagggcctgaagctgcccagcagaacctggagcccccccttcgagagcgaggacagccagaagcacaaccagagcgagtacgaggacagcgccggcgagtgctgcagctgccccaagaccgacagccagatcctgaaggagctggaggagagcagcttcagaaagaccttcgaggactacctgcacaacgtggtgttcgtgcccagaaagaccagcagcggcaccggcgccgaggaccccagacccagcagaaagagaagaagcctgggcgacgtgggcaacgtgaccgtggccgtgcccaccgtggccgccttccccaacaccagcagcaccagcgtgcccaccagccccgaggagcacagacccttcgagaaggtggtgaacaaggagagcctggtgatcagcggcctgagacacttcaccggctacagaatcgagctgcaggcctgcaaccaggacacccccgaggagagatgcagcgtggccgcctacgtgagcgccagaaccatgcccgaggccaaggccgacgacatcgtgggccccgtgacccacgagatcttcgagaacaacgtggtgcacctgatgtggcaggagcccaaggagcccaacggcctgatcgtgctgtacgaggtgagctacagaagatacggcgacgaggagctgcacctgtgcgtgagcagaaagcacttcgccctggagagaggctgcagactgagaggcctgagccccggcaactacagcgtgagaatcagagccaccagcctggccggcaacggcagctggaccgagcccacctacttctacgtgaccgactacctggacgtgcccagcaacatcgccaagatcatcatcggccccctgatcttcgtgttcctgttcagcgtggtgatcggcagcatctacctgttcctgagaaagagacagcccgacggccccctgggccccctgtacgccagcagcaaccccgagtacctgagcgccagcgacgtgttcccctgcagcgtgtacgtgcccgacgagtgggaggtgagcagagagaagatcaccctgctgagagagctgggccagggcagcttcggcatggtgtacgagggcaacgccagagacatcatcaagggcgaggccgagaccagagtggccgtgaagaccgtgaacgagagcgccagcctgagagagagaatcgagttcctgaacgaggccagcgtgatgaagggcttcacctgccaccacgtggtgagactgctgggcgtggtgagcaagggccagcccaccctggtggtgatggagctgatggcccacggcgacctgaagagctacctgagaagcctgagacccgaggccgagaacaaccccggcagacccccccccaccctgcaggagatgatccagatggccgccgagatcgccgacggcatggcctacctgaacgccaagaagttcgtgcacagagacctggccgccagaaactgcatggtggcccacgacttcaccgtgaagatcggcgacttcggcatgaccagagacatctacgagaccgactactacagaaagggcggcaagggcctgctgcccgtgagatggatggcccccgagagcctgaaggacggcgtgttcaccaccagcagcgacatgtggagcttcggcgtggtgctgtgggagatcaccagcctggccgagcagccctaccagggcctgagcaacgagcaggtgctgaagttcgtgatggacggcggctacctggaccagcccgacaactgccccgagagagtgaccgacctgatgagaatgtgctggcagttcaaccccaagatgagacccaccttcctggagatcgtgaacctgctgaaggacgacctgcaccccagcttccccgaggtgagcttcttccacagcgaggagaacaaggcccccgagagcgaggagctggagatggagttcgaggacatggagaacgtgcccctggacagaagcagccactgccagagagaggaggccggcggcagagacggcggcagcagcctgggcttcaagagaagctacgaggagcacatcccctacacccacatgaacggcggcaagaagaacggcagaatcctgaccctgcccagaagcaaccccagctag

SEQ ID NO: 85302 - DNA, 4113 bp, Artificial Sequence
  Description of Artificial Sequence: Synthetic coding sequence
atggccaccggcggcagaagaggcgccgccgccgcccccctgctggtggccgtggccgccctgctgctgggcgccgccggccacctgtaccccggcgaggtgtgccccggcatggacatcagaaacaacctgaccagactgcacgagctggagaactgcagcgtgatcgagggccacctgcagatcctgctgatgttcaagaccagacccgaggacttcagagacctgagcttccccaagctgatcatgatcaccgactacctgctgctgttcagagtgtacggcctggagagcctgaaggacctgttccccaacctgaccgtgatcagaggcagcagactgttcttcaactacgccctggtgatcttcgagatggtgcacctgaaggagctgggcctgtacaacctgatgaacatcaccagaggcagcgtgagaatcgagaagaacaacgagctgtgctacctggccaccatcgactggagcagaatcctggacagcgtggaggacaactacatcgtgctgaacaaggacgacaacgaggagtgcggcgacatctgccccggcaccgccaagggcaagaccaactgccccgccaccgtgatcaacggccagttcgtggagagatgctggacccacagccactgccagaaggtgtgccccaccatctgcaagagccacggctgcaccgccgagggcctgtgctgccacagcgagtgcctgggcaactgcagccagcccgacgaccccaccaagtgcgtggcctgcagaaacttctacctggacggcagatgcgtggagacctgcccccccccctactaccacttccaggactggagatgcgtgaacttcagcttctgccaggacctgcaccacaagtgcaagaacagcagaagacagggctgccaccagtacgtgatccacaacaacaagtgcatccccgagtgccccagcggctacaccatgaacagcagcaacctgctgtgcaccccctgcctgggcccctgccccaaggtgtgccacctgctggagggcgagaagaccatcgacagcgtgaccagcgcccaggagctgagaggctgcaccgtgatcaacggcagcctgatcatcaacatcagaggcggcaacaacctggccgccgagctggaggccaacctgggcctgatcgaggagatcagcggctacctgaagatcagaagaagctacgccctggtgagcctgagcttcttcagaaagctgagactgatcagaggcgagaccctggagatcggcaactacagcttctacgccctggacaaccagaacctgagacagctgtgggactggagcaagcacaacctgaccatcacccagggcaagctgttcttccactacaaccccaagctgtgcctgagcgagatccacaagatggaggaggtgagcggcaccaagggcagacaggagagaaacgacatcgccctgaagaccaacggcgaccaggccagctgcgagaacgagctgctgaagttcagctacatcagaaccagcttcgacaagatcctgctgagatgggagccctactggccccccgacttcagagacctgctgggcttcatgctgttctacaaggaggccccctaccagaacgtgaccgagttcgacggccaggacgcctgcggcagcaacagctggaccgtggtggacatcgacccccccctgagaagcaacgaccccaagagccagaaccaccccggctggctgatgagaggcctgaagccctggacccagtacgccatcttcgtgaagaccctggtgaccttcagcgacgagagaagaacctacggcgccaagagcgacatcatctacgtgcagaccgacgccaccaaccccagcgtgcccctggaccccatcagcgtgagcaacagcagcagccagatcatcctgaagtggaagccccccagcgaccccaacggcaacatcacccactacctggtgttctgggagagacaggccgaggacagcgagctgttcgagctggactactgcctgaagggcctgaagctgcccagcagaacctggagcccccccttcgagagcgaggacagccagaagcacaaccagagcgagtacgaggacagcgccggcgagtgctgcagctgccccaagaccgacagccagatcctgaaggagctggaggagagcagcttcagaaagaccttcgaggactacctgcacaacgtggtgttcgtgcccagacccagcagaaagagaagaagcctgggcgacgtgggcaacgtgaccgtggccgtgcccaccgtggccgccttccccaacaccagcagcaccagcgtgcccaccagccccgaggagcacagacccttcgagaaggtggtgaacaaggagagcctggtgatcagcggcctgagacacttcaccggctacagaatcgagctgcaggcctgcaaccaggacacccccgaggagagatgcagcgtggccgcctacgtgagcgccagaaccatgcccgaggccaaggccgacgacatcgtgggccccgtgacccacgagatcttcgagaacaacgtggtgcacctgatgtggcaggagcccaaggagcccaacggcctgatcgtgctgtacgaggtgagctacagaagatacggcgacgaggagctgcacctgtgcgtgagcagaaagcacttcgccctggagagaggctgcagactgagaggcctgagccccggcaactacagcgtgagaatcagagccaccagcctggccggcaacggcagctggaccgagcccacctacttctacgtgaccgactacctggacgtgcccagcaacatcgccaagatcatcatcggccccctgatcttcgtgttcctgttcagcgtggtgatcggcagcatctacctgttcctgagaaagagacagcccgacggccccctgggccccctgtacgccagcagcaaccccgagtacctgagcgccagcgacgtgttcccctgcagcgtgtacgtgcccgacgagtgggaggtgagcagagagaagatcaccctgctgagagagctgggccagggcagcttcggcatggtgtacgagggcaacgccagagacatcatcaagggcgaggccgagaccagagtggccgtgaagaccgtgaacgagagcgccagcctgagagagagaatcgagttcctgaacgaggccagcgtgatgaagggcttcacctgccaccacgtggtgagactgctgggcgtggtgagcaagggccagcccaccctggtggtgatggagctgatggcccacggcgacctgaagagctacctgagaagcctgagacccgaggccgagaacaaccccggcagacccccccccaccctgcaggagatgatccagatggccgccgagatcgccgacggcatggcctacctgaacgccaagaagttcgtgcacagagacctggccgccagaaactgcatggtggcccacgacttcaccgtgaagatcggcgacttcggcatgaccagagacatctacgagaccgactactacagaaagggcggcaagggcctgctgcccgtgagatggatggcccccgagagcctgaaggacggcgtgttcaccaccagcagcgacatgtggagcttcggcgtggtgctgtgggagatcaccagcctggccgagcagccctaccagggcctgagcaacgagcaggtgctgaagttcgtgatggacggcggctacctggaccagcccgacaactgccccgagagagtgaccgacctgatgagaatgtgctggcagttcaaccccaagatgagacccaccttcctggagatcgtgaacctgctgaaggacgacctgcaccccagcttccccgaggtgagcttcttccacagcgaggagaacaaggcccccgagagcgaggagctggagatggagttcgaggacatggagaacgtgcccctggacagaagcagccactgccagagagaggaggccggcggcagagacggcggcagcagcctgggcttcaagagaagctacgaggagcacatcccctacacccacatgaacggcggcaagaagaacggcagaatcctgaccctgcccagaagcaaccccagctag

SEQ ID NO: 85303 - DNA, 252 bp, Artificial Sequence
  Description of Artificial Sequence: Synthetic coding sequence
ccctaccagaacgtgaccgagttcgacggccaggacgcctgcggcagcaacagctggaccgtggtggacatcgacccccccctgagaagcaacgaccccaagagccagaaccaccccggctggctgatgagaggcctgaagccctggacccagtacgccatcttcgtgaagaccctggtgaccttcagcgacgagagaagaacctacggcgccaagagcgacatcatctacgtgcagaccgacgccacctag

SEQ ID NO: 85304 - DNA, 4017 bp, Artificial Sequence
  Description of Artificial Sequence: Synthetic coding sequence
atggccagcccccccagacacggcccccccggccccgccagcggcgacggccccaacctgaacaacaacaacaacaacaacaaccacagcgtgagaaagtgcggctacctgagaaagcagaagcacggccacaagagattcttcgtgctgagaggccccggcgccggcggcgacgaggccaccgccggcggcggcagcgccccccagccccccagactggagtactacgagagcgagaagaagtggagaagcaaggccggcgcccccaagagagtgatcgccctggactgctgcctgaacatcaacaagagagccgacgccaagcacaagtacctgatcgccctgtacaccaaggacgagtacttcgccgtggccgccgagaacgagcaggagcaggagggctggtacagagccctgaccgacctggtgagcgagggcagagccgccgccggcgacgccccccccgccgccgcccccgccgccagctgcagcgccagcctgcccggcgccctgggcggcagcgccggcgccgccggcgccgaggacagctacggcctggtggcccccgccaccgccgcctacagagaggtgtggcaggtgaacctgaagcccaagggcctgggccagagcaagaacctgaccggcgtgtacagactgtgcctgagcgccagaaccatcggcttcgtgaagctgaactgcgagcagcccagcgtgaccctgcagctgatgaacatcagaagatgcggccacagcgacagcttcttcttcatcgaggtgggcagaagcgccgtgaccggccccggcgagctgtggatgcaggccgacgacagcgtggtggcccagaacatccacgagaccatcctggaggccatgaaggccctgaaggagctgttcgagttcagacccagaagcaagagccagagcagcggcagcagcgccacccaccccatcagcgtgcccggcgccagaagacaccaccacctggtgaacctgccccccagccagaccggcctggtgagaagaagcagaaccgacagcctggccgccaccccccccgccgccaagtgcagcagctgcagagtgagaaccgccagcgagggcgacggcggcgccgccgccggcgccgccgccgccggcgccagacccgtgagcgtggccggcagccccctgagccccggccccgtgagagcccccctgagcagaagccacaccctgagcggcggctgcggcggcagaggcagcaaggtggccctgctgcccgccggcggcgccctgcagcacagcagaagcatgagcatgcccgtggcccacagcccccccgccgccaccagccccggcagcctgagcagcagcagcggccacggcagcggcagctacccccccccccccggcccccacccccccctgccccaccccctgcaccacggccccggccagagacccagcagcggcagcgccagcgccagcggcagccccagcgaccccggcttcatgagcctggacgagtacggcagcagccccggcgacctgagagccttctgcagccacagaagcaacacccccgagagcatcgccgagaccccccccgccagagacggcggcggcggcggcgagttctacggctacatgaccatggacagacccctgagccactgcggcagaagctacagaagagtgagcggcgacgccgcccaggacctggacagaggcctgagaaagagaacctacagcctgaccacccccgccagacagagacccgtgccccagcccagcagcgccagcctggacgagtacaccctgatgagagccaccttcagcggcagcgccggcagactgtgccccagctgccccgccagcagccccaaggtggcctaccacccctaccccgaggactacggcgacatcgagatcggcagccacagaagcagcagcagcaacctgggcgccgacgacggctacatgcccatgacccccggcgccgccctggccggcagcggcagcggcagctgcagaagcgacgactacatgcccatgagccccgccagcgtgagcgcccccaagcagatcctgcagcccagagccgccgccgccgccgccgccgccgtgcccagcgccggccccgccggccccgcccccaccagcgccgccggcagaaccttccccgccagcggcggcggctacaaggccagcagccccgccgagagcagccccgaggacagcggctacatgagaatgtggtgcggcagcaagctgagcatggagcacgccgacggcaagctgctgcccaacggcgactacctgaacgtgagccccagcgacgccgtgaccaccggcaccccccccgacttcttcagcgccgccctgcaccccggcggcgagcccctgagaggcgtgcccggctgctgctacagcagcctgcccagaagctacaaggccccctacacctgcggcggcgacagcgaccagtacgtgctgatgagcagccccgtgggcagaatcctggaggaggagagactggagccccaggccacccccggccccagccaggccgccagcgccttcggcgccggccccacccagcccccccaccccgtggtgcccagccccgtgagacccagcggcggcagacccgagggcttcctgggccagagaggcagagccgtgagacccaccagactgagcctggagggcctgcccagcctgcccagcatgcacgagtaccccctgccccccgagcccaagagccccggcgagtacatcaacatcgacttcggcgagcccggcgccagactgagcccccccgccccccccctgctggccagcgccgccagcagcagcagcctgctgagcgccagcagccccgccagcagcctgggcagcggcacccccggcaccagcagcgacagcagacagagaagccccctgagcgactacatgaacctggacttcagcagccccaagagccccaagcccggcgcccccagcggccaccccgtgggcagcctggacggcctgctgagccccgaggccagcagcccctacccccccctgccccccagacccagcgccagccccagcagcagcctgcagccccccccccccccccccgcccccggcgagctgtacagactgccccccgccagcgccgtggccaccgcccagggccccggcgccgccagcagcctgagcagcgacaccggcgacaacggcgactacaccgagatggccttcggcgtggccgccacccccccccagcccatcgccgccccccccaagcccgaggccgccagagtggccagccccaccagcggcgtgaagagactgagcctgatggagcaggtgagcggcgtggaggccttcctgcaggccagccagccccccgacccccacagaggcgccaaggtgatcagagccgacccccagggcggcagaagaagacacagcagcgagaccttcagcagcaccaccaccgtgacccccgtgagccccagcttcgcccacaaccccaagagacacaacagcgccagcgtggagaacgtgagcctgagaaagagcagcgagggcggcgtgggcgtgggccccggcggcggcgacgagccccccaccagccccagacagctgcagcccgccccccccctggccccccagggcagaccctggacccccggccagcccggcggcctggtgggctgccccggcagcggcggcagccccatgagaagagagaccagcgccggcttccagaacggcctgaactacatcgccatcgacgtgagagaggagcccggcctgcccccccagccccagcccccccccccccccctgccccagcccggcgacaagagcagctggggcagaaccagaagcctgggcggcctgatcagcgccgtgggcgtgggcagcaccggcggcggctgcggcggccccggccccggcgccctgccccccgccaacacctacgccagcatcgacttcctgagccaccacctgaaggaggccaccatcgtgaaggagtag

SEQ ID NO: 85305 - DNA, 3894 bp, Artificial Sequence
  Description of Artificial Sequence: Synthetic coding sequence
atggccgtgcccagcctgtggccctggggcgcctgcctgcccgtgatcttcctgagcctgggcttcggcctggacaccgtggaggtgtgccccagcctggacatcagaagcgaggtggccgagctgagacagctggagaactgcagcgtggtggagggccacctgcagatcctgctgatgttcaccgccaccggcgaggacttcagaggcctgagcttccccagactgacccaggtgaccgactacctgctgctgttcagagtgtacggcctggagagcctgagagacctgttccccaacctggccgtgatcagaggcaccagactgttcctgggctacgccctggtgatcttcgagatgccccacctgagagacgtggccctgcccgccctgggcgccgtgctgagaggcgccgtgagagtggagaagaaccaggagctgtgccacctgagcaccatcgactggggcctgctgcagcccgcccccggcgccaaccacatcgtgggcaacaagctgggcgaggagtgcgccgacgtgtgccccggcgtgctgggcgccgccggcgagccctgcgccaagaccaccttcagcggccacaccgactacagatgctggaccagcagccactgccagagagtgtgcccctgcccccacggcatggcctgcaccgccagaggcgagtgctgccacaccgagtgcctgggcggctgcagccagcccgaggaccccagagcctgcgtggcctgcagacacctgtacttccagggcgcctgcctgtgggcctgcccccccggcacctaccagtacgagagctggagatgcgtgaccgccgagagatgcgccagcctgcacagcgtgcccggcagagccagcaccttcggcatccaccagggcagctgcctggcccagtgccccagcggcttcaccagaaacagcagcagcatcttctgccacaagtgcgagggcctgtgccccaaggagtgcaaggtgggcaccaagaccatcgacagcatccaggccgcccaggacctggtgggctgcacccacgtggagggcagcctgatcctgaacctgagacagggctacaacctggagccccagctgcagcacagcctgggcctggtggagaccatcaccggcttcctgaagatcaagcacagcttcgccctggtgagcctgggcttcttcaagaacctgaagctgatcagaggcgacgccatggtggacggcaactacaccctgtacgtgctggacaaccagaacctgcagcagctgggcagctgggtggccgccggcctgaccatccccgtgggcaagatctacttcgccttcaaccccagactgtgcctggagcacatctacagactggaggaggtgaccggcaccagaggcagacagaacaaggccgagatcaaccccagaaccaacggcgacagagccgcctgccagaccagaaccctgagattcgtgagcaacgtgaccgaggccgacagaatcctgctgagatgggagagatacgagcccctggaggccagagacctgctgagcttcatcgtgtactacaaggagagccccttccagaacgccaccgagcacgtgggccccgacgcctgcggcacccagagctggaacctgctggacgtggagctgcccctgagcagaacccaggagcccggcgtgaccctggccagcctgaagccctggacccagtacgccgtgttcgtgagagccatcaccctgaccaccgaggaggacagcccccaccagggcgcccagagccccatcgtgtacctgagaaccctgcccgccgcccccaccgtgccccaggacgtgatcagcaccagcaacagcagcagccacctgctggtgagatggaagccccccacccagagaaacggcaacctgacctactacctggtgctgtggcagagactggccgaggacggcgacctgtacctgaacgactactgccacagaggcctgagactgcccaccagcaacaacgaccccagattcgacggcgaggacggcgaccccgaggccgagatggagagcgactgctgcccctgccagcaccccccccccggccaggtgctgccccccctggaggcccaggaggccagcttccagaagaagttcgagaacttcctgcacaacgccatcaccatccccatcagcccctggaaggtgaccagcatcaacaagagcccccagagagacagcggcagacacagaagagccgccggccccctgagactgggcggcaacagcagcgacttcgagatccaggaggacaaggtgcccagagagagagccgtgctgagcggcctgagacacttcaccgagtacagaatcgacatccacgcctgcaaccacgccgcccacaccgtgggctgcagcgccgccaccttcgtgttcgccagaaccatgccccacagagaggccgacggcatccccggcaaggtggcctgggaggccagcagcaagaacagcgtgctgctgagatggctggagccccccgaccccaacggcctgatcctgaagtacgagatcaagtacagaagactgggcgaggaggccaccgtgctgtgcgtgagcagactgagatacgccaagttcggcggcgtgcacctggccctgctgccccccggcaactacagcgccagagtgagagccaccagcctggccggcaacggcagctggaccgacagcgtggccttctacatcctgggccccgaggaggaggacgccggcggcctgcacgtgctgctgaccgccacccccgtgggcctgaccctgctgatcgtgctggccgccctgggcttcttctacggcaagaagagaaacagaaccctgtacgccagcgtgaaccccgagtacttcagcgccagcgacatgtacgtgcccgacgagtgggaggtgcccagagagcagatcagcatcatcagagagctgggccagggcagcttcggcatggtgtacgagggcctggccagaggcctggaggccggcgaggagagcacccccgtggccctgaagaccgtgaacgagctggccagccccagagagtgcatcgagttcctgaaggaggccagcgtgatgaaggccttcaagtgccaccacgtggtgagactgctgggcgtggtgagccagggccagcccaccctggtgatcatggagctgatgaccagaggcgacctgaagagccacctgagaagcctgagacccgaggccgagaacaaccccggcctgccccagcccgccctgggcgagatgatccagatggccggcgagatcgccgacggcatggcctacctggccgccaacaagttcgtgcacagagacctggccgccagaaactgcatggtgagccaggacttcaccgtgaagatcggcgacttcggcatgaccagagacgtgtacgagaccgactactacagaaagggcggcaagggcctgctgcccgtgagatggatggcccccgagagcctgaaggacggcatcttcaccacccacagcgacgtgtggagcttcggcgtggtgctgtgggagatcgtgaccctggccgagcagccctaccagggcctgagcaacgagcaggtgctgaagttcgtgatggacggcggcgtgctggaggagctggagggctgccccctgcagctgcaggagctgatgagcagatgctggcagcccaaccccagactgagacccagcttcacccacatcctggacagcatccaggaggagctgagacccagcttcagactgctgagcttctactacagccccgagtgcagaggcgccagaggcagcctgcccaccaccgacgccgagcccgacagcagccccacccccagagactgcagcccccagaacggcggccccggccactag

SEQ ID NO: 85306 - DNA, 3060 bp, Artificial Sequence
  Description of Artificial Sequence: Synthetic coding sequence
atgagatacagactggcctggctgctgcaccccgccctgcccagcaccttcagaagcgtgctgggcgccagactgcccccccccgagagactgtgcggcttccagaagaagacctacagcaagatgaacaaccccgccatcaagagaatcggcaaccacatcaccaagagccccgaggacaagagagagtacagaggcctggagctggccaacggcatcaaggtgctgctgatcagcgaccccaccaccgacaagagcagcgccgccctggacgtgcacatcggcagcctgagcgacccccccaacatcgccggcctgagccacttctgcgagcacatgctgttcctgggcaccaagaagtaccccaaggagaacgagtacagccagttcctgagcgagcacgccggcagcagcaacgccttcaccagcggcgagcacaccaactactacttcgacgtgagccacgagcacctggagggcgccctggacagattcgcccagttcttcctgtgccccctgttcgacgagagctgcaaggacagagaggtgaacgccgtggacagcgagcacgagaagaacgtgatgaacgacgcctggagactgttccagctggagaaggccaccggcaaccccaagcaccccttcagcaagttcggcaccggcaacaagtacaccctggagaccagacccaaccaggagggcatcgacgtgagacaggagctgctgaagttccacagcgcctactacagcagcaacctgatggccgtgtgcgtgctgggcagagagagcctggacgacctgaccaacctggtggtgaagctgttcagcgaggtggagaacaagaacgtgcccctgcccgagttccccgagcaccccttccaggaggagcacctgaagcagctgtacaagatcgtgcccatcaaggacatcagaaacctgtacgtgaccttccccatccccgacctgcagaagtactacaagagcaaccccggccactacctgggccacctgatcggccacgagggccccggcagcctgctgagcgagctgaagagcaagggctgggtgaacaccctggtgggcggccagaaggagggcgccagaggcttcatgttcttcatcatcaacgtggacctgaccgaggagggcctgctgcacgtggaggacatcatcctgcacatgttccagtacatccagaagctgagagccgagggcccccaggagtgggtgttccaggagtgcaaggacctgaacgccgtggccttcagattcaaggacaaggagagacccagaggctacaccagcaagatcgccggcatcctgcactactaccccctggaggaggtgctgaccgccgagtacctgctggaggagttcagacccgacctgatcgagatggtgctggacaagctgagacccgagaacgtgagagtggccatcgtgagcaagagcttcgagggcaagaccgacagaaccgaggagtggtacggcacccagtacaagcaggaggccatccccgacgaggtgatcaagaagtggcagaacgccgacctgaacggcaagttcaagctgcccaccaagaacgagttcatccccaccaacttcgagatcctgcccctggagaaggaggccaccccctaccccgccctgatcaaggacaccgccatgagcaagctgtggttcaagcaggacgacaagttcttcctgcccaaggcctgcctgaacttcgagttcttcagccccttcgcctacgtggaccccctgcactgcaacatggcctacctgtacctggagctgctgaaggacagcctgaacgagtacgcctacgccgccgagctggccggcctgagctacgacctgcagaacaccatctacggcatgtacctgagcgtgaagggctacaacgacaagcagcccatcctgctgaagaagatcatcgagaagatggccaccttcgagatcgacgagaagagattcgagatcatcaaggaggcctacatgagaagcctgaacaacttcagagccgagcagccccaccagcacgccatgtactacctgagactgctgatgaccgaggtggcctggaccaaggacgagctgaaggaggccctggacgacgtgaccctgcccagactgaaggccttcatcccccagctgctgagcagactgcacatcgaggccctgctgcacggcaacatcaccaagcaggccgccctgggcatcatgcagatggtggaggacaccctgatcgagcacgcccacaccaagcccctgctgcccagccagctggtgagatacagagaggtgcagctgcccgacagaggctggttcgtgtaccagcagagaaacgaggtgcacaacaactgcggcatcgagatctactaccagaccgacatgcagagcaccagcgagaacatgttcctggagctgttctgccagatcatcagcgagccctgcttcaacaccctgagaaccaaggagcagctgggctacatcgtgttcagcggccccagaagagccaacggcatccagggcctgagattcatcatccagagcgagaagcccccccactacctggagagcagagtggaggccttcctgatcaccatggagaagagcatcgaggacatgaccgaggaggccttccagaagcacatccaggccctggccatcagaagactggacaagcccaagaagctgagcgccgagtgcgccaagtactggggcgagatcatcagccagcagtacaacttcgacagagacaacaccgaggtggcctacctgaagaccctgaccaaggaggacatcatcaagttctacaaggagatgctggccgtggacgcccccagaagacacaaggtgagcgtgcacgtgctggccagagagatggacagctgccccgtggtgggcgagttcccctgccagaacgacatcaacctgagccaggcccccgccctgccccagcccgaggtgatccagaacatgaccgagttcaagagaggcctgcccctgttccccctggtgaagccccacatcaacttcatggccgccaagctgtag

SEQ ID NO: 85307 - DNA, 1395 bp, Artificial Sequence
  Description of Artificial Sequence: Synthetic coding sequence
atgagcaagctgtggttcaagcaggacgacaagttcttcctgcccaaggcctgcctgaacttcgagttcttcagccccttcgcctacgtggaccccctgcactgcaacatggcctacctgtacctggagctgctgaaggacagcctgaacgagtacgcctacgccgccgagctggccggcctgagctacgacctgcagaacaccatctacggcatgtacctgagcgtgaagggctacaacgacaagcagcccatcctgctgaagaagatcatcgagaagatggccaccttcgagatcgacgagaagagattcgagatcatcaaggaggcctacatgagaagcctgaacaacttcagagccgagcagccccaccagcacgccatgtactacctgagactgctgatgaccgaggtggcctggaccaaggacgagctgaaggaggccctggacgacgtgaccctgcccagactgaaggccttcatcccccagctgctgagcagactgcacatcgaggccctgctgcacggcaacatcaccaagcaggccgccctgggcatcatgcagatggtggaggacaccctgatcgagcacgcccacaccaagcccctgctgcccagccagctggtgagatacagagaggtgcagctgcccgacagaggctggttcgtgtaccagcagagaaacgaggtgcacaacaactgcggcatcgagatctactaccagaccgacatgcagagcaccagcgagaacatgttcctggagctgttctgccagatcatcagcgagccctgcttcaacaccctgagaaccaaggagcagctgggctacatcgtgttcagcggccccagaagagccaacggcatccagggcctgagattcatcatccagagcgagaagcccccccactacctggagagcagagtggaggccttcctgatcaccatggagaagagcatcgaggacatgaccgaggaggccttccagaagcacatccaggccctggccatcagaagactggacaagcccaagaagctgagcgccgagtgcgccaagtactggggcgagatcatcagccagcagtacaacttcgacagagacaacaccgaggtggcctacctgaagaccctgaccaaggaggacatcatcaagttctacaaggagatgctggccgtggacgcccccagaagacacaaggtgagcgtgcacgtgctggccagagagatggacagctgccccgtggtgggcgagttcccctgccagaacgacatcaacctgagccaggcccccgccctgccccagcccgaggtgatccagaacatgaccgagttcaagagaggcctgcccctgttccccctggtgaagccccacatcaacttcatggccgccaagctgtag

SEQ ID NO: 85308 - DNA, 774 bp, Artificial Sequence
  Description of Artificial Sequence: Synthetic coding sequence
gagttcatcatcagaggcggcagagtgcccagccactgcctgcacttcagcagaagcttccagaagaagacctacagcaagatgaacaaccccgccatcaagagaatcggcaaccacatcaccaagagccccgaggacaagagagagtacagaggcctggagctggccaacggcatcaaggtgctgctgatcagcgaccccaccaccgacaagagcagcgccgccctggacgtgcacatcggcagcctgagcgacccccccaacatcgccggcctgagccacttctgcgagcacatgctgttcctgggcaccaagaagtaccccaaggagaacgagtacagccagttcctgagcgagcacgccggcagcagcaacgccttcaccagcggcgagcacaccaactactacttcgacgtgagccacgagcacctggagggcgccctggacagattcgcccagttcttcctgtgccccctgttcgacgagagctgcaaggacagagaggtgaacgccgtggacagcgagcacgagaagaacgtgatgaacgacgcctggagactgttccagctggagaaggccaccggcaaccccaagcaccccttcagcaagttcggcaccggcaacaagtacaccctggagaccagacccaaccaggagggcatcgacgtgagacaggagctgctgaagttccacagcgcctactacagcagcaacctgatggccgtgtgcgtgctgggcagagagagcctggacgacctgaccaacctggtgtag

SEQ ID NO: 85309 - DNA, 396 bp, Artificial Sequence
  Description of Artificial Sequence: Synthetic coding sequence
atggaccccagactgcccgcctgggccctggtgctgctgggccccgccctggtgttcgccctgggccccgcccccacccccgagatgagagagaagctgtgcggccaccacttcgtgagagccctggtgagagtgtgcggcggccccagatggagcaccgaggccagaagacccgccaccggcggcgacagagagctgctgcagtggctggagagaagacacctgctgcacggcctggtggccgacagcaacctgaccctgggccccggcctgcagcccctgccccagaccagccaccaccacagacaccacagagccgccgccaccaaccccgccagatactgctgcctgagcggctgcacccagcaggacctgctgaccctgtgcccctactag

SEQ ID NO: 85310 - DNA, 474 bp, Artificial Sequence
  Description of Artificial Sequence: Synthetic coding sequence
atggaccccagactgcccgcctgggccctggtgctgctgggccccgccctggtgttcgccctgggccccgcccccacccccgagatgagagagaagctgtgcggccaccacttcgtgagagccctggtgagagtgtgcggcggccccagatggagcaccgaggccagaagacccgccaccggcggcgaccagagagagagccacagcgtgagccaggccggcctgaagctgctgagcagcagcaacccccccaccctgaccttccagagcgtgggcatcagcgacgtgagctgctacagcggctggagagacgacatctgcagcatgggctggtggcccaccgtgatcagcagatgggacctggcctgcagcccctgccccagacccctgaccatcaccgccaccaccgtgcagctgccccccaccctgcacgccaccgccgccagcgtggccgtgcccaacaagacctgctag

SEQ ID NO: 85311 - DNA, 420 bp, Artificial Sequence
  Description of Artificial Sequence: Synthetic coding sequence
atggccagcctgttcagaagctacctgcccgccatctggctgctgctgagccagctgctgagagagagcctggccgccgagctgagaggctgcggccccagattcggcaagcacctgctgagctactgccccatgcccgagaagaccttcaccaccacccccggcggctggctgctggagagcggcagacccaaggagatggtgagcaccagcaacaacaaggacggccaggccctgggcaccaccagcgagttcatccccaacctgagccccgagctgaagaagcccctgagcgagggccagcccagcctgaagaagatcatcctgagcagaaagaagagaagcggcagacacagattcgaccccttctgctgcgaggtgatctgcgacgacggcaccagcgtgaagctgtgcacctag

SEQ ID NO: 85312 - DNA, 408 bp, Artificial Sequence
  Description of Artificial Sequence: Synthetic coding sequence
atgaagggcagcatcttcaccctgttcctgttcagcgtgctgttcgccatcagcgaggtgagaagcaaggagagcgtgagactgtgcggcctggagtacatcagaaccgtgatctacatctgcgccagcagcagatggagaagacaccaggagggcatcccccaggcccagcaggccgagaccggcaacagcttccagctgccccacaagagagagttcagcgaggagaaccccgcccagaacctgcccaaggtggacgccagcggcgaggacagactgtggggcggccagatgcccaccgaggagctgtggaagagcaagaagcacagcgtgatgagcagacaggacctgcagaccctgtgctgcaccgacggctgcagcatgaccgacctgagcgccctgtgctag

SEQ ID NO: 85313 - DNA, 642 bp, Artificial Sequence
  Description of Artificial Sequence: Synthetic coding sequence
atgcccagactgctgagactgagcctgctgtggctgggcctgctgctggtgagattcagcagagagctgagcgacatcagcagcgccagaaagctgtgcggcagatacctggtgaaggagatcgagaagctgtgcggccacgccaactggagccagttcagattcgaggaggagacccccttcagcagactgatcgcccaggccagcgagaaggtggaggcctacagcccctaccagttcgagagcccccagaccgccagccccgccagaggcagaggcaccaaccccgtgagcaccagctgggaggaggccgtgaacagctgggagatgcagagcctgcccgagtacaaggacaagaagggctacagccccctgggcaagaccagagagttcagcagcagccacaacatcaacgtgtacatccacgagaacgccaagttccagaagaagagaagaaacaagatcaagaccctgagcaacctgttctggggccaccacccccagagaaagagaagaggctacagcgagaagtgctgcctgaccggctgcaccaaggaggagctgagcatcgcctgcctgccctacatcgacttcaagagactgaaggagaagagaagcagcctggtgaccaagatctactag

SEQ ID NO: 85314 - DNA, 1734 bp, Artificial Sequence
  Description of Artificial Sequence: Synthetic coding sequence
atgaacaagctgtacatcggcaacctgaacgagagcgtgacccccgccgacctggagaaggtgttcgccgagcacaagatcagctacagcggccagttcctggtgaagagcggctacgccttcgtggactgccccgacgagcactgggccatgaaggccatcgagaccttcagcggcaaggtggagctgcagggcaagagactggagatcgagcacagcgtgcccaagaagcagagaagcagaaagatccagatcagaaacatccccccccagctgagatgggaggtgctggacagcctgctggcccagtacggcaccgtggagaactgcgagcaggtgaacaccgagagcgagaccgccgtggtgaacgtgacctacagcaacagagagcagaccagacaggccatcatgaagctgaacggccaccagctggagaaccacgccctgaaggtgagctacatccccgacgagcagatcgcccagggccccgagaacggcagaagaggcggcttcggcagcagaggccagcccagacagggcagccccgtggccgccggcgcccccgccaagcagcagcaggtggacatccccctgagactgctggtgcccacccagtacgtgggcgccatcatcggcaaggagggcgccaccatcagaaacatcaccaagcagacccagagcaagatcgacgtgcacagaaaggagaacgccggcgccgccgagaaggccatcagcgtgcacagcacccccgagggctgcagcagcgcctgcaagatgatcctggagatcatgcacaaggaggccaaggacaccaagaccgccgacgaggtgcccctgaagatcctggcccacaacaacttcgtgggcagactgatcggcaaggagggcagaaacctgaagaaggtggagcaggacaccgagaccaagatcaccatcagcagcctgcaggacctgaccctgtacaaccccgagagaaccatcaccgtgaagggcgccatcgagaactgctgcagagccgagcaggagatcatgaagaaggtgagagaggcctacgagaacgacgtggccgccatgagcctgcagagccacctgatccccggcctgaacctggccgccgtgggcctgttccccgccagcagcagcgccgtgccccccccccccagcagcgtgaccggcgccgccccctacagcagcttcatgcaggcccccgagcaggagatggtgcaggtgttcatccccgcccaggccgtgggcgccatcatcggcaagaagggccagcacatcaagcagctgagcagattcgccagcgccagcatcaagatcgccccccccgagacccccgacagcaaggtgagaatggtgatcatcaccggcccccccgaggcccagttcaaggcccagggcagaatctacggcaagctgaaggaggagaacttcttcggccccaaggaggaggtgaagctggagacccacatcagagtgcccgccagcgccgccggcagagtgatcggcaagggcggcaagaccgtgaacgagctgcagaacctgaccgccgccgaggtggtggtgcccagagaccagacccccgacgagaacgaccaggtgatcgtgaagatcatcggccacttctacgccagccagatggcccagagaaagatcagagacatcctggcccaggtgaagcagcagcaccagaagggccagagcaaccaggcccaggccagaagaaagtag

SEQ ID NO: 85315 - DNA, 1317 bp, Artificial Sequence
  Description of Artificial Sequence: Synthetic coding sequence
atgaacaagctgtacatcggcaacctgaacgagagcgtgacccccgccgacctggagaaggtgttcgccgagcacaagatcagctacagcggccagttcctggtgaagagcggctacgccttcgtggactgccccgacgagcactgggccatgaaggccatcgagaccttcagcggcaaggtggagctgcagggcaagagactggagatcgagcacagcgtgcccaagaagcagagaagcagaaagatccagatcagaaacatccccccccagctgagatgggaggtgctggacagcctgctggcccagtacggcaccgtggagaactgcgagcaggtgaacaccgagagcgagaccgccgtggtgaacgtgacctacagcaacagagagcagaccagacaggccgacgaggtgcccctgaagatcctggcccacaacaacttcgtgggcagactgatcggcaaggagggcagaaacctgaagaaggtggagcaggacaccgagaccaagatcaccatcagcagcctgcaggacctgaccctgtacaaccccgagagaaccatcaccgtgaagggcgccatcgagaactgctgcagagccgagcaggagatcatgaagaaggtgagagaggcctacgagaacgacgtggccgccatgagcctgcagagccacctgatccccggcctgaacctggccgccgtgggcctgttccccgccagcagcagcgccgtgccccccccccccagcagcgtgaccggcgccgccccctacagcagcttcatgcaggcccccgagcaggagatggtgcaggtgttcatccccgcccaggccgtgggcgccatcatcggcaagaagggccagcacatcaagcagctgagcagattcgccagcgccagcatcaagatcgccccccccgagacccccgacagcaaggtgagaatggtgatcatcaccggcccccccgaggcccagttcaaggcccagggcagaatctacggcaagctgaaggaggagaacttcttcggccccaaggaggaggtgaagctggagacccacatcagagtgcccgccagcgccgccggcagagtgatcggcaagggcggcaagaccgtgaacgagctgcagaacctgaccgccgccgaggtggtggtgcccagagaccagacccccgacgagaacgaccaggtgatcgtgaagatcatcggccacttctacgccagccagatggcccagagaaagatcagagacatcctggcccaggtgaagcagcagcaccagaagggccagagcaaccaggcccaggccagaagaaagtag

SEQ ID NO: 85316 - DNA, 1671 bp, Artificial Sequence
  Description of Artificial Sequence: Synthetic coding sequence
atgatgaacaagctgtacatcggcaacctgagccccgccgtgaccgccgacgacctgagacagctgttcggcgacagaaagctgcccctggccggccaggtgctgctgaagagcggctacgccttcgtggactaccccgaccagaactgggccatcagagccatcgagaccctgagcggcaaggtggagctgcacggcaagatcatggaggtggactacagcgtgagcaagaagctgagaagcagaaagatccagatcagaaacatccccccccacctgcagtgggaggtgctggacggcctgctggcccagtacggcaccgtggagaacgtggagcaggtgaacaccgacaccgagaccgccgtggtgaacgtgacctacgccaccagagaggaggccaagatcgccatggagaagctgagcggccaccagttcgagaactacagcttcaagatcagctacatccccgacgaggaggtgagcagccccagccccccccagagagcccagagaggcgaccacagcagcagagagcagggccacgcccccggcggcaccagccaggccagacagatcgacttccccctgagaatcctggtgcccacccagttcgtgggcgccatcatcggcaaggagggcctgaccatcaagaacatcaccaagcagacccagagcagagtggacatccacagaaaggagaacagcggcgccgccgagaagcccgtgaccatccacgccacccccgagggcaccagcgaggcctgcagaatgatcctggagatcatgcagaaggaggccgacgagaccaagctggccgaggagatccccctgaagatcctggcccacaacggcctggtgggcagactgatcggcaaggagggcagaaacctgaagaagatcgagcacgagaccggcaccaagatcaccatcagcagcctgcaggacctgagcatctacaaccccgagagaaccatcaccgtgaagggcaccgtggaggcctgcgccagcgccgagatcgagatcatgaagaagctgagagaggccttcgagaacgacatgctggccgtgaacacccacagcggctacttcagcagcctgtacccccaccaccagttcggccccttcccccaccaccacagctaccccgagcaggagatcgtgaacctgttcatccccacccaggccgtgggcgccatcatcggcaagaagggcgcccacatcaagcagctggccagattcgccggcgccagcatcaagatcgcccccgccgagggccccgacgtgagcgagagaatggtgatcatcaccggcccccccgaggcccagttcaaggcccagggcagaatcttcggcaagctgaaggaggagaacttcttcaaccccaaggaggaggtgaagctggaggcccacatcagagtgcccagcagcaccgccggcagagtgatcggcaagggcggcaagaccgtgaacgagctgcagaacctgaccagcgccgaggtgatcgtgcccagagaccagacccccgacgagaacgaggaggtgatcgtgagaatcatcggccacttcttcgccagccagaccgcccagagaaagatcagagagatcgtgcagcaggtgaagcagcaggagcagaagtacccccagggcgtggccagccagagaagcaagtag

SEQ ID NO: 85317 - DNA, 1800 bp, Artificial Sequence
  Description of Artificial Sequence: Synthetic coding sequence
atgatgaacaagctgtacatcggcaacctgagccccgccgtgaccgccgacgacctgagacagctgttcggcgacagaaagctgcccctggccggccaggtgctgctgaagagcggctacgccttcgtggactaccccgaccagaactgggccatcagagccatcgagaccctgagcggcaaggtggagctgcacggcaagatcatggaggtggactacagcgtgagcaagaagctgagaagcagaaagatccagatcagaaacatccccccccacctgcagtgggaggtgctggacggcctgctggcccagtacggcaccgtggagaacgtggagcaggtgaacaccgacaccgagaccgccgtggtgaacgtgacctacgccaccagagaggaggccaagatcgccatggagaagctgagcggccaccagttcgagaactacagcttcaagatcagctacatccccgacgaggaggtgagcagccccagccccccccagagagcccagagaggcgaccacagcagcagagagcagggccacgcccccggcggcaccagccaggccagacagatcgacttccccctgagaatcctggtgcccacccagttcgtgggcgccatcatcggcaaggagggcctgaccatcaagaacatcaccaagcagacccagagcagagtggacatccacagaaaggagaacagcggcgccgccgagaagcccgtgaccatccacgccacccccgagggcaccagcgaggcctgcagaatgatcctggagatcatgcagaaggaggccgacgagaccaagctggccgaggagatccccctgaagatcctggcccacaacggcctggtgggcagactgatcggcaaggagggcagaaacctgaagaagatcgagcacgagaccggcaccaagatcaccatcagcagcctgcaggacctgagcatctacaaccccgagagaaccatcaccgtgaagggcaccgtggaggcctgcgccagcgccgagatcgagatcatgaagaagctgagagaggccttcgagaacgacatgctggccgtgaaccagcaggccaacctgatccccggcctgaacctgagcgccctgggcatcttcagcaccggcctgagcgtgctgagcccccccgccggccccagaggcgccccccccgccgccccctaccaccccttcaccacccacagcggctacttcagcagcctgtacccccaccaccagttcggccccttcccccaccaccacagctaccccgagcaggagatcgtgaacctgttcatccccacccaggccgtgggcgccatcatcggcaagaagggcgcccacatcaagcagctggccagattcgccggcgccagcatcaagatcgcccccgccgagggccccgacgtgagcgagagaatggtgatcatcaccggcccccccgaggcccagttcaaggcccagggcagaatcttcggcaagctgaaggaggagaacttcttcaaccccaaggaggaggtgaagctggaggcccacatcagagtgcccagcagcaccgccggcagagtgatcggcaagggcggcaagaccgtgaacgagctgcagaacctgaccagcgccgaggtgatcgtgcccagagaccagacccccgacgagaacgaggaggtgatcgtgagaatcatcggccacttcttcgccagccagaccgcccagagaaagatcagagagatcgtgcagcaggtgaagcagcaggagcagaagtacccccagggcgtggccagccagagaagcaagtag

SEQ ID NO: 85318 - DNA, 1629 bp, Artificial Sequence
  Description of Artificial Sequence: Synthetic coding sequence
atgttcagctgccccggccactaccacgtggacggcttcctgaaccccggcagcagaaagatccagatcagaaacatccccccccacctgcagtgggaggtgctggacggcctgctggcccagtacggcaccgtggagaacgtggagcaggtgttcgccttcagcctggtgaacaccgacaccgagaccgccgtggtgaacgtgacctacgccaccagagaggaggccaagatcgccatggagaagctgagcggccaccagttcgagaactacagcttcaagatcagctacatccccgacgaggaggtgagcagccccagccccccccagagagcccagagaggcgaccacagcagcagagagcagggccacgcccccggcggcaccagccaggccagacagatcgacttccccctgagaatcctggtgcccacccagttcgtgggcgccatcatcggcaaggagggcctgaccatcaagaacatcaccaagcagacccagagcagagtggacatccacagaaaggagaacagcggcgccgccgagaagcccgtgaccatccacgccacccccgagggcaccagcgaggcctgcagaatgatcctggagatcatgcagaaggaggccgacgagaccaagctggccgaggagatccccctgaagatcctggcccacaacggcctggtgggcagactgatcggcaaggagggcagaaacctgaagaagatcgagcacgagaccggcaccaagatcaccatcagcagcctgcaggacctgagcatctacaaccccgagagaaccatcaccgtgaagggcaccgtggaggcctgcgccagcgccgagatcgagatcatgaagaagctgagagaggccttcgagaacgacatgctggccgtgaaccagcaggccaacctgatccccggcctgaacctgagcgccctgggcatcttcagcaccggcctgagcgtgctgagcccccccgccggccccagaggcgccccccccgccgccccctaccaccccttcaccacccacagcggctacttcagcagcctgtacccccaccaccagttcggccccttcccccaccaccacagctaccccgagcaggagatcgtgaacctgttcatccccacccaggccgtgggcgccatcatcggcaagaagggcgcccacatcaagcagctggccagattcgccggcgccagcatcaagatcgcccccgccgagggccccgacgtgagcgagagaatggtgatcatcaccggcccccccgaggcccagttcaaggcccagggcagaatcttcggcaagctgaaggaggagaacttcttcaaccccaaggaggaggtgaagctggaggcccacatcagagtgcccagcagcaccgccggcagagtgatcggcaagggcggcaagaccgtgaacgagctgcagaacctgaccagcgccgaggtgatcgtgcccagagaccagacccccgacgagaacgaggaggtgatcgtgagaatcatcggccacttcttcgccagccagaccgcccagagaaagatcagagagatcgtgcagcaggtgaagcagcaggagcagaagtacccccagggcgtggccagccagagaagcaagtag

SEQ ID NO: 85319 - DNA, 1740 bp, Artificial Sequence
  Description of Artificial Sequence: Synthetic coding sequence
atgaacaagctgtacatcggcaacctgagcgagaacgccgcccccagcgacctggagagcatcttcaaggacgccaagatccccgtgagcggccccttcctggtgaagaccggctacgccttcgtggactgccccgacgagagctgggccctgaaggccatcgaggccctgagcggcaagatcgagctgcacggcaagcccatcgaggtggagcacagcgtgcccaagagacagagaatcagaaagctgcagatcagaaacatccccccccacctgcagtgggaggtgctggacagcctgctggtgcagtacggcgtggtggagagctgcgagcaggtgaacaccgacagcgagaccgccgtggtgaacgtgacctacagcagcaaggaccaggccagacaggccctggacaagctgaacggcttccagctggagaacttcaccctgaaggtggcctacatccccgacgagatggccgcccagcagaaccccctgcagcagcccagaggcagaagaggcctgggccagagaggcagcagcagacagggcagccccggcagcgtgagcaagcagaagccctgcgacctgcccctgagactgctggtgcccacccagttcgtgggcgccatcatcggcaaggagggcgccaccatcagaaacatcaccaagcagacccagagcaagatcgacgtgcacagaaaggagaacgccggcgccgccgagaagagcatcaccatcctgagcacccccgagggcaccagcgccgcctgcaagagcatcctggagatcatgcacaaggaggcccaggacatcaagttcaccgaggagatccccctgaagatcctggcccacaacaacttcgtgggcagactgatcggcaaggagggcagaaacctgaagaagatcgagcaggacaccgacaccaagatcaccatcagccccctgcaggagctgaccctgtacaaccccgagagaaccatcaccgtgaagggcaacgtggagacctgcgccaaggccgaggaggagatcatgaagaagatcagagagagctacgagaacgacatcgccagcatgaacctgcaggcccacctgatccccggcctgaacctgaacgccctgggcctgttcccccccaccagcggcatgcccccccccaccagcggcccccccagcgccatgacccccccctacccccagttcgagcagagcgagaccgagaccgtgcacctgttcatccccgccctgagcgtgggcgccatcatcggcaagcagggccagcacatcaagcagctgagcagattcgccggcgccagcatcaagatcgcccccgccgaggcccccgacgccaaggtgagaatggtgatcatcaccggcccccccgaggcccagttcaaggcccagggcagaatctacggcaagatcaaggaggagaacttcgtgagccccaaggaggaggtgaagctggaggcccacatcagagtgcccagcttcgccgccggcagagtgatcggcaagggcggcaagaccgtgaacgagctgcagaacctgagcagcgccgaggtggtggtgcccagagaccagacccccgacgagaacgaccaggtggtggtgaagatcaccggccacttctacgcctgccaggtggcccagagaaagatccaggagatcctgacccaggtgaagcagcaccagcagcagaaggccctgcagagcggccccccccagagcagaagaaagtag

SEQ ID NO: 85320 - DNA, 7476 bp, Artificial Sequence
  Description of Artificial Sequence: Synthetic coding sequence
atgggcgccgccgccggcagaagcccccacctgggccccgcccccgccagaagaccccagagaagcctgctgctgctgcagctgctgctgctggtggccgcccccggcagcacccaggcccaggccgcccccttccccgagctgtgcagctacacctgggaggccgtggacaccaagaacaacgtgctgtacaagatcaacatctgcggcagcgtggacatcgtgcagtgcggccccagcagcgccgtgtgcatgcacgacctgaagaccagaacctaccacagcgtgggcgacagcgtgctgagaagcgccaccagaagcctgctggagttcaacaccaccgtgagctgcgaccagcagggcaccaaccacagagtgcagagcagcatcgccttcctgtgcggcaagaccctgggcacccccgagttcgtgaccgccaccgagtgcgtgcactacttcgagtggagaaccaccgccgcctgcaagaaggacatcttcaaggccaacaaggaggtgccctgctacgtgttcgacgaggagctgagaaagcacgacctgaaccccctgatcaagctgagcggcgcctacctggtggacgacagcgaccccgacaccagcctgttcatcaacgtgtgcagagacatcgacaccctgagagaccccggcagccagctgagagcctgcccccccggcaccgccgcctgcctggtgagaggccaccaggccttcgacgtgggccagcccagagacggcctgaagctggtgagaaaggacagactggtgctgagctacgtgagagaggaggccggcaagctggacttctgcgacggccacagccccgccgtgaccatcaccttcgtgtgccccagcgagagaagagagggcaccatccccaagctgaccgccaagagcaactgcagatacgagatcgagtggatcaccgagtacgcctgccacagagactacctggagagcaagacctgcagcctgagcggcgagcagcaggacgtgagcatcgacctgacccccctggcccagagcggcggcagcagctacatcagcgacggcaaggagtacctgttctacctgaacgtgtgcggcgagaccgagatccagttctgcaacaagaagcaggccgccgtgtgccaggtgaagaagagcgacaccagccaggtgaaggccgccggcagataccacaaccagaccctgagatacagcgacggcgacctgaccctgatctacttcggcggcgacgagtgcagcagcggcttccagagaatgagcgtgatcaacttcgagtgcaacaagaccgccggcaacgacggcaagggcacccccgtgttcaccggcgaggtggactgcacctacttcttcacctgggacaccgagtacgcctgcgtgaaggagaaggaggacctgctgtgcggcgccaccgacggcaagaagagatacgacctgagcgccctggtgagacacgccgagcccgagcagaactgggaggccgtggacggcagccagaccgagaccgagaagaagcacttcttcatcaacatctgccacagagtgctgcaggagggcaaggccagaggctgccccgaggacgccgccgtgtgcgccgtggacaagaacggcagcaagaacctgggcaagttcatcagcagccccatgaaggagaagggcaacatccagctgagctacagcgacggcgacgactgcggccacggcaagaagatcaagaccaacatcaccctggtgtgcaagcccggcgacctggagagcgcccccgtgctgagaaccagcggcgagggcggctgcttctacgagttcgagtggcacaccgccgccgcctgcgtgctgagcaagaccgagggcgagaactgcaccgtgttcgacagccaggccggcttcagcttcgacctgagccccctgaccaagaagaacggcgcctacaaggtggagaccaagaagtacgacttctacatcaacgtgtgcggccccgtgagcgtgagcccctgccagcccgacagcggcgcctgccaggtggccaagagcgacgagaagacctggaacctgggcctgagcaacgccaagctgagctactacgacggcatgatccagctgaactacagaggcggcaccccctacaacaacgagagacacacccccagagccaccctgatcaccttcctgtgcgacagagacgccggcgtgggcttccccgagtaccaggaggaggacaacagcacctacaacttcagatggtacaccagctacgcctgccccgaggagcccctggagtgcgtggtgaccgaccccagcaccctggagcagtacgacctgagcagcctggccaagagcgagggcggcctgggcggcaactggtacgccatggacaacagcggcgagcacgtgacctggagaaagtactacatcaacgtgtgcagacccctgaaccccgtgcccggctgcaacagatacgccagcgcctgccagatgaagtacgagaaggaccagggcagcttcaccgaggtggtgagcatcagcaacctgggcatggccaagaccggccccgtggtggaggacagcggcagcctgctgctggagtacgtgaacggcagcgcctgcaccaccagcgacggcagacagaccacctacaccaccagaatccacctggtgtgcagcagaggcagactgaacagccaccccatcttcagcctgaactgggagtgcgtggtgagcttcctgtggaacaccgaggccgcctgccccatccagaccaccaccgacaccgaccaggcctgcagcatcagagaccccaacagcggcttcgtgttcaacctgaaccccctgaacagcagccagggctacaacgtgagcggcatcggcaagatcttcatgttcaacgtgtgcggcaccatgcccgtgtgcggcaccatcctgggcaagcccgccagcggctgcgaggccgagacccagaccgaggagctgaagaactggaagcccgccagacccgtgggcatcgagaagagcctgcagctgagcaccgagggcttcatcaccctgacctacaagggccccctgagcgccaagggcaccgccgacgccttcatcgtgagattcgtgtgcaacgacgacgtgtacagcggccccctgaagttcctgcaccaggacatcgacagcggccagggcatcagaaacacctacttcgagttcgagaccgccctggcctgcgtgcccagccccgtggactgccaggtgaccgacctggccggcaacgagtacgacctgaccggcctgagcaccgtgagaaagccctggaccgccgtggacaccagcgtggacggcagaaagagaaccttctacctgagcgtgtgcaaccccctgccctacatccccggctgccagggcagcgccgtgggcagctgcctggtgagcgagggcaacagctggaacctgggcgtggtgcagatgagcccccaggccgccgccaacggcagcctgagcatcatgtacgtgaacggcgacaagtgcggcaaccagagattcagcaccagaatcaccttcgagtgcgcccagatcagcggcagccccgccttccagctgcaggacggctgcgagtacgtgttcatctggagaaccgtggaggcctgccccgtggtgagagtggagggcgacaactgcgaggtgaaggaccccagacacggcaacctgtacgacctgaagcccctgggcctgaacgacaccatcgtgagcgccggcgagtacacctactacttcagagtgtgcggcaagctgagcagcgacgtgtgccccaccagcgacaagagcaaggtggtgagcagctgccaggagaagagagagccccagggcttccacaaggtggccggcctgctgacccagaagctgacctacgagaacggcctgctgaagatgaacttcaccggcggcgacacctgccacaaggtgtaccagagaagcaccgccatcttcttctactgcgacagaggcacccagagacccgtgttcctgaaggagaccagcgactgcagctacctgttcgagtggagaacccagtacgcctgcccccccttcgacctgaccgagtgcagcttcaaggacggcgccggcaacagcttcgacctgagcagcctgagcagatacagcgacaactgggaggccatcaccggcaccggcgaccccgagcactacctgatcaacgtgtgcaagagcctggccccccaggccggcaccgagccctgcccccccgaggccgccgcctgcctgctgggcggcagcaagcccgtgaacctgggcagagtgagagacggcccccagtggagagacggcatcatcgtgctgaagtacgtggacggcgacctgtgccccgacggcatcagaaagaagagcaccaccatcagattcacctgcagcgagagccaggtgaacagcagacccatgttcatcagcgccgtggaggactgcgagtacaccttcgcctggcccaccgccaccgcctgccccatgaagagcaacgagcacgacgactgccaggtgaccaaccccagcaccggccacctgttcgacctgagcagcctgagcggcagagccggcttcaccgccgcctacagcgagaagggcctggtgtacatgagcatctgcggcgagaacgagaactgcccccccggcgtgggcgcctgcttcggccagaccagaatcagcgtgggcaaggccaacaagagactgagatacgtggaccaggtgctgcagctggtgtacaaggacggcagcccctgccccagcaagagcggcctgagctacaagagcgtgatcagcttcgtgtgcagacccgaggccagacccaccaacagacccatgctgatcagcctggacaagcagacctgcaccctgttcttcagctggcacacccccctggcctgcgagcaggccaccgagtgcagcgtgagaaacggcagcagcatcgtggacctgagccccctgatccacagaaccggcggctacgaggcctacgacgagagcgaggacgacgccagcgacaccaaccccgacttctacatcaacatctgccagcccctgaaccccatgcacggcgtgccctgccccgccggcgccgccgtgtgcaaggtgcccatcgacggcccccccatcgacatcggcagagtggccggcccccccatcctgaaccccatcgccaacgagatctacctgaacttcgagagcagcaccccctgcctggccgacaagcacttcaactacaccagcctgatcgccttccactgcaagagaggcgtgagcatgggcacccccaagctgctgagaaccagcgagtgcgacttcgtgttcgagtgggagacccccgtggtgtgccccgacgaggtgagaatggacggctgcaccctgaccgacgagcagctgctgtacagcttcaacctgagcagcctgagcaccagcaccttcaaggtgaccagagacagcagaacctacagcgtgggcgtgtgcaccttcgccgtgggccccgagcagggcggctgcaaggacggcggcgtgtgcctgctgagcggcaccaagggcgccagcttcggcagactgcagagcatgaagctggactacagacaccaggacgaggccgtggtgctgagctacgtgaacggcgacagatgcccccccgagaccgacgacggcgtgccctgcgtgttccccttcatcttcaacggcaagagctacgaggagtgcatcatcgagagcagagccaagctgtggtgcagcaccaccgccgactacgacagagaccacgagtggggcttctgcagacacagcaacagctacagaaccagcagcatcatcttcaagtgcgacgaggacgaggacatcggcagaccccaggtgttcagcgaggtgagaggctgcgacgtgaccttcgagtggaagaccaaggtggtgtgcccccccaagaagctggagtgcaagttcgtgcagaagcacaagacctacgacctgagactgctgagcagcctgaccggcagctggagcctggtgcacaacggcgtgagctactacatcaacctgtgccagaagatctacaagggccccctgggctgcagcgagagagccagcatctgcagaagaaccaccaccggcgacgtgcaggtgctgggcctggtgcacacccagaagctgggcgtgatcggcgacaaggtggtggtgacctacagcaagggctacccctgcggcggcaacaagaccgccagcagcgtgatcgagctgacctgcaccaagaccgtgggcagacccgccttcaagagattcgacatcgacagctgcacctactacttcagctgggacagcagagccgcctgcgccgtgaagccccaggaggtgcagatggtgaacggcaccatcaccaaccccatcaacggcaagagcttcagcctgggcgacatctacttcaagctgttcagagccagcggcgacatgagaaccaacggcgacaactacctgtacgagatccagctgagcagcatcaccagcagcagaaaccccgcctgcagcggcgccaacatctgccaggtgaagcccaacgaccagcacttcagcagaaaggtgggcaccagcgacaagaccaagtactacctgcaggacggcgacctggacgtggtgttcgccagcagcagcaagtgcggcaaggacaagaccaagagcgtgagcagcaccatcttcttccactgcgaccccctggtggaggacggcatccccgagttcagccacgagaccgccgactgccagtacctgttcagctggtacaccagcgccgtgtgccccctgggcgtgggcttcgacagcgagaaccccggcgacgacggccagatgcacaagggcctgagcgagagaagccaggccgtgggcgccgtgctgagcctgctgctggtggccctgacctgctgcctgctggccctgctgctgtacaagaaggagagaagagagaccgtgatcagcaagctgaccacctgctgcagaagaagcagcaacgtgagctacaagtacagcaaggtgaacaaggaggaggagaccgacgagaacgagaccgagtggctgatggaggagatccagctgcccccccccagacagggcaaggagggccaggagaacggccacatcaccaccaagagcgtgaaggccctgagcagcctgcacggcgacgaccaggacagcgaggacgaggtgctgaccatccccgaggtgaaggtgcacagcggcagaggcgccggcgccgagagcagccaccccgtgagaaacgcccagagcaacgccctgcaggagagagaggacgacagagtgggcctggtgagaggcgagaaggccagaaagggcaagagcagcagcgcccagcagaagaccgtgagcagcaccaagctggtgagcttccacgacgacagcgacgaggacctgctgcacatctag

SEQ ID NO: 85321 - DNA, 780 bp, Artificial Sequence
  Description of Artificial Sequence: Synthetic coding sequence
atgagcgaggtgcccgtggccagagtgtggctggtgctgctgctgctgaccgtgcaggtgggcgtgaccgccggcgccccctggcagtgcgccccctgcagcgccgagaagctggccctgtgcccccccgtgagcgccagctgcagcgaggtgaccagaagcgccggctgcggctgctgccccatgtgcgccctgcccctgggcgccgcctgcggcgtggccaccgccagatgcgccagaggcctgagctgcagagccctgcccggcgagcagcagcccctgcacgccctgaccagaggccagggcgcctgcgtgcaggagagcgacgccagcgccccccacgccgccgaggccggcagccccgagagccccgagagcaccgagatcaccgaggaggagctgctggacaacttccacctgatggcccccagcgaggaggaccacagcatcctgtgggacgccatcagcacctacgacggcagcaaggccctgcacgtgaccaacatcaagaagtggaaggagccctgcagaatcgagctgtacagagtggtggagagcctggccaaggcccaggagaccagcggcgaggagatcagcaagttctacctgcccaactgcaacaagaacggcttctaccacagcagacagtgcgagaccagcatggacggcgaggccggcctgtgctggtgcgtgtacccctggaacggcaagagaatccccggcagccccgagatcagaggcgaccccaactgccagatctacttcaacgtgcagaactag

SEQ ID NO: 85322 - DNA, 777 bp, Artificial Sequence
  Description of Artificial Sequence: Synthetic coding sequence
atgctgcccctgtgcctggtggccgccctgctgctggccgccggccccggccccagcctgggcgacgaggccatccactgccccccctgcagcgaggagaagctggccagatgcagaccccccgtgggctgcgaggagctggtgagagagcccggctgcggctgctgcgccacctgcgccctgggcctgggcatgccctgcggcgtgtacacccccagatgcggcagcggcctgagatgctacccccccagaggcgtggagaagcccctgcacaccctgatgcacggccagggcgtgtgcatggagctggccgagatcgaggccatccaggagagcctgcagcccagcgacaaggacgagggcgaccaccccaacaacagcttcagcccctgcagcgcccacgacagaagatgcctgcagaagcacttcgccaagatcagagacagaagcaccagcggcggcaagatgaaggtgaacggcgcccccagagaggacgccagacccgtgccccagggcagctgccagagcgagctgcacagagccctggagagactggccgccagccagagcagaacccacgaggacctgtacatcatccccatccccaactgcgacagaaacggcaacttccaccccaagcagtgccaccccgccctggacggccagagaggcaagtgctggtgcgtggacagaaagaccggcgtgaagctgcccggcggcctggagcccaagggcgagctggactgccaccagctggccgacagcttcagagagtag

SEQ ID NO: 85323 - DNA, 477 bp, Artificial Sequence
  Description of Artificial Sequence: Synthetic coding sequence
atggagctggccgagatcgaggccatccaggagagcctgcagcccagcgacaaggacgagggcgaccaccccaacaacagcttcagcccctgcagcgcccacgacagaagatgcctgcagaagcacttcgccaagatcagagacagaagcaccagcggcggcaagatgaaggtgaacggcgcccccagagaggacgccagacccgtgccccagggcagctgccagagcgagctgcacagagccctggagagactggccgccagccagagcagaacccacgaggacctgtacatcatccccatccccaactgcgacagaaacggcaacttccaccccaagcagtgccaccccgccctggacggccagagaggcaagtgctggtgcgtggacagaaagaccggcgtgaagctgcccggcggcctggagcccaagggcgagctggactgccaccagctggccgacagcttcagagagtag

SEQ ID NO: 85324 - DNA, 849 bp, Artificial Sequence
  Description of Artificial Sequence: Synthetic coding sequence
atggagagacccagcctgagagccctgctgctgggcgccgccggcctgctgctgctgctgctgcccctgagcagcagcagcagcagcgacacctgcggcccctgcgagcccgccagctgcccccccctgccccccctgggctgcctgctgggcgagaccagagacgcctgcggctgctgccccatgtgcgccagaggcgagggcgagccctgcggcggcggcggcgccggcagaggctactgcgcccccggcatggagtgcgtgaagagcagaaagagaagaaagggcaaggccggcgccgccgccggcggccccggcgtgagcggcgtgtgcgtgtgcaagagcagataccccgtgtgcggcagcgacggcaccacctaccccagcggctgccagctgagagccgccagccagagagccgagagcagaggcgagaaggccatcacccaggtgagcaagggcacctgcgagcagggccccagcatcgtgaccccccccaaggacatctggaacgtgaccggcgcccaggtgtacctgagctgcgaggtgatcggcatccccacccccgtgctgatctggaacaaggtgaagagaggccactacggcgtgcagagaaccgagctgctgcccggcgacagagacaacctggccatccagaccagaggcggccccgagaagcacgaggtgaccggctgggtgctggtgagccccctgagcaaggaggacgccggcgagtacgagtgccacgccagcaacagccagggccaggccagcgccagcgccaagatcaccgtggtggacgccctgcacgagatccccgtgaagaagggcgagggcgccgagctgtag

SEQ ID NO: 85325 - DNA, 840 bp, Artificial Sequence
  Description of Artificial Sequence: Synthetic coding sequence
atggagagacccagcctgagagccctgctgctgggcgccgccggcctgctgctgctgctgctgcccctgagcagcagcagcagcagcgacacctgcggcccctgcgagcccgccagctgcccccccctgccccccctgggctgcctgctgggcgagaccagagacgcctgcggctgctgccccatgtgcgccagaggcgagggcgagccctgcggcggcggcggcgccggcagaggctactgcgcccccggcatggagtgcgtgaagagcagaaagagaagaaagggcaaggccggcgccgccgccggcggccccggcgtgagcggcgtgtgcgtgtgcaagagcagataccccgtgtgcggcagcgacggcaccacctaccccagcggctgccagctgagagccgccagccagagagccgagagcagaggcgagaaggccatcacccaggtgagcaagggcacctgcgagcagggccccagcatcgtgaccccccccaaggacatctggaacgtgaccggcgcccaggtgtacctgagctgcgaggtgatcggcatccccacccccgtgctgatctggaacaaggtgaagagaggccactacggcgtgcagagaaccgagctgctgcccggcgacagagacaacctggccatccagaccagaggcggccccgagaagcacgaggtgaccggctgggtgctggtgagccccctgagcaaggaggacgccggcgagtacgagtgccacgccagcaacagccagggccaggccagcgccagcgccaagatcaccgtggtggacgccctgcacgagatccccgtgaagaagggcacccagtag

SEQ ID NO: 85326 - DNA, 393 bp, Artificial Sequence
  Description of Artificial Sequence: Synthetic coding sequence
atggagaccctgggcgccctgctggtgctggagttcctgctgctgagccccgtggaggcccagcaggccaccgagcacagactgaagccctggctggtgggcctggccgccgtggtgggcttcctgttcatcgtgtacctggtgctgctggccaacagactgtggtgcagcaaggccagagccgaggacgaggaggagaccaccttcagaatggagagcaacctgtaccaggaccagagcgaggacaagagagagaagaaggaggccaaggagaaggaggagaagagaaagaaggagaagaagaccgccaaggagggcgagagcaacctgggcctggacctggaggagaaggagcccggcgaccacgagagagccaagagcaccgtgatgtag

SEQ ID NO: 85327 - DNA, 1932 bp, Artificial Sequence
  Description of Artificial Sequence: Synthetic coding sequence
atggccctgagaaaggccggcgacctggagccccagttcacccccgagagaagattcagactgtgctggtaccaggcccacagcggcagagccctgctgggcccccccccccaggccagcccccccgccggcggcctggccctggccctgctgctgctgagctgggtggccctgggccccagaagcctggagggcgccgaccccggcacccccggcgaggccgagggccccgcctgccccgccgcctgcgtgtgcagctacgacgacgacgccgacgagctgagcgtgttctgcagcagcagaaacctgaccagactgcccgacggcgtgcccggcggcacccaggccctgtggctggacggcaacaacctgagcagcgtgccccccgccgccttccagaacctgagcagcctgggcttcctgaacctgcagggcggccagctgggcagcctggagccccaggccctgctgggcctggagaacctgtgccacctgcacctggagagaaaccagctgagaagcctggccctgggcaccttcgcccacacccccgccctggccagcctgggcctgagcaacaacagactgagcagactggaggacggcctgttcgagggcctgggcagcctgtgggacctgaacctgggctggaacagcctggccgtgctgcccgacgccgccttcagaggcctgggcagcctgagagagctggtgctggccggcaacagactggcctacctgcagcccgccctgttcagcggcctggccgagctgagagagctggacctgagcagaaacgccctgagagccatcaaggccaacgtgttcgtgcagctgcccagactgcagaagctgtacctggacagaaacctgatcgccgccgtggcccccggcgccttcctgggcctgaaggccctgagatggctggacctgagccacaacagagtggccggcctgctggaggacaccttccccggcctgctgggcctgagagtgctgagactgagccacaacgccatcgccagcctgagacccagaaccttcaaggacctgcacttcctggaggagctgcagctgggccacaacagaatcagacagctggccgagagaagcttcgagggcctgggccagctggaggtgctgaccctggaccacaaccagctgcaggaggtgaaggccggcgccttcctgggcctgaccaacgtggccgtgatgaacctgagcggcaactgcctgagaaacctgcccgagcaggtgttcagaggcctgggcaagctgcacagcctgcacctggagggcagctgcctgggcagaatcagaccccacaccttcaccggcctgagcggcctgagaagactgttcctgaaggacaacggcctggtgggcatcgaggagcagagcctgtggggcctggccgagctgctggagctggacctgaccagcaaccagctgacccacctgccccacagactgttccagggcctgggcaagctggagtacctgctgctgagcagaaacagactggccgagctgcccgccgacgccctgggccccctgcagagagccttctggctggacgtgagccacaacagactggaggccctgcccaacagcctgctggcccccctgggcagactgagatacctgagcctgagaaacaacagcctgagaaccttcaccccccagccccccggcctggagagactgtggctggagggcaacccctgggactgcggctgccccctgaaggccctgagagacttcgccctgcagaaccccagcgccgtgcccagattcgtgcaggccatctgcgagggcgacgactgccagccccccgcctacacctacaacaacatcacctgcgccagcccccccgaggtggtgggcctggacctgagagacctgagcgaggcccacttcgccccctgctag

SEQ ID NO: 85328 - DNA, 1533 bp, Artificial Sequence
  Description of Artificial Sequence: Synthetic coding sequence
atgcccagaggcttcctggtgaagagaagcaagaagagcacccccgtgagctacagagtgagaggcggcgaggacggcgacagagccctgctgctgagccccagctgcggcggcgccagagccgagccccccgcccccagccccgtgcccggccccctgcccccccccccccccgccgagagagcccacgccgccctggccgccgccctggcctgcgcccccggcccccagccccccccccagggccccagagccgcccacttcggcaaccccgaggccgcccaccccgcccccctgtacagccccaccagacccgtgagcagagagcacgagaagcacaagtacttcgagagaagcttcaacctgggcagccccgtgagcgccgagagcttccccacccccgccgccctgctgggcggcggcggcggcggcggcgccagcggcgccggcggcggcggcacctgcggcggcgaccccctgctgttcgcccccgccgagctgaagatgggcaccgccttcagcgccggcgccgaggccgccagaggccccggccccggcccccccctgccccccgccgccgccctgagaccccccggcaagagaccccccccccccaccgccgccgagccccccgccaaggccgtgaaggcccccggcgccaagaagcccaaggccatcagaaagctgcacttcgaggacgaggtgaccaccagccccgtgctgggcctgaagatcaaggagggccccgtggaggcccccagaggcagagccggcggcgccgccagacccctgggcgagttcatctgccagctgtgcaaggaggagtacgccgaccccttcgccctggcccagcacaagtgcagcagaatcgtgagagtggagtacagatgccccgagtgcgccaaggtgttcagctgccccgccaacctggccagccacagaagatggcacaagcccagacccgcccccgccgccgccagagcccccgagcccgaggccgccgccagagccgaggccagagaggcccccggcggcggcagcgacagagacacccccagccccggcggcgtgagcgagagcggcagcgaggacggcctgtacgagtgccaccactgcgccaagaagttcagaagacaggcctacctgagaaagcacctgctggcccaccaccaggccctgcaggccaagggcgcccccctggccccccccgccgaggacctgctggccctgtaccccggccccgacgagaaggccccccaggaggccgccggcgacggcgagggcgccggcgtgctgggcctgagcgccagcgccgagtgccacctgtgccccgtgtgcggcgagagcttcgccagcaagggcgcccaggagagacacctgagactgctgcacgccgcccaggtgttcccctgcaagtactgccccgccaccttctacagcagccccggcctgaccagacacatcaacaagtgccaccccagcgagaacagacaggtgatcctgctgcaggtgcccgtgagacccgcctgctag

SEQ ID NO: 85329 - DNA, 1701 bp, Artificial Sequence
  Description of Artificial Sequence: Synthetic coding sequence
atgcccagaggcttcctggtgaagagaaccaagagaaccggcggcctgtacagagtgagactggccgagagagtgttccccctgctgggcccccagggcgccccccccttcctggaggaggcccccagcgccagcctgcccggcgccgagagagccaccccccccaccagagaggagcccggcaagggcctgaccgccgaggccgccagagagcagagcggcagcccctgcagagccgccggcgtgagccccggcaccggcggcagagagggcgccgagtggagagccggcggcagagagggccccggccccagccccagccccagccccagccccgccaagcccgccggcgccgagctgagaagagccttcctggagagatgcctgagcagccccgtgagcgccgagagcttccccggcggcgccgccgccgtggccgccttcagctgcagcgtggcccccgccgccgcccccacccccggcgagcagttcctgctgcccctgagagcccccttccccgagcccgccctgcagcccgaccccgcccccctgagcgccgccctgcagagcctgaagagagccgccggcggcgagagaagaggcaaggcccccaccgactgcgccagcggccccgccgccgccggcatcaagaagcccaaggccatgagaaagctgagcttcgccgacgaggtgaccaccagccccgtgctgggcctgaagatcaaggaggaggagcccggcgcccccagcagaggcctgggcggcagcagaacccccctgggcgagttcatctgccagctgtgcaaggagcagtacgccgaccccttcgccctggcccagcacagatgcagcagaatcgtgagagtggagtacagatgccccgagtgcgacaaggtgttcagctgccccgccaacctggccagccacagaagatggcacaagcccagacccgccgccgccaacgccgccaccgtgagcagcgccgacggcaagccccccagcagcagcagcagcagcagcagagacagcggcgccatcgccagcttcctggccgagggcaaggagaacagcagaatcgagagaaccgccgaccagcacccccaggccagagacagcagcggcgccgaccagcaccccgacagcgcccccagacagggcctgcaggtgctgacccaccccgagccccccctgccccagggcccctacaccgagggcgtgctgggcagaagagtgcccgtgcccggcagcaccagcggcggcagaggcagcgagatcttcgtgtgcccctactgccacaagaagttcagaagacaggcctacctgagaaagcacctgagcacccacgaggccggcagcgccagagccctggcccccggcttcggcagcgagagaggcgcccccctggccttcgcctgccccctgtgcggcgcccacttccccaccgccgacatcagagagaagcacagactgtggcacgccgtgagagaggagctgctgctgcccgccctggccggcgccccccccgagaccagcggccccagcggccccagcgacggcagcgcccagcagatcttcagctgcaagcactgccccagcaccttcttcagcagccccggcctgaccagacacatcaacaagtgccaccccagcgagagcagacaggtgctgctgctgcagatgcccctgagacccggctgctag

SEQ ID NO: 85330 - DNA, 792 bp, Artificial Sequence
  Description of Artificial Sequence: Synthetic coding sequence
atggtgaagatcgccttcaacacccccaccgccgtgcagaaggaggaggccagacaggacgtggaggccctgctgagcagaaccgtgagaacccagatcctgaccggcaaggagctgagagtggccacccaggagaaggagggcagcagcggcagatgcatgctgaccctgctgggcctgagcttcatcctggccggcctgatcgtgggcggcgcctgcatctacaagtacttcatgcccaagagcaccatctacagaggcgagatgtgcttcttcgacagcgaggaccccgccaacagcctgagaggcggcgagcccaacttcctgcccgtgaccgaggaggccgacatcagagaggacgacaacatcgccatcatcgacgtgcccgtgcccagcttcagcgacagcgaccccgccgccatcatccacgacttcgagaagggcatgaccgcctacctggacctgctgctgggcaactgctacctgatgcccctgaacaccagcatcgtgatgccccccaagaacctggtggagctgttcggcaagctggccagcggcagatacctgccccagacctacgtggtgagagaggacctggtggccgtggaggagatcagagacgtgagcaacctgggcatcttcatctaccagctgtgcaacaacagaaagagcttcagactgagaagaagagacctgctgctgggcttcaacaagagagccatcgacaagtgctggaagatcagacacttccccaacgagttcatcgtggagaccaagatctgccaggagtag

SEQ ID NO: 85331 - DNA, 660 bp, Artificial Sequence
  Description of Artificial Sequence: Synthetic coding sequence
atggtgaagatcgccttcaacacccccaccgccgtgcagaaggaggaggccagacaggacgtggaggccctgctgagcagaaccgtgagaacccagatcctgaccggcaagagcaccatctacagaggcgagatgtgcttcttcgacagcgaggaccccgccaacagcctgagaggcggcgagcccaacttcctgcccgtgaccgaggaggccgacatcagagaggacgacaacatcgccatcatcgacgtgcccgtgcccagcttcagcgacagcgaccccgccgccatcatccacgacttcgagaagggcatgaccgcctacctggacctgctgctgggcaactgctacctgatgcccctgaacaccagcatcgtgatgccccccaagaacctggtggagctgttcggcaagctggccagcggcagatacctgccccagacctacgtggtgagagaggacctggtggccgtggaggagatcagagacgtgagcaacctgggcatcttcatctaccagctgtgcaacaacagaaagagcttcagactgagaagaagagacctgctgctgggcttcaacaagagagccatcgacaagtgctggaagatcagacacttccccaacgagttcatcgtggagaccaagatctgccaggagtag

SEQ ID NO: 85332 - DNA, 801 bp, Artificial Sequence
  Description of Artificial Sequence: Synthetic coding sequence
atggtgaaggtgaccttcaacagcgccctggcccagaaggaggccaagaaggacgagcccaagagcggcgaggaggccctgatcatcccccccgacgccgtggccgtggactgcaaggaccccgacgacgtggtgcccgtgggccagagaagagcctggtgctggtgcatgtgcttcggcctggccttcatgctggccggcgtgatcctgggcggcgcctacctgtacaagtacttcgccctgcagcccgacgacgtgtactactgcggcatcaagtacatcaaggacgacgtgatcctgaacgagcccagcgccgacgcccccgccgccctgtaccagaccatcgaggagaacatcaagatcttcgaggaggaggaggtggagttcatcagcgtgcccgtgcccgagttcgccgacagcgaccccgccaacatcgtgcacgacttcaacaagaagctgaccgcctacctggacctgaacctggacaagtgctacgtgatccccctgaacaccagcatcgtgatgccccccagaaacctgctggagctgctgatcaacatcaaggccggcacctacctgccccagagctacctgatccacgagcacatggtgatcaccgacagaatcgagaacatcgaccacctgggcttcttcatctacagactgtgccacgacaaggagacctacaagctgcagagaagagagaccatcaagggcatccagaagagagaggccagcaactgcttcgccatcagacacttcgagaacaagttcgccgtggagaccctgatctgcagctag

SEQ ID NO: 85333 - DNA, 693 bp, Artificial Sequence
  Description of Artificial Sequence: Synthetic coding sequence
atggtgaagatcagcttccagcccgccgtggccggcatcaagggcgacaaggccgacaaggccagcgccagcgcccccgcccccgccagcgccaccgagatcctgctgacccccgccagagaggagcagcccccccagcacagaagcaagagaggcggcagcgtgggcggcgtgtgctacctgagcatgggcatggtggtgctgctgatgggcctggtgttcgccagcgtgtacatctacagatacttcttcctggcccagctggccagagacaacttcttcagatgcggcgtgctgtacgaggacagcctgagcagccaggtgagaacccagatggagctggaggaggacgtgaagatctacctggacgagaactacgagagaatcaacgtgcccgtgccccagttcggcggcggcgaccccgccgacatcatccacgacttccagagaagaggcacctacctgccccagacctacatcatccaggaggagatggtggtgaccgagcacgtgagcgacaaggaggccctgggcagcttcatctaccacctgtgcaacggcaaggacacctacagactgagaagaagagccaccagaagaagaatcaacaagagaggcgccaagaactgcaacgccatcagacacttcgagaacaccttcgtggtggagaccctgatctgcggcgtggtgtag

SEQ ID NO: 85334 - DNA, 804 bp, Artificial Sequence
  Description of Artificial Sequence: Synthetic coding sequence
atggtgaagatcagcttccagcccgccgtggccggcatcaagggcgacaaggccgacaaggccagcgccagcgcccccgcccccgccagcgccaccgagatcctgctgacccccgccagagaggagcagcccccccagcacagaagcaagagaggcggcagcgtgggcggcgtgtgctacctgagcatgggcatggtggtgctgctgatgggcctggtgttcgccagcgtgtacatctacagatacttcttcctggcccagctggccagagacaacttcttcagatgcggcgtgctgtacgaggacagcctgagcagccaggtgagaacccagatggagctggaggaggacgtgaagatctacctggacgagaactacgagagaatcaacgtgcccgtgccccagttcggcggcggcgaccccgccgacatcatccacgacttccagagaggcctgaccgcctaccacgacatcagcctggacaagtgctacgtgatcgagctgaacaccaccatcgtgctgccccccagaaacttctgggagctgctgatgaacgtgaagagaggcacctacctgccccagacctacatcatccaggaggagatggtggtgaccgagcacgtgagcgacaaggaggccctgggcagcttcatctaccacctgtgcaacggcaaggacacctacagactgagaagaagagccaccagaagaagaatcaacaagagaggcgccaagaactgcaacgccatcagacacttcgagaacaccttcgtggtggagaccctgatctgcggcgtggtgtag

SEQ ID NO: 85335 - DNA, 663 bp, Artificial Sequence
  Description of Artificial Sequence: Synthetic coding sequence
atggtgaagatcagcttccagcccgccgtggccggcatcaagggcgacaaggccgacaaggccagcgccagcgcccccgcccccgccagcgccaccgagatcctgctgacccccgccagactggccagagacaacttcttcagatgcggcgtgctgtacgaggacagcctgagcagccaggtgagaacccagatggagctggaggaggacgtgaagatctacctggacgagaactacgagagaatcaacgtgcccgtgccccagttcggcggcggcgaccccgccgacatcatccacgacttccagagaggcctgaccgcctaccacgacatcagcctggacaagtgctacgtgatcgagctgaacaccaccatcgtgctgccccccagaaacttctgggagctgctgatgaacgtgaagagaggcacctacctgccccagacctacatcatccaggaggagatggtggtgaccgagcacgtgagcgacaaggaggccctgggcagcttcatctaccacctgtgcaacggcaaggacacctacagactgagaagaagagccaccagaagaagaatcaacaagagaggcgccaagaactgcaacgccatcagacacttcgagaacaccttcgtggtggagaccctgatctgcggcgtggtgtag

SEQ ID NO: 85336 - DNA, 543 bp, Artificial Sequence
  Description of Artificial Sequence: Synthetic coding sequence
atggtgaagatcagcttccagcccgccgtggccggcatcaagggcgacaaggccgacaaggccagcgccagcgcccccgcccccgccagcgccaccgagatcctgctgacccccgccagagaggagcagcccccccagcacagaagcaagagaggcggcagcgtgggcggcgtgtgctacctgagcatgggcatggtggtgctgctgatgggcctggtgttcgccagcgtgtacatctacagatacttcttcctggcccagctggccagagacaacttcttcagatgcggcgtgctgtacgaggacagcctgagcagccaggtgagaacccagatggagctggaggaggacgtgaagatctacctggacgagaactacgagagaatcaacgtgcccgtgccccagttcggcggcggcgaccccgccgacatcatccacgacttccagagaggcctgaccgcctaccacgacatcagcctggacaagtgctacgtgatcgagctgaacaccaccatcgtgctgccccccagaaacttctggtag

SEQ ID NO: 85337 - DNA, 1839 bp, Artificial Sequence
  Description of Artificial Sequence: Synthetic coding sequence
atggccgccgccggcagactgcccagcagctgggccctgttcagccccctgctggccggcctggccctgctgggcgtgggccccgtgcccgccagagccctgcacaacgtgaccgccgagctgttcggcgccgaggcctggggcaccctggccgccttcggcgacctgaacagcgacaagcagaccgacctgttcgtgctgagagagagaaacgacctgatcgtgttcctggccgaccagaacgccccctacttcaagcccaaggtgaaggtgagcttcaagaaccacagcgccctgatcaccagcgtggtgcccggcgactacgacggcgacagccagatggacgtgctgctgacctacctgcccaagaactacgccaagagcgagctgggcgccgtgatcttctggggccagaaccagaccctggaccccaacaacatgaccatcctgaacagaaccttccaggacgagcccctgatcatggacttcaacggcgacctgatccccgacatcttcggcatcaccaacgagagcaaccagccccagatcctgctgggcggcaacctgagctggcaccccgccctgaccaccaccagcaagatgagaatcccccacagccacgccttcatcgacctgaccgaggacttcaccgccgacctgttcctgaccaccctgaacgccaccaccagcaccttccagttcgagatctgggagaacctggacggcaacttcagcgtgagcaccatcctggagaagccccagaacatgatggtggtgggccagagcgccttcgccgacttcgacggcgacggccacatggaccacctgctgcccggctgcgaggacaagaactgccagaagagcaccatctacctggtgagaagcggcatgaagcagtgggtgcccgtgctgcaggacttcagcaacaagggcaccctgtggggcttcgtgcccttcgtggacgagcagcagcccaccgagatccccatccccatcaccctgcacatcggcgactacaacatggacggctaccccgacgccctggtgatcctgaagaacaccagcggcagcaaccagcaggccttcctgctggagaacgtgccctgcaacaacgccagctgcgaggaggccagaagaatgttcaaggtgtactgggagctgaccgacctgaaccagatcaaggacgccatggtggccaccttcttcgacatctacgaggacggcatcctggacatcgtggtgctgagcaagggctacaccaagaacgacttcgccatccacaccctgaagaacaacttcgaggccgacgcctacttcgtgaaggtgatcgtgctgagcggcctgtgcagcaacgactgccccagaaagatcacccccttcggcgtgaaccagcccggcccctacatcatgtacaccaccgtggacgccaacggctacctgaagaacggcagcgccggccagctgagccagagcgcccacctggccctgcagctgccctacaacgtgctgggcctgggcagaagcgccaacttcctggaccacctgtacgtgggcatccccagacccagcggcgagaagagcatcagaaagcaggagtggaccgccatcatccccaacagccagctgatcgtgatcccctacccccacaacgtgcccagaagctggagcgccaagctgtacctgacccccagcaacatcgtgctgctgaccgccatcgccctgatcggcgtgtgcgtgttcatcctggccatcatcggcatcctgcactggcaggagaagaaggccgacgacagagagaagagacaggaggcccacagattccacttcgacgccatgtag

SEQ ID NO: 85338 - DNA, 819 bp, Artificial Sequence
  Description of Artificial Sequence: Synthetic coding sequence
atggacggctaccccgacgccctggtgatcctgaagaacaccagcggcagcaaccagcaggccttcctgctggagaacgtgccctgcaacaacgccagctgcgaggaggccagaagaatgttcaaggtgtactgggagctgaccgacctgaaccagatcaaggacgccatggtggccaccttcttcgacatctacgaggacggcatcctggacatcgtggtgctgagcaagggctacaccaagaacgacttcgccatccacaccctgaagaacaacttcgaggccgacgcctacttcgtgaaggtgatcgtgctgagcggcctgtgcagcaacgactgccccagaaagatcacccccttcggcgtgaaccagcccggcccctacatcatgtacaccaccgtggacgccaacggctacctgaagaacggcagcgccggccagctgagccagagcgcccacctggccctgcagctgccctacaacgtgctgggcctgggcagaagcgccaacttcctggaccacctgtacgtgggcatccccagacccagcggcgagaagagcatcagaaagcaggagtggaccgccatcatccccaacagccagctgatcgtgatcccctacccccacaacgtgcccagaagctggagcgccaagctgtacctgacccccagcaacatcgtgctgctgaccgccatcgccctgatcggcgtgtgcgtgttcatcctggccatcatcggcatcctgcactggcaggagaagaaggccgacgacagagagaagagacaggaggcccacagattccacttcgacgccatgtag

SEQ ID NO: 85339 - DNA, 1074 bp, Artificial Sequence
  Description of Artificial Sequence: Synthetic coding sequence
atgatggtggtgggccagagcgccttcgccgacttcgacggcgacggccacatggaccacctgctgcccggctgcgaggacaagaactgccagaagagcaccatctacctggtgagaagcggcatgaagcagtgggtgcccgtgctgcaggacttcagcaacaagggcaccctgtggggcttcgtgcccttcgtggacgagcagcagcccaccgagatccccatccccatcaccctgcacatcggcgactacaacatggacggctaccccgacgccctggtgatcctgaagaacaccagcggcagcaaccagcaggccttcctgctggagaacgtgccctgcaacaacgccagctgcgaggaggccagaagaatgttcaaggtgtactgggagctgaccgacctgaaccagatcaaggacgccatggtggccaccttcttcgacatctacgaggacggcatcctggacatcgtggtgctgagcaagggctacaccaagaacgacttcgccatccacaccctgaagaacaacttcgaggccgacgcctacttcgtgaaggtgatcgtgctgagcggcctgtgcagcaacgactgccccagaaagatcacccccttcggcgtgaaccagcccggcccctacatcatgtacaccaccgtggacgccaacggctacctgaagaacggcagcgccggccagctgagccagagcgcccacctggccctgcagctgccctacaacgtgctgggcctgggcagaagcgccaacttcctggaccacctgtacgtgggcatccccagacccagcggcgagaagagcatcagaaagcaggagtggaccgccatcatccccaacagccagctgatcgtgatcccctacccccacaacgtgcccagaagctggagcgccaagctgtacctgacccccagcaacatcgtgctgctgaccgccatcgccctgatcggcgtgtgcgtgttcatcctggccatcatcggcatcctgcactggcaggagaagaaggccgacgacagagagaagagacaggaggcccacagattccacttcgacgccatgtag

SEQ ID NO: 85340 - DNA, 1395 bp, Artificial Sequence
  Description of Artificial Sequence: Synthetic coding sequence
atggacgtgctgctgacctacctgcccaagaactacgccaagagcgagctgggcgccgtgatcttctggggccagaaccagaccctggaccccaacaacatgaccatcctgaacagaaccttccaggacgagcccctgatcatggacttcaacggcgacctgatccccgacatcttcggcatcaccaacgagagcaaccagccccagatcctgctgggcggcaacctgagctggcaccccgccctgaccaccaccagcaagatgagaatcccccacagccacgccttcatcgacctgaccgaggacttcaccgccgacctgttcctgaccaccctgaacgccaccaccagcaccttccagttcgagatctgggagaacctggacggcaacttcagcgtgagcaccatcctggagaagccccagaacatgatggtggtgggccagagcgccttcgccgacttcgacggcgacggccacatggaccacctgctgcccggctgcgaggacaagaactgccagaagagcaccatctacctggtgagaagcggcatgaagcagtgggtgcccgtgctgcaggacttcagcaacaagggcaccctgtggggcttcgtgcccttcgtggacgagcagcagcccaccgagatccccatccccatcaccctgcacatcggcgactacaacatggacggctaccccgacgccctggtgatcctgaagaacaccagcggcagcaaccagcaggccttcctgctggagaacgtgccctgcaacaacgccagctgcgaggaggccagaagaatgttcaaggtgtactgggagctgaccgacctgaaccagatcaaggacgccatggtggccaccttcttcgacatctacgaggacggcatcctggacatcgtggtgctgagcaagggctacaccaagaacgacttcgccatccacaccctgaagaacaacttcgaggccgacgcctacttcgtgaaggtgatcgtgctgagcggcctgtgcagcaacgactgccccagaaagatcacccccttcggcgtgaaccagcccggcccctacatcatgtacaccaccgtggacgccaacggctacctgaagaacggcagcgccggccagctgagccagagcgcccacctggccctgcagctgccctacaacgtgctgggcctgggcagaagcgccaacttcctggaccacctgtacgtgggcatccccagacccagcggcgagaagagcatcagaaagcaggagtggaccgccatcatccccaacagccagctgatcgtgatcccctacccccacaacgtgcccagaagcagccacagatgcctgtgcttccacctgggcaacaactggcacttcaccctggccggcaaggagagcagatag

SEQ ID NO: 85341 - DNA, 1044 bp, Artificial Sequence
  Description of Artificial Sequence: Synthetic coding sequence
atgagcctgctgtgcagaaacaagggctgcggccagcacttcgaccccaacaccaacctgcccgacagctgctgccaccaccccggcgtgcccatcttccacgacgccctgaagggctggagctgctgcagaaagagaaccgtggacttcagcgagttcctgaacatcaagggctgcaccatgggcccccactgcgccgagaagctgcccgaggccccccagcccgagggccccgccaccagcagcagcctgcaggagcagaagcccctgaacgtgatccccaagagcgccgagaccctgagaagagagagacccaagagcgagctgcccctgaagctgctgcccctgaacatcagccaggccctggagatggccctggagcagaaggagctggaccaggagcccggcgccggcctggacagcctgatcagaaccggcagcagctgccagaaccccggctgcgacgccgtgtaccagggccccgagagcgacgccaccccctgcacctaccaccccggcgcccccagattccacgagggcatgaagagctggagctgctgcggcatccagaccctggacttcggcgccttcctggcccagcccggctgcagagtgggcagacacgactggggcaagcagctgcccgccagctgcagacacgactggcaccagaccgacagcctggtggtggtgaccgtgtacggccagatccccctgcccgccttcaactgggtgaaggccagccagaccgagctgcacgtgcacatcgtgttcgacggcaacagagtgttccaggcccagatgaagctgtggggcgtgatcaacgtggagcagagcagcgtgttcctgatgcccagcagagtggagatcagcctggtgaaggccgaccccggcagctgggcccagctggagcaccccgacgccctggccaagaaggccagagccggcgtggtgctggagatggacgaggaggagagcgacgacagcgacgacgacctgagctggaccgaggaggaggaggaggaggaggccatgggcgagtag

SEQ ID NO: 85342 - DNA, 990 bp, Artificial Sequence
  Description of Artificial Sequence: Synthetic coding sequence
atgagcaccgacagctgctgccaccaccccggcgtgcccatcttccacgacgccctgaagggctggagctgctgcagaaagagaaccgtggacttcagcgagttcctgaacatcaagggctgcaccatgggcccccactgcgccgagaagctgcccgaggccccccagcccgagggccccgccaccagcagcagcctgcaggagcagaagcccctgaacgtgatccccaagagcgccgagaccctgagaagagagagacccaagagcgagctgcccctgaagctgctgcccctgaacatcagccaggccctggagatggccctggagcagaaggagctggaccaggagcccggcgccggcctggacagcctgatcagaaccggcagcagctgccagaaccccggctgcgacgccgtgtaccagggccccgagagcgacgccaccccctgcacctaccaccccggcgcccccagattccacgagggcatgaagagctggagctgctgcggcatccagaccctggacttcggcgccttcctggcccagcccggctgcagagtgggcagacacgactggggcaagcagctgcccgccagctgcagacacgactggcaccagaccgacagcctggtggtggtgaccgtgtacggccagatccccctgcccgccttcaactgggtgaaggccagccagaccgagctgcacgtgcacatcgtgttcgacggcaacagagtgttccaggcccagatgaagctgtggggcgtgatcaacgtggagcagagcagcgtgttcctgatgcccagcagagtggagatcagcctggtgaaggccgaccccggcagctgggcccagctggagcaccccgacgccctggccaagaaggccagagccggcgtggtgctggagatggacgaggaggagagcgacgacagcgacgacgacctgagctggaccgaggaggaggaggaggaggaggccatgggcgagtag

SEQ ID NO: 85343 - DNA, 603 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctggacctgatcaactacatcgacgtggcccagcaggacggcaagctgcccttcgtgccccccgaggaggagttcatcatgggcgtgagcaagtacggcatcaaggtgagcaccagcgaccagtacgacgtgctgcacagacacgccctgtacctgatcatcagaatggtgtgctacgacgacggcctgggcgccggcaagagcctgctggccctgaagaccaccgacgccagcaacgaggagtacagcctgtgggtgtaccagtgcaacagcctggagcaggcccaggccatctgcaaggtgctgagcaccgccttcgacagcgtgctgaccagcgagaagccctag

SEQ ID NO: 85344 - DNA, 603 bp, Artificial Sequence; identical to SEQ ID NO: 85343
  Description of Artificial Sequence: Synthetic coding sequence

SEQ ID NO: 85345 - DNA, 255 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggctag

SEQ ID NO: 85346 - DNA, 291 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctggacctgatcaactacatcgacgtggcccagtag

SEQ ID NO: 85347 - DNA, 261 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctgtag

SEQ ID NO: 85348 - DNA, 411 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctggacctgatcaactacatcgacgtggcccagcaggacggcaagctgcccttcgtgccccccgaggaggagttcatcatgggcgtgagcaagtacggcatcaaggtgagcaccagcgaccagtacgacgtgctgcacagacacgccctgtactag

SEQ ID NO: 85349 - DNA, 345 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctggacctgatcaactacatcgacgtggcccagcaggacggcaagctgcccttcgtgccccccgaggaggagttcatcatgggcgtgtag

SEQ ID NO: 85350 - DNA, 198 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatctag

SEQ ID NO: 85351 - DNA, 453 bp, Artificial Sequence
  Description of Artificial Sequence: Synthetic coding sequence
atgttcagaaagggcaagaagagacacagcagcagcagcagccagagcagcgagatcagcaccaagagcaagagcgtggacagcagcctgggcggcctgagcagaagcagcaccgtggccagcctggacaccgacagcaccaagagcagcggccagagcaacaacaacagcgacacctgcgccgagttcagaatcaagtacgtgggcgccatcgagaagctgaagctgagcgagggcaagggcctggagggccccctggacctgatcaactacatcgacgtggcccagcaggacggcaagctgcccttcgtgccccccgaggaggagttcatcatgggcgtgagcaagtacggcatcaaggtgagcaccagcgaccagtacgagcaggcccaggccatctgcaaggtgctgagcaccgccttcgacagcgtgctgaccagcgagaagccctag

SEQ ID NO: 85352 - DNA, 534 bp, Artificial Sequence
  Description of Artificial Sequence: Synthetic coding sequence
atgcccgtgaagagaagcctgaagctggacggcctgctggaggagaacagcttcgaccccagcaagatcaccagaaagaagagcgtgatcacctacagccccaccaccggcacctgccagatgagcctgttcgccagccccaccagcagcgaggagcagaagcacagaaacggcctgagcaacgagaagagaaagaagctgaaccaccccagcctgaccgagagcaaggagagcaccaccaaggacaacgacgagttcatgatgctgctgagcaaggtggagaagctgagcgaggagatcatggagatcatgcagaacctgagcagcatccaggccctggagggcagcagagagctggagaacctgatcggcatcagctgcgccagccacttcctgaagagagagatgcagaagaccaaggagctgatgaccaaggtgaacaagcagaagctgttcgagaagagcaccggcctgccccacaaggccagcagacacctggacagctacgagttcctgaaggccatcctgaactag

SEQ ID NO: 85353 - DNA, 513 bp, Artificial Sequence
  Description of Artificial Sequence: Synthetic coding sequence
atgcccgtgaagagaagcctgaagctggacggcctgctggaggagaacagcttcgaccccagcaagatcaccagaaagaagagcgtgatcacctacagccccaccaccggcacctgccagatgagcctgttcgccagccccaccagcagcgaggagcagaagcacagaaacggcctgagcaacgagaagagaaagaagctgaaccaccccagcctgaccgagagcaaggagagcaccaccaaggacaacgacgagttcatgatgctgctgagcaaggtggagaagctgagcgaggagatcatggagatcatgcagaacctgagcagcatccaggccctggagggcagcagagagctggagaacctgatcggcatcagctgcgccagccacttcctgaagagagagatgcagaagaccaaggagctgatgaccaaggtgaacaagcagaagctgttcgagaagagcaccggcctgccccacaagggccagccccagatgagccagcccctgtag

SEQ ID NO: 85354 - DNA, 651 bp, Artificial Sequence
  Description of Artificial Sequence: Synthetic coding sequence
atgcccttcgcccccgtggcccaggccagagtgcagtggcacgacttcagaagcctgcagcacctgctgcccgccttcaagagattcagctgcctgagcctgggcagcagctgggactacagcgtgaagagaagcctgaagctggacggcctgctggaggagaacagcttcgaccccagcaagatcaccagaaagaagagcgtgatcacctacagccccaccaccggcacctgccagatgagcctgttcgccagccccaccagcagcgaggagcagaagcacagaaacggcctgagcaacgagaagagaaagaagctgaaccaccccagcctgaccgagagcaaggagagcaccaccaaggacaacgacgagttcatgatgctgctgagcaaggtggagaagctgagcgaggagatcatggagatcatgcagaacctgagcagcatccaggccctggagggcagcagagagctggagaacctgatcggcatcagctgcgccagccacttcctgaagagagagatgcagaagaccaaggagctgatgaccaaggtgaacaagcagaagctgttcgagaagagcaccggcctgccccacaaggccagcagacacctggacagctacgagttcctgaaggccatcctgaactag

SEQ ID NO: 85355 - DNA, 3540 bp, Artificial Sequence
  Description of Artificial Sequence: Synthetic coding sequence
atggcccccagacccagagccagacccggcgtggccgtggcctgctgctggctgctgaccgtggtgctgagatgctgcgtgagcttcaacgtggacgtgaagaacagcatgaccttcagcggccccgtggaggacatgttcggctacaccgtgcagcagtacgagaacgaggagggcaagtgggtgctgatcggcagccccctggtgggccagcccaagaacagaaccggcgacgtgtacaagtgccccgtgggcagaggcgagagcctgccctgcgtgaagctggacctgcccgtgaacaccagcatccccaacgtgaccgaggtgaaggagaacatgaccttcggcagcaccctggtgaccaaccccaacggcggcttcctggcctgcggccccctgtacgcctacagatgcggccacctgcactacaccaccggcatctgcagcgacgtgagccccaccttccaggtggtgaacagcatcgcccccgtgcaggagtgcagcacccagctggacatcgtgatcgtgctggacggcagcaacagcatctacccctgggacagcgtgaccgccttcctgaacgacctgctggagagaatggacatcggccccaagcagacccaggtgggcatcgtgcagtacggcgagaacgtgacccacgagttcaacctgaacaagtacagcagcaccgaggaggtgctggtggccgccaagaagatcgtgcagagaggcggcagacagaccatgaccgccctgggcatcgacaccgccagaaaggaggccttcaccgaggccagaggcgccagaagaggcgtgaagaaggtgatggtgatcgtgaccgacggcgagagccacgacaaccacagactgaagaaggtgatccaggactgcgaggacgagaacatccagagattcagcatcgccatcctgggcagctacaacagaggcaacctgagcaccgagaagttcgtggaggagatcaagagcatcgccagcgagcccaccgagaagcacttcttcaacgtgagcgacgagctggccctggtgaccatcgtgaagaccctgggcgagagaatcttcgccctggaggccaccgccgaccagagcgccgccagcttcgagatggagatgagccagaccggcttcagcgcccactacagccaggactgggtgatgctgggcgccgtgggcgcctacgactggaacggcaccgtggtgatgcagaaggccagccagatcatcatccccagaaacaccaccttcaacgtggagagcaccaagaagaacgagcccctggccagctacctgggctacaccgtgaacagcgccaccgccagcagcggcgacgtgctgtacatcgccggccagcccagatacaaccacaccggccaggtgatcatctacagaatggaggacggcaacatcaagatcctgcagaccctgagcggcgagcagatcggcagctacttcggcagcatcctgaccaccaccgacatcgacaaggacagcaacaccgacatcctgctggtgggcgcccccatgtacatgggcaccgagaaggaggagcagggcaaggtgtacgtgtacgccctgaaccagaccagattcgagtaccagatgagcctggagcccatcaagcagacctgctgcagcagcagacagcacaacagctgcaccaccgagaacaagaacgagccctgcggcgccagattcggcaccgccatcgccgccgtgaaggacctgaacctggacggcttcaacgacatcgtgatcggcgcccccctggaggacgaccacggcggcgccgtgtacatctaccacggcagcggcaagaccatcagaaaggagtacgcccagagaatccccagcggcggcgacggcaagaccctgaagttcttcggccagagcatccacggcgagatggacctgaacggcgacggcctgaccgacgtgaccatcggcggcctgggcggcgccgccctgttctggagcagagacgtggccgtggtgaaggtgaccatgaacttcgagcccaacaaggtgaacatccagaagaagaactgccacatggagggcaaggagaccgtgtgcatcaacgccaccgtgtgcttcgacgtgaagctgaagagcaaggaggacaccatctacgaggccgacctgcagtacagagtgaccctggacagcctgagacagatcagcagaagcttcttcagcggcacccaggagagaaaggtgcagagaaacatcaccgtgagaaagagcgagtgcaccaagcacagcttctacatgctggacaagcacgacttccaggacagcgtgagaatcaccctggacttcaacctgaccgaccccgagaacggccccgtgctggacgacagcctgcccaacagcgtgcacgagtacatccccttcgccaaggactgcggcaacaaggagaagtgcatcagcgacctgagcctgcacgtggccaccaccgagaaggacctgctgatcgtgagaagccagaacgacaagttcaacgtgagcctgaccgtgaagaacaccaaggacagcgcctacaacaccagaaccatcgtgcactacagccccaacctggtgttcagcggcatcgaggccatccagaaggacagctgcgagagcaaccacaacatcacctgcaaggtgggctaccccttcctgagaagaggcgagatggtgaccttcaagatcctgttccagttcaacaccagctacctgatggagaacgtgaccatctacctgagcgccaccagcgacagcgaggagccccccgagaccctgagcgacaacgtggtgaacatcagcatccccgtgaagtacgaggtgggcctgcagttctacagcagcgccagcgagtaccacatcagcatcgccgccaacgagaccgtgcccgaggtgatcaacagcaccgaggacatcggcaacgagatcaacatcttctacctgatcagaaagagcggcagcttccccatgcccgagctgaagctgagcatcagcttccccaacatgaccagcaacggctaccccgtgctgtaccccaccggcctgagcagcagcgagaacgccaactgcagaccccacatcttcgaggaccccttcagcatcaacagcggcaagaagatgaccaccagcaccgaccacctgaagagaggcaccatcctggactgcaacacctgcaagttcgccaccatcacctgcaacctgaccagcagcgacatcagccaggtgaacgtgagcctgatcctgtggaagcccaccttcatcaagagctacttcagcagcctgaacctgaccatcagaggcgagctgagaagcgagaacgccagcctggtgctgagcagcagcaaccagaagagagagctggccatccagatcagcaaggacggcctgcccggcagagtgcccctgtgggtgatcctgctgagcgccttcgccggcctgctgctgctgatgctgctgatcctggccctgtggaagatcggcttcttcaagagacccctgaagaagaagatggagaagtag

SEQ ID NO: 85356 - DNA, 3567 bp, Artificial Sequence
  Description of Artificial Sequence: Synthetic coding sequence
atggacctgcccagaggcctggtggtggcctgggccctgagcctgtggcccggcttcaccgacaccttcaacatggacaccagaaagcccagagtgatccccggcagcagaaccgccttcttcggctacaccgtgcagcagcacgacatcagcggcaacaagtggctggtggtgggcgcccccctggagaccaacggctaccagaagaccggcgacgtgtacaagtgccccgtgatccacggcaactgcaccaagctgaacctgggcagagtgaccctgagcaacgtgagcgagagaaaggacaacatgagactgggcctgagcctggccaccaaccccaaggacaacagcttcctggcctgcagccccctgtggagccacgagtgcggcagcagctactacaccaccggcatgtgcagcagagtgaacagcaacttcagattcagcaagaccgtggcccccgccctgcagagatgccagacctacatggacatcgtgatcgtgctggacggcagcaacagcatctacccctgggtggaggtgcagcacttcctgatcaacatcctgaagaagttctacatcggccccggccagatccaggtgggcgtggtgcagtacggcgaggacgtggtgcacgagttccacctgaacgactacagaagcgtgaaggacgtggtggaggccgccagccacatcgagcagagaggcggcaccgagaccagaaccgccttcggcatcgagttcgccagaagcgaggccttccagaagggcggcagaaagggcgccaagaaggtgatgatcgtgatcaccgacggcgagagccacgacagccccgacctggagaaggtgatccagcagagcgagagagacaacgtgaccagatacgccgtggccgtgctgggctactacaacagaagaggcatcaaccccgagaccttcctgaacgagatcaagtacatcgccagcgaccccgacgacaagcacttcttcaacgtgaccgacgaggccgccctgaaggacatcgtggacgccctgggcgacagaatcttcagcctggagggcaccaacaagaacgagaccagcttcggcctggagatgagccagaccggcttcagcagccacgtggtggaggacggcgtgctgctgggcgccgtgggcgcctacgactggaacggcgccgtgctgaaggagaccagcgccggcaaggtgatccccctgagagagagctacctgaaggagttccccgaggagctgaagaaccacggcgcctacctgggctacaccgtgaccagcgtggtgagcagcagacagggcagagtgtacgtggccggcgcccccagattcaaccacaccggcaaggtgatcctgttcaccatgcacaacaacagaagcctgaccatccaccaggccatgagaggccagcagatcggcagctacttcggcagcgagatcaccagcgtggacatcgacggcgacggcgtgaccgacgtgctgctggtgggcgcccccatgtacttcaacgagggcagagagagaggcaaggtgtacgtgtacgagctgagacagaacctgttcgtgtacaacggcaccctgaaggacagccacagctaccagaacgccagattcggcagcagcatcgccagcgtgagagacctgaaccaggacagctacaacgacgtggtggtgggcgcccccctggaggacaaccacgccggcgccatctacatcttccacggcttcagaggcagcatcctgaagacccccaagcagagaatcaccgccagcgagctggccaccggcctgcagtacttcggctgcagcatccacggccagctggacctgaacgaggacggcctgatcgacctggccgtgggcgccctgggcaacgccgtgatcctgtggagcagacccgtggtgcagatcaacgccagcctgcacttcgagcccagcaagatcaacatcttccacagagactgcaagagaagcggcagagacgccacctgcctggccgccttcctgtgcttcacccccatcttcctggccccccacttccagaccaccaccgtgggcatcagatacaacgccaccatggacgagagaagatacacccccagagcccacctggacgagggcggcgacagattcaccaacagagccgtgctgctgagcagcggccaggagctgtgcgagagaatcaacttccacgtgctggacaccgccgactacgtgaagcccgtgaccttcagcgtggagtacagcctggaggaccccgaccacggccccatgctggacgacggctggcccaccaccctgagagtgagcgtgcccttctggaacggctgcaacgaggacgagcactgcgtgcccgacctggtgctggacgccagaagcgacctgcccaccgccatggagtactgccagagagtgctgagaaagcccgcccaggactgcagcgcctacaccctgagcttcgacaccaccgtgttcatcatcgagagcaccagacagagagtggccgtggaggccaccctggagaacagaggcgagaacgcctacagcaccgtgctgaacatcagccagagcgccaacctgcagttcgccagcctgatccagaaggaggacagcgacggcagcatcgagtgcgtgaacgaggagagaagactgcagaagcaggtgtgcaacgtgagctaccccttcttcagagccaaggccaaggtggccttcagactggacttcgagttcagcaagagcatcttcctgcaccacctggagatcgagctggccgccggcagcgacagcaacgagagagacagcaccaaggaggacaacgtggcccccctgagattccacctgaagtacgaggccgacgtgctgttcaccagaagcagcagcctgagccactacgaggtgaagcccaacagcagcctggagagatacgacggcatcggcccccccttcagctgcatcttcagaatccagaacctgggcctgttccccatccacggcatgatgatgaagatcaccatccccatcgccaccagaagcggcaacagactgctgaagctgagagacttcctgaccgacgaggccaacaccagctgcaacatctggggcaacagcaccgagtacagacccacccccgtggaggaggacctgagaagagccccccagctgaaccacagcaacagcgacgtggtgagcatcaactgcaacatcagactggtgcccaaccaggagatcaacttccacctgctgggcaacctgtggctgagaagcctgaaggccctgaagtacaagagcatgaagatcatggtgaacgccgccctgcagagacagttccacagccccttcatcttcagagaggaggaccccagcagacagatcgtgttcgagatcagcaagcaggaggactggcaggtgcccatctggatcatcgtgggcagcaccctgggcggcctgctgctgctggccctgctggtgctggccctgtggaagctgggcttcttcagaagcgccagaagaagaagagagcccggcctggaccccacccccaaggtgctggagtag

SEQ ID NO: 85357 - DNA, 3570 bp, Artificial Sequence
  Description of Artificial Sequence: Synthetic coding sequence
atggacctgcccagaggcctggtggtggcctgggccctgagcctgtggcccggcttcaccgacaccttcaacatggacaccagaaagcccagagtgatccccggcagcagaaccgccttcttcggctacaccgtgcagcagcacgacatcagcggcaacaagtggctggtggtgggcgcccccctggagaccaacggctaccagaagaccggcgacgtgtacaagtgccccgtgatccacggcaactgcaccaagctgaacctgggcagagtgaccctgagcaacgtgagcgagagaaaggacaacatgagactgggcctgagcctggccaccaaccccaaggacaacagcttcctggcctgcagccccctgtggagccacgagtgcggcagcagctactacaccaccggcatgtgcagcagagtgaacagcaacttcagattcagcaagaccgtggcccccgccctgcagagatgccagacctacatggacatcgtgatcgtgctggacggcagcaacagcatctacccctgggtggaggtgcagcacttcctgatcaacatcctgaagaagttctacatcggccccggccagatccaggtgggcgtggtgcagtacggcgaggacgtggtgcacgagttccacctgaacgactacagaagcgtgaaggacgtggtggaggccgccagccacatcgagcagagaggcggcaccgagaccagaaccgccttcggcatcgagttcgccagaagcgaggccttccagaagggcggcagaaagggcgccaagaaggtgatgatcgtgatcaccgacggcgagagccacgacagccccgacctggagaaggtgatccagcagagcgagagagacaacgtgaccagatacgccgtggccgtgctgggctactacaacagaagaggcatcaaccccgagaccttcctgaacgagatcaagtacatcgccagcgaccccgacgacaagcacttcttcaacgtgaccgacgaggccgccctgaaggacatcgtggacgccctgggcgacagaatcttcagcctggagggcaccaacaagaacgagaccagcttcggcctggagatgagccagaccggcttcagcagccacgtggtggaggacggcgtgctgctgggcgccgtgggcgcctacgactggaacggcgccgtgctgaaggagaccagcgccggcaaggtgatccccctgagagagagctacctgaaggagttccccgaggagctgaagaaccacggcgcctacctgggctacaccgtgaccagcgtggtgagcagcagacagggcagagtgtacgtggccggcgcccccagattcaaccacaccggcaaggtgatcctgttcaccatgcacaacaacagaagcctgaccatccaccaggccatgagaggccagcagatcggcagctacttcggcagcgagatcaccagcgtggacatcgacggcgacggcgtgaccgacgtgctgctggtgggcgcccccatgtacttcaacgagggcagagagagaggcaaggtgtacgtgtacgagctgagacagaacctgttcgtgtacaacggcaccctgaaggacagccacagctaccagaacgccagattcggcagcagcatcgccagcgtgagagacctgaaccaggacagctacaacgacgtggtggtgggcgcccccctggaggacaaccacgccggcgccatctacatcttccacggcttcagaggcagcatcctgaagacccccaagcagagaatcaccgccagcgagctggccaccggcctgcagtacttcggctgcagcatccacggccagctggacctgaacgaggacggcctgatcgacctggccgtgggcgccctgggcaacgccgtgatcctgtggagcagacccgtggtgcagatcaacgccagcctgcacttcgagcccagcaagatcaacatcttccacagagactgcaagagaagcggcagagacgccacctgcctggccgccttcctgtgcttcacccccatcttcctggccccccacttccagaccaccaccgtgggcatcagatacaacgccaccatggacgagagaagatacacccccagagcccacctggacgagggcggcgacagattcaccaacagagccgtgctgctgagcagcggccaggagctgtgcgagagaatcaacttccacgtgctggacaccgccgactacgtgaagcccgtgaccttcagcgtggagtacagcctggaggaccccgaccacggccccatgctggacgacggctggcccaccaccctgagagtgagcgtgcccttctggaacggctgcaacgaggacgagcactgcgtgcccgacctggtgctggacgccagaagcgacctgcccaccgccatggagtactgccagagagtgctgagaaagcccgcccaggactgcagcgcctacaccctgagcttcgacaccaccgtgttcatcatcgagagcaccagacagagagtggccgtggaggccaccctggagaacagaggcgagaacgcctacagcaccgtgctgaacatcagccagagcgccaacctgcagttcgccagcctgatccagaaggaggacagcgacggcagcatcgagtgcgtgaacgaggagagaagactgcagaagcaggtgtgcaacgtgagctaccccttcttcagagccaaggccaaggtggccttcagactggacttcgagttcagcaagagcatcttcctgcaccacctggagatcgagctggccgccggcagcgacagcaacgagagagacagcaccaaggaggacaacgtggcccccctgagattccacctgaagtacgaggccgacgtgctgttcaccagaagcagcagcctgagccactacgaggtgaagcccaacagcagcctggagagatacgacggcatcggcccccccttcagctgcatcttcagaatccagaacctgggcctgttccccatccacggcatgatgatgaagatcaccatccccatcgccaccagaagcggcaacagactgctgaagctgagagacttcctgaccgacgaggtggccaacaccagctgcaacatctggggcaacagcaccgagtacagacccacccccgtggaggaggacctgagaagagccccccagctgaaccacagcaacagcgacgtggtgagcatcaactgcaacatcagactggtgcccaaccaggagatcaacttccacctgctgggcaacctgtggctgagaagcctgaaggccctgaagtacaagagcatgaagatcatggtgaacgccgccctgcagagacagttccacagccccttcatcttcagagaggaggaccccagcagacagatcgtgttcgagatcagcaagcaggaggactggcaggtgcccatctggatcatcgtgggcagcaccctgggcggcctgctgctgctggccctgctggtgctggccctgtggaagctgggcttcttcagaagcgccagaagaagaagagagcccggcctggaccccacccccaaggtgctggagtag

SEQ ID NO: 85358 - DNA, 2472 bp, Artificial Sequence
  Description of Artificial Sequence: Synthetic coding sequence
atgagccagaccggcttcagcagccacgtggtggaggacggcgtgctgctgggcgccgtgggcgcctacgactggaacggcgccgtgctgaaggagaccagcgccggcaaggtgatccccctgagagagagctacctgaaggagttccccgaggagctgaagaaccacggcgcctacctgggctacaccgtgaccagcgtggtgagcagcagacagggcagagtgtacgtggccggcgcccccagattcaaccacaccggcaaggtgatcctgttcaccatgcacaacaacagaagcctgaccatccaccaggccatgagaggccagcagatcggcagctacttcggcagcgagatcaccagcgtggacatcgacggcgacggcgtgaccgacgtgctgctggtgggcgcccccatgtacttcaacgagggcagagagagaggcaaggtgtacgtgtacgagctgagacagaacctgttcgtgtacaacggcaccctgaaggacagccacagctaccagaacgccagattcggcagcagcatcgccagcgtgagagacctgaaccaggacagctacaacgacgtggtggtgggcgcccccctggaggacaaccacgccggcgccatctacatcttccacggcttcagaggcagcatcctgaagacccccaagcagagaatcaccgccagcgagctggccaccggcctgcagtacttcggctgcagcatccacggccagctggacctgaacgaggacggcctgatcgacctggccgtgggcgccctgggcaacgccgtgatcctgtggagcagacccgtggtgcagatcaacgccagcctgcacttcgagcccagcaagatcaacatcttccacagagactgcaagagaagcggcagagacgccacctgcctggccgccttcctgtgcttcacccccatcttcctggccccccacttccagaccaccaccgtgggcatcagatacaacgccaccatggacgagagaagatacacccccagagcccacctggacgagggcggcgacagattcaccaacagagccgtgctgctgagcagcggccaggagctgtgcgagagaatcaacttccacgtgctggacaccgccgactacgtgaagcccgtgaccttcagcgtggagtacagcctggaggaccccgaccacggccccatgctggacgacggctggcccaccaccctgagagtgagcgtgcccttctggaacggctgcaacgaggacgagcactgcgtgcccgacctggtgctggacgccagaagcgacctgcccaccgccatggagtactgccagagagtgctgagaaagcccgcccaggactgcagcgcctacaccctgagcttcgacaccaccgtgttcatcatcgagagcaccagacagagagtggccgtggaggccaccctggagaacagaggcgagaacgcctacagcaccgtgctgaacatcagccagagcgccaacctgcagttcgccagcctgatccagaaggaggacagcgacggcagcatcgagtgcgtgaacgaggagagaagactgcagaagcaggtgtgcaacgtgagctaccccttcttcagagccaaggccaaggtggccttcagactggacttcgagttcagcaagagcatcttcctgcaccacctggagatcgagctggccgccggcagcgacagcaacgagagagacagcaccaaggaggacaacgtggcccccctgagattccacctgaagtacgaggccgacgtgctgttcaccagaagcagcagcctgagccactacgaggtgaagcccaacagcagcctggagagatacgacggcatcggcccccccttcagctgcatcttcagaatccagaacctgggcctgttccccatccacggcatgatgatgaagatcaccatccccatcgccaccagaagcggcaacagactgctgaagctgagagacttcctgaccgacgaggccaacaccagctgcaacatctggggcaacagcaccgagtacagacccacccccgtggaggaggacctgagaagagccccccagctgaaccacagcaacagcgacgtggtgagcatcaactgcaacatcagactggtgcccaaccaggagatcaacttccacctgctgggcaacctgtggctgagaagcctgaaggccctgaagtacaagagcatgaagatcatggtgaacgccgccctgcagagacagttccacagccccttcatcttcagagaggaggaccccagcagacagatcgtgttcgagatcagcaagcaggaggactggcaggtgcccatctggatcatcgtgggcagcaccctgggcggcctgctgctgctggccctgctggtgctggccctgtggaagctgggcttcttcagaagcgccagaagaagaagagagcccggcctggaccccacccccaaggtgctggagtag

SEQ ID NO: 85359 - DNA, 1953 bp, Artificial Sequence
  Description of Artificial Sequence: Synthetic coding sequence
atggacctgcccagaggcctggtggtggcctgggccctgagcctgtggcccggcttcaccgacaccttcaacatggacaccagaaagcccagagtgatccccggcagcagaaccgccttcttcggctacaccgtgcagcagcacgacatcagcggcaacaagtggctggtggtgggcgcccccctggagaccaacggctaccagaagaccggcgacgtgtacaagtgccccgtgatccacggcaactgcaccaagctgaacctgggcagagtgaccctgagcaacgtgagcgagagaaaggacaacatgagactgggcctgagcctggccaccaaccccaaggacaacagcttcctggcctgcagccccctgtggagccacgagtgcggcagcagctactacaccaccggcatgtgcagcagagtgaacagcaacttcagattcagcaagaccgtggcccccgccctgcagagatgccagacctacatggacatcgtgatcgtgctggacggcagcaacagcatctacccctgggtggaggtgcagcacttcctgatcaacatcctgaagaagttctacatcggccccggccagatccaggtgggcgtggtgcagtacggcgaggacgtggtgcacgagttccacctgaacgactacagaagcgtgaaggacgtggtggaggccgccagccacatcgagcagagaggcggcaccgagaccagaaccgccttcggcatcgagttcgccagaagcgaggccttccagaagggcggcagaaagggcgccaagaaggtgatgatcgtgatcaccgacggcgagagccacgacagccccgacctggagaaggtgatccagcagagcgagagagacaacgtgaccagatacgccgtggccgtgctgggctactacaacagaagaggcatcaaccccgagaccttcctgaacgagatcaagtacatcgccagcgaccccgacgacaagcacttcttcaacgtgaccgacgaggccgccctgaaggacatcgtggacgccctgggcgacagaatcttcagcctggagggcaccaacaagaacgagaccagcttcggcctggagatgagccagaccggcttcagcagccacgtggtggaggacggcgtgctgctgggcgccgtgggcgcctacgactggaacggcgccgtgctgaaggagaccagcgccggcaaggtgatccccctgagagagagctacctgaaggagttccccgaggagctgaagaaccacggcgcctacctgggctacaccgtgaccagcgtggtgagcagcagacagggcagagtgtacgtggccggcgcccccagattcaaccacaccggcaaggtgatcctgttcaccatgcacaacaacagaagcctgaccatccaccaggccatgagaggccagcagatcggcagctacttcggcagcgagatcaccagcgtggacatcgacggcgacggcgtgaccgacgtgctgctggtgggcgcccccatgtacttcaacgagggcagagagagaggcaaggtgtacgtgtacgagctgagacagaacctgttcgtgtacaacggcaccctgaaggacagccacagctaccagaacgccagattcggcagcagcatcgccagcgtgagagacctgaaccaggacagctacaacgacgtggtggtgggcgcccccctggaggacaaccacgccggcgccatctacatcttccacggcttcagaggcagcatcctgaagacccccaagcagagaatcaccgccagcgagctggccaccggcctgcagtacttcggctgcagcatccacggccagctggacctgaacgaggacggcctgatcgacctggccgtgggcgccctgggcaacgccgtgatcctgtggacccccccccccaagtgctggagcgaggcccccgaggagaccctgagctag

SEQ ID NO: 85360 - DNA, 3546 bp, Artificial Sequence
  Description of Artificial Sequence: Synthetic coding sequence
atgggccccgagagaaccggcgccgcccccctgcccctgctgctggtgctggccctgagccagggcatcctgaactgctgcctggcctacaacgtgggcctgcccgaggccaagatcttcagcggccccagcagcgagcagttcggctacgccgtgcagcagttcatcaaccccaagggcaactggctgctggtgggcagcccctggagcggcttccccgagaacagaatgggcgacgtgtacaagtgccccgtggacctgagcaccgccacctgcgagaagctgaacctgcagaccagcaccagcatccccaacgtgaccgagatgaagaccaacatgagcctgggcctgatcctgaccagaaacatgggcaccggcggcttcctgacctgcggccccctgtgggcccagcagtgcggcaaccagtactacaccaccggcgtgtgcagcgacatcagccccgacttccagctgagcgccagcttcagccccgccacccagccctgccccagcctgatcgacgtggtggtggtgtgcgacgagagcaacagcatctacccctgggacgccgtgaagaacttcctggagaagttcgtgcagggcctggacatcggccccaccaagacccaggtgggcctgatccagtacgccaacaaccccagagtggtgttcaacctgaacacctacaagaccaaggaggagatgatcgtggccaccagccagaccagccagtacggcggcgacctgaccaacaccttcggcgccatccagtacgccagaaagtacgcctacagcgccgccagcggcggcagaagaagcgccaccaaggtgatggtggtggtgaccgacggcgagagccacgacggcagcatgctgaaggccgtgatcgaccagtgcaaccacgacaacatcctgagattcggcatcgccgtgctgggctacctgaacagaaacgccctggacaccaagaacctgatcaaggagatcaaggccatcgccagcatccccaccgagagatacttcttcaacgtgagcgacgaggccgccctgctggagaaggccggcaccctgggcgagcagatcttcagcatcgagggcaccgtgcagggcggcgacaacttccagatggagatgagccaggtgggcttcagcgccgactacagcagccagaacgacatcctgatgctgggcgccgtgggcgccttcggctggagcggcaccatcgtgcagaagaccagccacggccacctgatcttccccaagcaggccttcgaccagatcctgcaggacagaaaccacagcagctacctgggctacagcgtggccgccatcagcaccggcgagagcacccacttcgtggccggcgcccccagagccaactacaccggccagatcgtgctgtacagcgtgaacgagaacggcaacatcaccgtgatccaggcccacagaggcgaccagatcggcagctacttcggcagcgtgctgtgcagcgtggacgtggacaaggacaccatcaccgacgtgctgctggtgggcgcccccatgtacatgagcgacctgaagaaggaggagggcagagtgtacctgttcaccatcaaggagggcatcctgggccagcaccagttcctggagggccccgagggcatcgagaacaccagattcggcagcgccatcgccgccctgagcgacatcaacatggacggcttcaacgacgtgatcgtgggcagccccctggagaaccagaacagcggcgccgtgtacatctacaacggccaccagggcaccatcagaaccaagtacagccagaagatcctgggcagcgacggcgccttcagaagccacctgcagtacttcggcagaagcctggacggctacggcgacctgaacggcgacagcatcaccgacgtgagcatcggcgccttcggccaggtggtgcagctgtggagccagagcatcgccgacgtggccatcgaggccagcttcacccccgagaagatcaccctggtgaacaagaacgcccagatcatcctgaagctgtgcttcagcgccaagttcagacccaccaagcagaacaaccaggtggccatcgtgtacaacatcaccctggacgccgacggcttcagcagcagagtgaccagcagaggcctgttcaaggagaacaacgagagatgcctgcagaagaacatggtggtgaaccaggcccagagctgccccgagcacatcatctacatccaggagcccagcgacgtggtgaacagcctggacctgagagtggacatcagcctggagaaccccggcaccagccccgccctggaggcctacagcgagaccgccaaggtgttcagcatccccttccacaaggactgcggcgaggacggcctgtgcatcagcgacctggtgctggacgtgagacagatccccgccgcccaggagcagcccttcatcgtgagcaaccagaacaagagactgaccttcagcgtgaccctgaagaacaagagagagagcgcctacaacaccggcatcgtggtggacttcagcgagaacctgttcttcgccagcttcagcctgcccgtggacggcaccgaggtgacctgccaggtggccgccagccagaagagcgtggcctgcgacgtgggctaccccgccctgaagagagagcagcaggtgaccttcaccatcaacttcgacttcaacctgcagaacctgcagaaccaggccagcctgagcttccaggccctgagcgagagccaggaggagaacaaggccgacaacctggtgaacctgaagatccccctgctgtacgacgccgagatccacctgaccagaagcaccaacatcaacttctacgagatcagcagcgacggcaacgtgcccagcatcgtgcacagcttcgaggacgtgggccccaagttcatcttcagcctgaaggtgaccaccggcagcgtgcccgtgagcatggccaccgtgatcatccacatcccccagtacaccaaggagaagaaccccctgatgtacctgaccggcgtgcagaccgacaaggccggcgacatcagctgcaacgccgacatcaaccccctgaagatcggccagaccagcagcagcgtgagcttcaagagcgagaacttcagacacaccaaggagctgaactgcagaaccgccagctgcagcaacgtgacctgctggctgaaggacgtgcacatgaagggcgagtacttcgtgaacgtgaccaccagaatctggaacggcaccttcgccagcagcaccttccagaccgtgcagctgaccgccgccgccgagatcaacacctacaaccccgagatctacgtgatcgaggacaacaccgtgaccatccccctgatgatcatgaagcccgacgagaaggccgaggtgcccaccggcgtgatcatcggcagcatcatcgccggcatcctgctgctgctggccctggtggccatcctgtggaagctgggcttcttcaagagaaagtacgagaagatgaccaagaaccccgacgagatcgacgagaccaccgagctgagcagctag

SEQ ID NO: 85361 - DNA, 2448 bp, Artificial Sequence
  Description of Artificial Sequence: Synthetic coding sequence
atgggccccgagagaaccggcgccgcccccctgcccctgctgctggtgctggccctgagccagggcatcctgaactgctgcctggcctacaacgtgggcctgcccgaggccaagatcttcagcggccccagcagcgagcagttcggctacgccgtgcagcagttcatcaaccccaagggcaactggctgctggtgggcagcccctggagcggcttccccgagaacagaatgggcgacgtgtacaagtgccccgtggacctgagcaccgccacctgcgagaagctgaacctgcagaccagcaccagcatccccaacgtgaccgagatgaagaccaacatgagcctgggcctgatcctgaccagaaacatgggcaccggcggcttcctgacctgcggccccctgtgggcccagcagtgcggcaaccagtactacaccaccggcgtgtgcagcgacatcagccccgacttccagctgagcgccagcttcagccccgccacccagccctgccccagcctgatcgacgtggtggtggtgtgcgacgagagcaacagcatctacccctgggacgccgtgaagaacttcctggagaagttcgtgcagggcctggacatcggccccaccaagacccaggtgggcctgatccagtacgccaacaaccccagagtggtgttcaacctgaacacctacaagaccaaggaggagatgatcgtggccaccagccagaccagccagtacggcggcgacctgaccaacaccttcggcgccatccagtacgccagaaagtacgcctacagcgccgccagcggcggcagaagaagcgccaccaaggtgatggtggtggtgaccgacggcgagagccacgacggcagcatgctgaaggccgtgatcgaccagtgcaaccacgacaacatcctgagattcggcatcgccgtgctgggctacctgaacagaaacgccctggacaccaagaacctgatcaaggagatcaaggccatcgccagcatccccaccgagagatacttcttcaacgtgagcgacgaggccgccctgctggagaaggccggcaccctgggcgagcagatcttcagcatcgagggcaccgtgcagggcggcgacaacttccagatggagatgagccaggtgggcttcagcgccgactacagcagccagaacgacatcctgatgctgggcgccgtgggcgccttcggctggagcggcaccatcgtgcagaagaccagccacggccacctgatcttccccaagcaggccttcgaccagatcctgcaggacagaaaccacagcagctacctgggctacagcgtggccgccatcagcaccggcgagagcacccacttcgtggccggcgcccccagagccaactacaccggccagatcgtgctgtacagcgtgaacgagaacggcaacatcaccgtgatccaggcccacagaggcgaccagatcggcagctacttcggcagcgtgctgtgcagcgtggacgtggacaaggacaccatcaccgacgtgctgctggtgggcgcccccatgtacatgagcgacctgaagaaggaggagggcagagtgtacctgttcaccatcaaggagggcatcctgggccagcaccagttcctggagggccccgagggcatcgagaacaccagattcggcagcgccatcgccgccctgagcgacatcaacatggacggcttcaacgacgtgatcgtgggcagccccctggagaaccagaacagcggcgccgtgtacatctacaacggccaccagggcaccatcagaaccaagtacagccagaagatcctgggcagcgacggcgccttcagaagccacctgcagtacttcggcagaagcctggacggctacggcgacctgaacggcgacagcatcaccgacgtgagcatcggcgccttcggccaggtggtgcagctgtggagccagagcatcgccgacgtggccatcgaggccagcttcacccccgagaagatcaccctggtgaacaagaacgcccagatcatcctgaagctgtgcttcagcgccaagttcagacccaccaagcagaacaaccaggtggccatcgtgtacaacatcaccctggacgccgacggcttcagcagcagagtgaccagcagaggcctgttcaaggagaacaacgagagatgcctgcagaagaacatggtggtgaaccaggcccagagctgccccgagcacatcatctacatccaggagcccagcgacgtggtgaacagcctggacctgagagtggacatcagcctggagaaccccggcaccagccccgccctggaggcctacagcgagaccgccaaggtgttcagcatccccttccacaaggactgcggcgaggacggcctgtgcatcagcgacctggtgctggacgtgagacagatccccgccgcccagctgatgggccagaagtag

SEQ ID NO: 85362 - DNA, 1926 bp, Artificial Sequence
  Description of Artificial Sequence: Synthetic coding sequence
atgggccccgagagaaccggcgccgcccccctgcccctgctgctggtgctggccctgagccagggcatcctgaactgctgcctggcctacaacgtgggcctgcccgaggccaagatcttcagcggccccagcagcgagcagttcggctacgccgtgcagcagttcatcaaccccaagggcaactggctgctggtgggcagcccctggagcggcttccccgagaacagaatgggcgacgtgtacaagtgccccgtggacctgagcaccgccacctgcgagaagctgaacctgcagaccagcaccagcatccccaacgtgaccgagatgaagaccaacatgagcctgggcctgatcctgaccagaaacatgggcaccggcggcttcctgacctgcggccccctgtgggcccagcagtgcggcaaccagtactacaccaccggcgtgtgcagcgacatcagccccgacttccagctgagcgccagcttcagccccgccacccagccctgccccagcctgatcgacgtggtggtggtgtgcgacgagagcaacagcatctacccctgggacgccgtgaagaacttcctggagaagttcgtgcagggcctggacatcggccccaccaagacccaggtgggcctgatccagtacgccaacaaccccagagtggtgttcaacctgaacacctacaagaccaaggaggagatgatcgtggccaccagccagaccagccagtacggcggcgacctgaccaacaccttcggcgccatccagtacgccagaaagtacgcctacagcgccgccagcggcggcagaagaagcgccaccaaggtgatggtggtggtgaccgacggcgagagccacgacggcagcatgctgaaggccgtgatcgaccagtgcaaccacgacaacatcctgagattcggcatcgccgtgctgggctacctgaacagaaacgccctggacaccaagaacctgatcaaggagatcaaggccatcgccagcatccccaccgagagatacttcttcaacgtgagcgacgaggccgccctgctggagaaggccggcaccctgggcgagcagatcttcagcatcgagggcaccgtgcagggcggcgacaacttccagatggagatgagccaggtgggcttcagcgccgactacagcagccagaacgacatcctgatgctgggcgccgtgggcgccttcggctggagcggcaccatcgtgcagaagaccagccacggccacctgatcttccccaagcaggccttcgaccagatcctgcaggacagaaaccacagcagctacctgggctacagcgtggccgccatcagcaccggcgagagcacccacttcgtggccggcgcccccagagccaactacaccggccagatcgtgctgtacagcgtgaacgagaacggcaacatcaccgtgatccaggcccacagaggcgaccagatcggcagctacttcggcagcgtgctgtgcagcgtggacgtggacaaggacaccatcaccgacgtgctgctggtgggcgcccccatgtacatgagcgacctgaagaaggaggagggcagagtgtacctgttcaccatcaaggagggcatcctgggccagcaccagttcctggagggccccgagggcatcgagaacaccagattcggcagcgccatcgccgccctgagcgacatcaacatggacggcttcaacgacgtgatcgtgggcagccccctggagaaccagaacagcggcgccgtgtacatctacaacggccaccagggcaccatcagaaccaagtacagccagctgctgtgcaccatcatcagctgccagacctgcagcttcagaaagagctgggaccccatggagcccctgggcgccatcagcagcaccctgggcggcccctggatggccatggagatctag

SEQ ID NO: 85363 - DNA, 2829 bp, Artificial Sequence
  Description of Artificial Sequence: Synthetic coding sequence
atgggccccgagagaaccggcgccgcccccctgcccctgctgctggtgctggccctgagccagggcatcctgaactgctgcctggcctacaacgtgggcctgcccgaggccaagatcttcagcggccccagcagcgagcagttcggctacgccgtgcagcagttcatcaaccccaagggcaactggctgctggtgggcagcccctggagcggcttccccgagaacagaatgggcgacgtgtacaagtgccccgtggacctgagcaccgccacctgcgagaagctgaacctgcagaccagcaccagcatccccaacgtgaccgagatgaagaccaacatgagcctgggcctgatcctgaccagaaacatgggcaccggcggcttcctgacctgcggccccctgtgggcccagcagtgcggcaaccagtactacaccaccggcgtgtgcagcgacatcagccccgacttccagctgagcgccagcttcagccccgccacccagccctgccccagcctgatcgacgtggtggtggtgtgcgacgagagcaacagcatctacccctgggacgccgtgaagaacttcctggagaagttcgtgcagggcctggacatcggccccaccaagacccaggtgggcctgatccagtacgccaacaaccccagagtggtgttcaacctgaacacctacaagaccaaggaggagatgatcgtggccaccagccagaccagccagtacggcggcgacctgaccaacaccttcggcgccatccagtacgccagaaagtacgcctacagcgccgccagcggcggcagaagaagcgccaccaaggtgatggtggtggtgaccgacggcgagagccacgacggcagcatgctgaaggccgtgatcgaccagtgcaaccacgacaacatcctgagattcggcatcgccgtgctgggctacctgaacagaaacgccctggacaccaagaacctgatcaaggagatcaaggccatcgccagcatccccaccgagagatacttcttcaacgtgagcgacgaggccgccctgctggagaaggccggcaccctgggcgagcagatcttcagcatcgagggcaccgtgcagggcggcgacaacttccagatggagatgagccaggtgggcttcagcgccgactacagcagccagaacgacatcctgatgctgggcgccgtgggcgccttcggctggagcggcaccatcgtgcagaagaccagccacggccacctgatcttccccaagcaggccttcgaccagatcctgcaggacagaaaccacagcagctacctgggctacagcgtggccgccatcagcaccggcgagagcacccacttcgtggccggcgcccccagagccaactacaccggccagatcgtgctgtacagcgtgaacgagaacggcaacatcaccgtgatccaggcccacagaggcgaccagatcggcagctacttcggcagcgtgctgtgcagcgtggacgtggacaaggacaccatcaccgacgtgctgctggtgggcgcccccatgtacatgagcgacctgaagaaggaggagggcagagtgtacctgttcaccatcaaggagggcatcctgggccagcaccagttcctggagggccccgagggcatcgagaacaccagattcggcagcgccatcgccgccctgagcgacatcaacatggacggcttcaacgacgtgatcgtgggcagccccctggagaaccagaacagcggcgccgtgtacatctacaacggccaccagggcaccatcagaaccaagtacagccagaagatcctgggcagcgacggcgccttcagaagccacctgcagtacttcggcagaagcctggacggctacggcgacctgaacggcgacagcatcaccgacgtgagcatcggcgccttcggccaggtggtgcagctgtggagccagagcatcgccgacgtggccatcgaggccagcttcacccccgagaagatcaccctggtgaacaagaacgcccagatcatcctgaagctgtgcttcagcgccaagttcagacccaccaagcagaacaaccaggtggccatcgtgtacaacatcaccctggacgccgacggcttcagcagcagagtgaccagcagaggcctgttcaaggagaacaacgagagatgcctgcagaagaacatggtggtgaaccaggcccagagctgccccgagcacatcatctacatccaggagcccagcgacgtggtgaacagcctggacctgagagtggacatcagcctggagaaccccggcaccagccccgccctggaggcctacagcgagaccgccaaggtgttcagcatccccttccacaaggactgcggcgaggacggcctgtgcatcagcgacctggtgctggacgtgagacagatccccgccgcccaggagcagcccttcatcgtgagcaaccagaacaagagactgaccttcagcgtgaccctgaagaacaagagagagagcgcctacaacaccggcatcgtggtggacttcagcgagaacctgttcttcgccagcttcagcctgcccgtggacggcaccgaggtgacctgccaggtggccgccagccagaagagcgtggcctgcgacgtgggctaccccgccctgaagagagagcagcaggtgaccttcaccatcaacttcgacttcaacctgcagaacctgcagaaccaggccagcctgagcttccaggccctgagcgagagccaggaggagaacaaggccgacaacctggtgaacctgaagatccccctgctgtacgacgccgagatccacctgaccagatag

SEQ ID NO: 85364 - DNA, 3120 bp, Artificial Sequence
  Description of Artificial Sequence: Synthetic coding sequence
atggccagagccctgtgccccctgcaggccctgtggctgctggagtgggtgctgctgctgctgggcccctgcgccgccccccccgcctgggccctgaacctggaccccgtgcagctgaccttctacgccggccccaacggcagccagttcggcttcagcctggacttccacaaggacagccacggcagagtggccatcgtggtgggcgcccccagaaccctgggccccagccaggaggagaccggcggcgtgttcctgtgcccctggagagccgagggcggccagtgccccagcctgctgttcgacctgagagacgagaccagaaacgtgggcagccagaccctgcagaccttcaaggccagacagggcctgggcgccagcgtggtgagctggagcgacgtgatcgtggcctgcgccccctggcagcactggaacgtgctggagaagaccgaggaggccgagaagacccccgtgggcagctgcttcctggcccagcccgagagcggcagaagagccgagtacagcccctgcagaggcaacaccctgagcagaatctacgtggagaacgacttcagctgggacaagagatactgcgaggccggcttcagcagcgtggtgacccaggccggcgagctggtgctgggcgcccccggcggctactacttcctgggcctgctggcccaggcccccgtggccgacatcttcagcagctacagacccggcatcctgctgtggcacgtgagcagccagagcctgagcttcgacagcagcaaccccgagtacttcgacggctactggggctacagcgtggccgtgggcgagttcgacggcgacctgaacaccaccgagtacgtggtgggcgcccccacctggagctggaccctgggcgccgtggagatcctggacagctactaccagagactgcacagactgagaggcgagcagatggccagctacttcggccacagcgtggccgtgaccgacgtgaacggcgacggcagacacgacctgctggtgggcgcccccctgtacatggagagcagagccgacagaaagctggccgaggtgggcagagtgtacctgttcctgcagcccagaggcccccacgccctgggcgcccccagcctgctgctgaccggcacccagctgtacggcagattcggcagcgccatcgcccccctgggcgacctggacagagacggctacaacgacatcgccgtggccgccccctacggcggccccagcggcagaggccaggtgctggtgttcctgggccagagcgagggcctgagaagcagacccagccaggtgctggacagccccttccccaccggcagcgccttcggcttcagcctgagaggcgccgtggacatcgacgacaacggctaccccgacctgatcgtgggcgcctacggcgccaaccaggtggccgtgtacagagcccagcccgtggtgaaggccagcgtgcagctgctggtgcaggacagcctgaaccccgccgtgaagagctgcgtgctgccccagaccaagacccccgtgagctgcttcaacatccagatgtgcgtgggcgccaccggccacaacatcccccagaagctgagcctgaacgccgagctgcagctggacagacagaagcccagacagggcagaagagtgctgctgctgggcagccagcaggccggcaccaccctgaacctggacctgggcggcaagcacagccccatctgccacaccaccatggccttcctgagagacgaggccgacttcagagacaagctgagccccatcgtgctgagcctgaacgtgagcctgccccccaccgaggccggcatggcccccgccgtggtgctgcacggcgacacccacgtgcaggagcagaccagaatcgtgctggactgcggcgaggacgacgtgtgcgtgccccagctgcagctgaccgccagcgtgaccggcagccccctgctggtgggcgccgacaacgtgctggagctgcagatggacgccgccaacgagggcgagggcgcctacgaggccgagctggccgtgcacctgccccagggcgcccactacatgagagccctgagcaacgtggagggcttcgagagactgatctgcaaccagaagaaggagaacgagaccagagtggtgctgtgcgagctgggcaaccccatgaagaagaacgcccagatcggcatcgccatgctggtgagcgtgggcaacctggaggaggccggcgagagcgtgagcttccagctgcagatcagaagcaagaacagccagaaccccaacagcaagatcgtgctgctggacgtgcccgtgagagccgaggcccaggtggagctgagaggcaacagcttccccgccagcctggtggtggccgccgaggagggcgagagagagcagaacagcctggacagctggggccccaaggtggagcacacctacgagctgcacaacaacggccccggcaccgtgaacggcctgcacctgagcatccacctgcccggccagagccagcccagcgacctgctgtacatcctggacatccagccccagggcggcctgcagtgcttcccccagccccccgtgaaccccctgaaggtggactggggcctgcccatccccagccccagccccatccaccccgcccaccacaagagagacagaagacagatcttcctgcccgagcccgagcagcccagcagactgcaggaccccgtgctggtgagctgcgacagcgccccctgcaccgtggtgcagtgcgacctgcaggagatggccagaggccagagagccatggtgaccgtgctggccttcctgtggctgcccagcctgtaccagagacccctggaccagttcgtgctgcagagccacgcctggttcaacgtgagcagcctgccctacgccgtgccccccctgagcctgcccagaggcgaggcccaggtgtggacccagctgctgagagccctggaggagagagccatccccatctggtgggtgctggtgggcgtgctgggcggcctgctgctgctgaccatcctggtgctggccatgtggaaggtgggcttcttcaagagaaacagaccccccctggaggaggacgacgaggagggcgagtag

SEQ ID NO: 85365 - DNA, 3018 bp, Artificial Sequence
  Description of Artificial Sequence: Synthetic coding sequence
atggccagagccctgtgccccctgcaggccctgtggctgctggagtgggtgctgctgctgctgggcccctgcgccgccccccccgcctgggccctgaacctggaccccgtgcagctgaccttctacgccggccccaacggcagccagttcggcttcagcctggacttccacaaggacagccacggcagagtggccatcgtggtgggcgcccccagaaccctgggccccagccaggaggagaccggcggcgtgttcctgtgcccctggagagccgagggcggccagtgccccagcctgctgttcgacctgagagacgagaccagaaacgtgggcagccagaccctgcagaccttcaaggccagacagggcctgggcgccagcgtggtgagctggagcgacgtgatcgtggcctgcgccccctggcagcactggaacgtgctggagaagaccgaggaggccgagaagacccccgtgggcagctgcttcctggcccagcccgagagcggcagaagagccgagtacagcccctgcagaggcaacaccctgagcagaatctacgtggagaacgacttcagctgggacaagagatactgcgaggccggcttcagcagcgtggtgacccaggccggcgagctggtgctgggcgcccccggcggctactacttcctgggcctgctggcccaggcccccgtggccgacatcttcagcagctacagacccggcatcctgctgtggcacgtgagcagccagagcctgagcttcgacagcagcaaccccgagtacttcgacggctactggggctacagcgtggccgtgggcgagttcgacggcgacctgaacaccaccgagtacgtggtgggcgcccccacctggagctggaccctgggcgccgtggagatcctggacagctactaccagagactgcacagactgagaggcgagcagatggccagctacttcggccacagcgtggccgtgaccgacgtgaacggcgacggcagacacgacctgctggtgggcgcccccctgtacatggagagcagagccgacagaaagctggccgaggtgggcagagtgtacctgttcctgcagcccagaggcccccacgccctgggcgcccccagcctgctgctgaccggcacccagctgtacggcagattcggcagcgccatcgcccccctgggcgacctggacagagacggctacaacgacatcgccgtggccgccccctacggcggccccagcggcagaggccaggtgctggtgttcctgggccagagcgagggcctgagaagcagacccagccaggtgctggacagccccttccccaccggcagcgccttcggcttcagcctgagaggcgccgtggacatcgacgacaacggctaccccgacctgatcgtgggcgcctacggcgccaaccaggtggccgtgtacagagcccagcccgtggtgaaggccagcgtgcagctgctggtgcaggacagcctgaaccccgccgtgaagagctgcgtgctgccccagaccaagacccccgtgagctgcttcaacatccagatgtgcgtgggcgccaccggccacaacatcccccagaagctgagcctgaacgccgagctgcagctggacagacagaagcccagacagggcagaagagtgctgctgctgggcagccagcaggccggcaccaccctgaacctggacctgggcggcaagcacagccccatctgccacaccaccatggccttcctgagagacgaggccgacttcagagacaagctgagccccatcgtgctgagcctgaacgtgagcctgccccccaccgaggccggcatggcccccgccgtggtgctgcacggcgacacccacgtgcaggagcagaccagaatcgtgctggactgcggcgaggacgacgtgtgcgtgccccagctgcagctgaccgccagcgtgaccggcagccccctgctggtgggcgccgacaacgtgctggagctgcagatggacgccgccaacgagggcgagggcgcctacgaggccgagctggccgtgcacctgccccagggcgcccactacatgagagccctgagcaacgtggagggcttcgagagactgatctgcaaccagaagaaggagaacgagaccagagtggtgctgtgcgagctgggcaaccccatgaagaagaacgcccagatcggcatcgccatgctggtgagcgtgggcaacctggaggaggccggcgagagcgtgagcttccagctgcagatcagaagcaagaacagccagaaccccaacagcaagatcgtgctgctggacgtgcccgtgagagccgaggcccaggtggagctgagaggcaacagcttccccgccagcctggtggtggccgccgaggagggcgagagagagcagaacagcctggacagctggggccccaaggtggagcacacctacgagctgcacaacaacggccccggcaccgtgaacggcctgcacctgagcatccacctgcccggccagagccagcccagcgacctgctgtacatcctggacatccagccccagggcggcctgcagtgcttcccccagccccccgtgaaccccctgaaggtggactggggcctgcccatccccagccccagccccatccaccccgcccaccacaagagagacagaagacagatcttcctgcccgagcccgagcagcccagcagactgcaggaccccgtgctggtgagctgcgacagcgccccctgcaccgtggtgcagtgcgacctgcaggagatggccagaggccagagagccatggtgaccgtgctggccttcctgtggctgcccagcctgtaccaggtgtggacccagctgctgagagccctggaggagagagccatccccatctggtgggtgctggtgggcgtgctgggcggcctgctgctgctgaccatcctggtgctggccatgtggaaggtgggcttcttcaagagaaacagaccccccctggaggaggacgacgaggagggcgagtag

SEQ ID NO: 85366 - DNA, 660 bp, Artificial Sequence
  Description of Artificial Sequence: Synthetic coding sequence
atggccagctacttcggccacagcgtggccgtgaccgacgtgaacggcgacggcagacacgacctgctggtgggcgcccccctgtacatggagagcagagccgacagaaagctggccgaggtgggcagagtgtacctgttcctgcagcccagaggcccccacgccctgggcgcccccagcctgctgctgaccggcacccagctgtacggcagattcggcagcgccatcgcccccctgggcgacctggacagagacggctacaacgacatcgccgtggccgccccctacggcggccccagcggcagaggccaggtgctggtgttcctgggccagagcgagggcctgagaagcagacccagccaggtgctggacagccccttccccaccggcagcgccttcggcttcagcctgagaggcgccgtggacatcgacgacaacggctaccccggcgccctggactgcctgcagctggagatgcccaagaagggcccctggaccttcgccggcagcgccaagagacacggccagggcctgatgcccggcctggtgagccactacggcctgcccgagggcctgggcgagaccagcagcggcggcggcggcgtgggcaacccctgggaggacgagatgagaatcccctgccccaacagacagttctag

SEQ ID NO: 85367 - DNA, 3201 bp, Artificial Sequence
  Description of Artificial Sequence: Synthetic coding sequence
atgggccccggccccagcagagcccccagagcccccagactgatgctgtgcgccctggccctgatggtggccgccggcggctgcgtggtgagcgccttcaacctggacaccagattcctggtggtgaaggaggccggcaaccccggcagcctgttcggctacagcgtggccctgcacagacagaccgagagacagcagagatacctgctgctggccggcgcccccagagagctggccgtgcccgacggctacaccaacagaaccggcgccgtgtacctgtgccccctgaccgcccacaaggacgactgcgagagaatgaacatcaccgtgaagaacgaccccggccaccacatcatcgaggacatgtggctgggcgtgaccgtggccagccagggccccgccggcagagtgctggtgtgcgcccacagatacacccaggtgctgtggagcggcagcgaggaccagagaagaatggtgggcaagtgctacgtgagaggcaacgacctggagctggacagcagcgacgactggcagacctaccacaacgagatgtgcaacagcaacaccgactacctggagaccggcatgtgccagctgggcaccagcggcggcttcacccagaacaccgtgtacttcggcgcccccggcgcctacaactggaagggcaacagctacatgatccagagaaaggagtgggacctgagcgagtacagctacaaggaccccgaggaccagggcaacctgtacatcggctacaccatgcaggtgggcagcttcatcctgcaccccaagaacatcaccatcgtgaccggcgcccccagacacagacacatgggcgccgtgttcctgctgagccaggaggccggcggcgacctgagaagaagacaggtgctggagggcagccaggtgggcgcctacttcggcagcgccatcgccctggccgacctgaacaacgacggctggcaggacctgctggtgggcgccccctactacttcgagagaaaggaggaggtgggcggcgccatctacgtgttcatgaaccaggccggcaccagcttccccgcccaccccagcctgctgctgcacggccccagcggcagcgccttcggcctgagcgtggccagcatcggcgacatcaaccaggacggcttccaggacatcgccgtgggcgcccccttcgagggcctgggcaaggtgtacatctaccacagcagcagcaagggcctgctgagacagccccagcaggtgatccacggcgagaagctgggcctgcccggcctggccaccttcggctacagcctgagcggccagatggacgtggacgagaacttctaccccgacctgctggtgggcagcctgagcgaccacatcgtgctgctgagagccagacccgtgatcaacatcgtgcacaagaccctggtgcccagacccgccgtgctggaccccgccctgtgcaccgccaccagctgcgtgcaggtggagctgtgcttcgcctacaaccagagcgccggcaaccccaactacagaagaaacatcaccctggcctacaccctggaggccgacagagacagaagaccccccagactgagattcgccggcagcgagagcgccgtgttccacggcttcttcagcatgcccgagatgagatgccagaagctggagctgctgctgatggacaacctgagagacaagctgagacccatcatcatcagcatgaactacagcctgcccctgagaatgcccgacagacccagactgggcctgagaagcctggacgcctaccccatcctgaaccaggcccaggccctggagaaccacaccgaggtgcagttccagaaggagtgcggccccgacaacaagtgcgagagcaacctgcagatgagagccgccttcgtgagcgagcagcagcagaagctgagcagactgcagtacagcagagacgtgagaaagctgctgctgagcatcaacgtgaccaacaccagaaccagcgagagaagcggcgaggacgcccacgaggccctgctgaccctggtggtgccccccgccctgctgctgagcagcgtgagaccccccggcgcctgccaggccaacgagaccatcttctgcgagctgggcaaccccttcaagagaaaccagagaatggagctgctgatcgccttcgaggtgatcggcgtgaccctgcacaccagagacctgcaggtgcagctgcagctgagcaccagcagccaccaggacaacctgtggcccatgatcctgaccctgctggtggactacaccctgcagaccagcctgagcatggtgaaccacagactgcagagcttcttcggcggcaccgtgatgggcgagagcggcatgaagaccgtggaggacgtgggcagccccctgaagtacgagttccaggtgggccccatgggcgagggcctggtgggcctgggcaccctggtgctgggcctggagtggccctacgaggtgagcaacggcaagtggctgctgtaccccaccgagatcaccgtgcacggcaacggcagctggccctgcagaccccccggcgacctgatcaaccccctgaacctgaccctgagcgaccccggcgacagacccagcagcccccagagaagaagaagacagctggaccccggcggcggccagggccccccccccgtgaccctggccgccgccaagaaggccaagagcgagaccgtgctgacctgcgccaccggcagagcccactgcgtgtggctggagtgccccatccccgacgcccccgtggtgaccaacgtgaccgtgaaggccagagtgtggaacagcaccttcatcgaggactacagagacttcgacagagtgagagtgaacggctgggccaccctgttcctgagaaccagcatccccaccatcaacatggagaacaagaccacctggttcagcgtggacatcgacagcgagctggtggaggagctgcccgccgagatcgagctgtggctggtgctggtggccgtgggcgccggcctgctgctgctgggcctgatcatcctgctgctgtggaagtgcgacttcttcaagagaaccagatactaccagatcatgcccaagtaccacgccgtgagaatcagagaggaggagagataccccccccccggcagcaccctgcccaccaagaagcactgggtgaccagctggcagaccagagaccagtactactag

SEQ ID NO: 85368 - DNA, 3156 bp, Artificial Sequence
  Description of Artificial Sequence: Synthetic coding sequence
atgggccccggccccagcagagcccccagagcccccagactgatgctgtgcgccctggccctgatggtggccgccggcggctgcgtggtgagcgccttcaacctggacaccagattcctggtggtgaaggaggccggcaaccccggcagcctgttcggctacagcgtggccctgcacagacagaccgagagacagcagagatacctgctgctggccggcgcccccagagagctggccgtgcccgacggctacaccaacagaaccggcgccgtgtacctgtgccccctgaccgcccacaaggacgactgcgagagaatgaacatcaccgtgaagaacgaccccggccaccacatcatcgaggacatgtggctgggcgtgaccgtggccagccagggccccgccggcagagtgctggtgtgcgcccacagatacacccaggtgctgtggagcggcagcgaggaccagagaagaatggtgggcaagtgctacgtgagaggcaacgacctggagctggacagcagcgacgactggcagacctaccacaacgagatgtgcaacagcaacaccgactacctggagaccggcatgtgccagctgggcaccagcggcggcttcacccagaacaccgtgtacttcggcgcccccggcgcctacaactggaagggcaacagctacatgatccagagaaaggagtgggacctgagcgagtacagctacaaggaccccgaggaccagggcaacctgtacatcggctacaccatgcaggtgggcagcttcatcctgcaccccaagaacatcaccatcgtgaccggcgcccccagacacagacacatgggcgccgtgttcctgctgagccaggaggccggcggcgacctgagaagaagacaggtgctggagggcagccaggtgggcgcctacttcggcagcgccatcgccctggccgacctgaacaacgacggctggcaggacctgctggtgggcgccccctactacttcgagagaaaggaggaggtgggcggcgccatctacgtgttcatgaaccaggccggcaccagcttccccgcccaccccagcctgctgctgcacggccccagcggcagcgccttcggcctgagcgtggccagcatcggcgacatcaaccaggacggcttccaggacatcgccgtgggcgcccccttcgagggcctgggcaaggtgtacatctaccacagcagcagcaagggcctgctgagacagccccagcaggtgatccacggcgagaagctgggcctgcccggcctggccaccttcggctacagcctgagcggccagatggacgtggacgagaacttctaccccgacctgctggtgggcagcctgagcgaccacatcgtgctgctgagagccagacccgtgatcaacatcgtgcacaagaccctggtgcccagacccgccgtgctggaccccgccctgtgcaccgccaccagctgcgtgcaggtggagctgtgcttcgcctacaaccagagcgccggcaaccccaactacagaagaaacatcaccctggcctacaccctggaggccgacagagacagaagaccccccagactgagattcgccggcagcgagagcgccgtgttccacggcttcttcagcatgcccgagatgagatgccagaagctggagctgctgctgatggacaacctgagagacaagctgagacccatcatcatcagcatgaactacagcctgcccctgagaatgcccgacagacccagactgggcctgagaagcctggacgcctaccccatcctgaaccaggcccaggccctggagaaccacaccgaggtgcagttccagaaggagtgcggccccgacaacaagtgcgagagcaacctgcagatgagagccgccttcgtgagcgagcagcagcagaagctgagcagactgcagtacagcagagacgtgagaaagctgctgctgagcatcaacgtgaccaacaccagaaccagcgagagaagcggcgaggacgcccacgaggccctgctgaccctggtggtgccccccgccctgctgctgagcagcgtgagaccccccggcgcctgccaggccaacgagaccatcttctgcgagctgggcaaccccttcaagagaaaccagagaatggagctgctgatcgccttcgaggtgatcggcgtgaccctgcacaccagagacctgcaggtgcagctgcagctgagcaccagcagccaccaggacaacctgtggcccatgatcctgaccctgctggtggactacaccctgcagaccagcctgagcatggtgaaccacagactgcagagcttcttcggcggcaccgtgatgggcgagagcggcatgaagaccgtggaggacgtgggcagccccctgaagtacgagttccaggtgggccccatgggcgagggcctggtgggcctgggcaccctggtgctgggcctggagtggccctacgaggtgagcaacggcaagtggctgctgtaccccaccgagatcaccgtgcacggcaacggcagctggccctgcagaccccccggcgacctgatcaaccccctgaacctgaccctgagcgaccccggcgacagacccagcagcccccagagaagaagaagacagctggaccccggcggcggccagggccccccccccgtgaccctggccgccgccaagaaggccaagagcgagaccgtgctgacctgcgccaccggcagagcccactgcgtgtggctggagtgccccatccccgacgcccccgtggtgaccaacgtgaccgtgaaggccagagtgtggaacagcaccttcatcgaggactacagagacttcgacagagtgagagtgaacggctgggccaccctgttcctgagaaccagcatccccaccatcaacatggagaacaagaccacctggttcagcgtggacatcgacagcgagctggtggaggagctgcccgccgagatcgagctgtggctggtgctggtggccgtgggcgccggcctgctgctgctgggcctgatcatcctgctgctgtggaagtgcggcttcttcaagagagccagaaccagagccctgtacgaggccaagagacagaaggccgagatgaagagccagcccagcgagaccgagagactgaccgacgactactag

SEQ ID NO: 85369 - DNA, 3114 bp, Artificial Sequence
  Description of Artificial Sequence: Synthetic coding sequence
atgctgtgcgccctggccctgatggtggccgccggcggctgcgtggtgagcgccttcaacctggacaccagattcctggtggtgaaggaggccggcaaccccggcagcctgttcggctacagcgtggccctgcacagacagaccgagagacagcagagatacctgctgctggccggcgcccccagagagctggccgtgcccgacggctacaccaacagaaccggcgccgtgtacctgtgccccctgaccgcccacaaggacgactgcgagagaatgaacatcaccgtgaagaacgaccccggccaccacatcatcgaggacatgtggctgggcgtgaccgtggccagccagggccccgccggcagagtgctggtgtgcgcccacagatacacccaggtgctgtggagcggcagcgaggaccagagaagaatggtgggcaagtgctacgtgagaggcaacgacctggagctggacagcagcgacgactggcagacctaccacaacgagatgtgcaacagcaacaccgactacctggagaccggcatgtgccagctgggcaccagcggcggcttcacccagaacaccgtgtacttcggcgcccccggcgcctacaactggaagggcaacagctacatgatccagagaaaggagtgggacctgagcgagtacagctacaaggaccccgaggaccagggcaacctgtacatcggctacaccatgcaggtgggcagcttcatcctgcaccccaagaacatcaccatcgtgaccggcgcccccagacacagacacatgggcgccgtgttcctgctgagccaggaggccggcggcgacctgagaagaagacaggtgctggagggcagccaggtgggcgcctacttcggcagcgccatcgccctggccgacctgaacaacgacggctggcaggacctgctggtgggcgccccctactacttcgagagaaaggaggaggtgggcggcgccatctacgtgttcatgaaccaggccggcaccagcttccccgcccaccccagcctgctgctgcacggccccagcggcagcgccttcggcctgagcgtggccagcatcggcgacatcaaccaggacggcttccaggacatcgccgtgggcgcccccttcgagggcctgggcaaggtgtacatctaccacagcagcagcaagggcctgctgagacagccccagcaggtgatccacggcgagaagctgggcctgcccggcctggccaccttcggctacagcctgagcggccagatggacgtggacgagaacttctaccccgacctgctggtgggcagcctgagcgaccacatcgtgctgctgagagccagacccgtgatcaacatcgtgcacaagaccctggtgcccagacccgccgtgctggaccccgccctgtgcaccgccaccagctgcgtgcaggtggagctgtgcttcgcctacaaccagagcgccggcaaccccaactacagaagaaacatcaccctggcctacaccctggaggccgacagagacagaagaccccccagactgagattcgccggcagcgagagcgccgtgttccacggcttcttcagcatgcccgagatgagatgccagaagctggagctgctgctgatggacaacctgagagacaagctgagacccatcatcatcagcatgaactacagcctgcccctgagaatgcccgacagacccagactgggcctgagaagcctggacgcctaccccatcctgaaccaggcccaggccctggagaaccacaccgaggtgcagttccagaaggagtgcggccccgacaacaagtgcgagagcaacctgcagatgagagccgccttcgtgagcgagcagcagcagaagctgagcagactgcagtacagcagagacgtgagaaagctgctgctgagcatcaacgtgaccaacaccagaaccagcgagagaagcggcgaggacgcccacgaggccctgctgaccctggtggtgccccccgccctgctgctgagcagcgtgagaccccccggcgcctgccaggccaacgagaccatcttctgcgagctgggcaaccccttcaagagaaaccagagaatggagctgctgatcgccttcgaggtgatcggcgtgaccctgcacaccagagacctgcaggtgcagctgcagctgagcaccagcagccaccaggacaacctgtggcccatgatcctgaccctgctggtggactacaccctgcagaccagcctgagcatggtgaaccacagactgcagagcttcttcggcggcaccgtgatgggcgagagcggcatgaagaccgtggaggacgtgggcagccccctgaagtacgagttccaggtgggccccatgggcgagggcctggtgggcctgggcaccctggtgctgggcctggagtggccctacgaggtgagcaacggcaagtggctgctgtaccccaccgagatcaccgtgcacggcaacggcagctggccctgcagaccccccggcgacctgatcaaccccctgaacctgaccctgagcgaccccggcgacagacccagcagcccccagagaagaagaagacagctggaccccggcggcggccagggccccccccccgtgaccctggccgccgccaagaaggccaagagcgagaccgtgctgacctgcgccaccggcagagcccactgcgtgtggctggagtgccccatccccgacgcccccgtggtgaccaacgtgaccgtgaaggccagagtgtggaacagcaccttcatcgaggactacagagacttcgacagagtgagagtgaacggctgggccaccctgttcctgagaaccagcatccccaccatcaacatggagaacaagaccacctggttcagcgtggacatcgacagcgagctggtggaggagctgcccgccgagatcgagctgtggctggtgctggtggccgtgggcgccggcctgctgctgctgggcctgatcatcctgctgctgtggaagtgcggcttcttcaagagagccagaaccagagccctgtacgaggccaagagacagaaggccgagatgaagagccagcccagcgagaccgagagactgaccgacgactactag

SEQ ID NO: 85370 - DNA, 885 bp, Artificial Sequence
  Description of Artificial Sequence: Synthetic coding sequence
atgatccagagaaaggagtgggacctgagcgagtacagctacaaggaccccgaggaccagggcaacctgtacatcggctacaccatgcaggtgggcagcttcatcctgcaccccaagaacatcaccatcgtgaccggcgcccccagacacagacacatgggcgccgtgttcctgctgagccaggaggccggcggcgacctgagaagaagacaggtgctggagggcagccaggtgggcgcctacttcggcagcgccatcgccctggccgacctgaacaacgacggctggcaggacctgctggtgggcgccccctactacttcgagagaaaggaggaggtgggcggcgccatctacgtgttcatgaaccaggccggcaccagcttccccgcccaccccagcctgctgctgcacggccccagcggcagcgccttcggcctgagcgtggccagcatcggcgacatcaaccaggacggcttccaggacatcgccgtgggcgcccccttcgagggcctgggcaaggtgtacatctaccacagcagcagcaagggcctgctgagacagccccagcaggtgatccacggcgagaagctgggcctgcccggcctggccaccttcggctacagcctgagcggccagatggacgtggacgagaacttctaccccgacctgctggtgggcagcctgagcgaccacatcgtgctgctgagagccagacccgtgatcaacatcgtgcacaagaccctggtgcccagacccgccgtgctggaccccgccctgtgcaccgccaccagctgcgtgcaggtggagctgtgcttcgcctacaaccagagcgccggcaaccccaactacagaagaaacatcagcgagtgctggggcgccgcctag

SEQ ID NO: 85371 - DNA, 3108 bp, Artificial Sequence
  Description of Artificial Sequence: Synthetic coding sequence
atgggcggccccgccgcccccagaggcgccggcagactgagagccctgctgctggccctggtggtggccggcatccccgccggcgcctacaacctggacccccagagacccgtgcacttccagggccccgccgacagcttcttcggctacgccgtgctggagcacttccacgacaacaccagatgggtgctggtgggcgcccccaaggccgacagcaagtacagccccagcgtgaagagccccggcgccgtgttcaagtgcagagtgcacaccaaccccgacagaagatgcaccgagctggacatggccagaggcaagaacagaggcaccagctgcggcaagacctgcagagaggacagagacgacgagtggatgggcgtgagcctggccagacagcccaaggccgacggcagagtgctggcctgcgcccacagatggaagaacatctactacgaggccgaccacatcctgccccacggcttctgctacatcatccccagcaacctgcaggccaagggcagaaccctgatcccctgctacgaggagtacaagaagaagtacggcgaggagcacggcagctgccaggccggcatcgccggcttcttcaccgaggagctggtggtgatgggcgcccccggcagcttctactgggccggcaccatcaaggtgctgaacctgaccgacaacacctacctgaagctgaacgacgaggtgatcatgaacagaagatacacctacctgggctacgccgtgaccgccggccacttcagccaccccagcaccatcgacgtggtgggcggcgccccccaggacaagggcatcggcaaggtgtacatcttcagagccgacagaagaagcggcaccctgatcaagatcttccaggccagcggcaagaagatgggcagctacttcggcagcagcctgtgcgccgtggacctgaacggcgacggcctgagcgacctgctggtgggcgcccccatgttcagcgagatcagagacgagggccaggtgaccgtgtacatcaacagaggcaacggcgccctggaggagcagctggccctgaccggcgacggcgcctacaacgcccacttcggcgagagcatcgccagcctggacgacctggacaacgacggcttccccgacgtggccatcggcgcccccaaggaggacgacttcgccggcgccgtgtacatctaccacggcgacgccggcggcatcgtgccccagtacagcatgaagctgagcggccagaagatcaaccccgtgctgagaatgttcggccagagcatcagcggcggcatcgacatggacggcaacggctaccccgacgtgaccgtgggcgccttcatgagcgacagcgtggtgctgctgagagccagacccgtgatcaccgtggacgtgagcatcttcctgcccggcagcatcaacatcaccgccccccagtgccacgacggccagcagcccgtgaactgcctgaacgtgaccacctgcttcagcttccacggcaagcacgtgcccggcgagatcggcctgaactacgtgctgatggccgacgtggccaagaaggagaagggccagatgcccagagtgtacttcgtgctgctgggcgagaccatgggccaggtgaccgagaagctgcagctgacctacatggaggagacctgcagacactacgtggcccacgtgaagagaagagtgcaggacgtgatcagccccatcgtgttcgaggccgcctacagcctgagcgagcacgtgaccggcgaggaggagagagagctgccccccctgacccccgtgctgagatggaagaagggccagaagatcgcccagaagaaccagaccgtgttcgagagaaactgcagaagcgaggactgcgccgccgacctgcagctgcagggcaagctgctgctgagcagcatggacgagaagaccctgtacctggccctgggcgccgtgaagaacatcagcctgaacatcagcatcagcaacctgggcgacgacgcctacgacgccaacgtgagcttcaacgtgagcagagagctgttcttcatcaacatgtggcagaaggaggagatgggcatcagctgcgagctgctggagagcgacttcctgaagtgcagcgtgggcttccccttcatgagaagcaagagcaagtacgagttcagcgtgatcttcgacaccagccacctgagcggcgaggaggaggtgctgagcttcatcgtgaccgcccagagcggcaacaccgagagaagcgagagcctgcacgacaacaccctggtgctgatggtgcccctgatgcacgaggtggacaccagcatcaccggcatcatgagccccaccagcttcgtgtacggcgagagcgtggacgccgccaacttcatccagctggacgacctggagtgccacttccagcccatcaacatcaccctgcaggtgtacaacaccggccccagcaccctgcccggcagcagcgtgagcatcagcttccccaacagactgagcagcggcggcgccgagatgttccacgtgcaggagatggtggtgggccaggagaagggcaactgcagcttccagaagaaccccaccccctgcatcatcccccaggagcaggagaacatcttccacaccatcttcgccttcttcaccaagagcggcagaaaggtgctggactgcgagaagcccggcatcagctgcctgaccgcccactgcaacttcagcgccctggccaaggaggagagcagaaccatcgacatctacatgctgctgaacaccgagatcctgaagaaggacagcagcagcgtgatccagttcatgagcagagccaaggtgaaggtggaccccgccctgagagtggtggagatcgcccacggcaaccccgaggaggtgaccgtggtgttcgaggccctgcacaacctggagcccagaggctacgtggtgggctggatcatcgccatcagcctgctggtgggcatcctgatcttcctgctgctggccgtgctgctgtggaagatgggcttcttcagaagaagatacaaggagatcatcgaggccgagaagaacagaaaggagaacgaggacagctgggactgggtgcagaagaaccagtag

SEQ ID NO: 85372 - DNA, 696 bp, Artificial Sequence
  Description of Artificial Sequence: Synthetic coding sequence
atgtgccagcccccccccaccgcccccggcagctggcccgtggccagaccctgcaccgagagcgtgggcagaacccacacccagagagtgcccgccagctgctgggccagagccggcagaagcagcagacagagccccacccccagacagttcgccctgatgcagtacagcaacctgctgaagatccacttcaccttcacccagttcagaaccagccccagccagcagagcctggtggaccccatcgtgcagctgaagggcctgaccttcaccgccaccggcatcctgaccgtggtgacccagctgttccaccacaagaacggcgccagaaagagcgccaagaagatcctgatcgtgatcaccgacggccagaagtacaaggaccccctggagtacagcgacgtgatcccccaggccgagaaggccggcatcatcagatacgccatcggcgtgagactgttcttcacccccgcccccggcagcgcctgcatcagcttcagatgcagcgccgccggcctgatcctgctgggctgcctgagcgccgccggcggcaccagattccccggcacccactgccaggccggcgccgagtaccaccagctgagcgccagcgccggccccagagtgcagggcggccagctgtgcagcccctggcagcaccccgaggccgccgccggcgaggacctgtgcagctag

SEQ ID NO: 85373 - DNA, 3486 bp, Artificial Sequence
  Description of Artificial Sequence: Synthetic coding sequence
atgaccttcggcaccgtgctgctgctgagcgtgctggccagctaccacggcttcaacctggacgtggaggagcccaccatcttccaggaggacgccggcggcttcggccagagcgtggtgcagttcggcggcagcagactggtggtgggcgcccccctggaggtggtggccgccaaccagaccggcagactgtacgactgcgccgccgccaccggcatgtgccagcccatccccctgcacatcagacccgaggccgtgaacatgagcctgggcctgaccctggccgccagcaccaacggcagcagactgctggcctgcggccccaccctgcacagagtgtgcggcgagaacagctacagcaagggcagctgcctgctgctgggcagcagatgggagatcatccagaccgtgcccgacgccacccccgagtgcccccaccaggagatggacatcgtgttcctgatcgacggcagcggcagcatcgaccagaacgacttcaaccagatgaagggcttcgtgcaggccgtgatgggccagttcgagggcaccgacaccctgttcgccctgatgcagtacagcaacctgctgaagatccacttcaccttcacccagttcagaaccagccccagccagcagagcctggtggaccccatcgtgcagctgaagggcctgaccttcaccgccaccggcatcctgaccgtggtgacccagctgttccaccacaagaacggcgccagaaagagcgccaagaagatcctgatcgtgatcaccgacggccagaagtacaaggaccccctggagtacagcgacgtgatcccccaggccgagaaggccggcatcatcagatacgccatcggcgtgggccacgccttccagggccccaccgccagacaggagctgaacaccatcagcagcgcccccccccaggaccacgtgttcaaggtggacaacttcgccgccctgggcagcatccagaagcagctgcaggagaagatctacgccgtggagggcacccagagcagagccagcagcagcttccagcacgagatgagccaggagggcttcagcaccgccctgaccatggacggcctgttcctgggcgccgtgggcagcttcagctggagcggcggcgccttcctgtacccccccaacatgagccccaccttcatcaacatgagccaggagaacgtggacatgagagacagctacctgggctacagcaccgagctggccctgtggaagggcgtgcagaacctggtgctgggcgcccccagataccagcacaccggcaaggccgtgatcttcacccaggtgagcagacagtggagaaagaaggccgaggtgaccggcacccagatcggcagctacttcggcgccagcctgtgcagcgtggacgtggacagcgacggcagcaccgacctgatcctgatcggcgccccccactactacgagcagaccagaggcggccaggtgagcgtgtgccccctgcccagaggcagagtgcagtggcagtgcgacgccgtgctgagaggcgagcagggccacccctggggcagattcggcgccgccctgaccgtgctgggcgacgtgaacgaggacaagctgatcgacgtggccatcggcgcccccggcgagcaggagaacagaggcgccgtgtacctgttccacggcgccagcgagagcggcatcagccccagccacagccagagaatcgccagcagccagctgagccccagactgcagtacttcggccaggccctgagcggcggccaggacctgacccaggacggcctgatggacctggccgtgggcgccagaggccaggtgctgctgctgagaagcctgcccgtgctgaaggtgggcgtggccatgagattcagccccgtggaggtggccaaggccgtgtacagatgctgggaggagaagcccagcgccctggaggccggcgacgccaccgtgtgcctgaccatccagaagagcagcctggaccagctgggcgacatccagagcagcgtgagattcgacctggccctggaccccggcagactgaccagcagagccatcttcaacgagaccaagaaccccaccctgaccagaagaaagaccctgggcctgggcatccactgcgagaccctgaagctgctgctgcccgactgcgtggaggacgtggtgagccccatcatcctgcacctgaacttcagcctggtgagagagcccatccccagcccccagaacctgagacccgtgctggccgtgggcagccaggacctgttcaccgccagcctgcccttcgagaagaactgcggccaggacggcctgtgcgagggcgacctgggcgtgaccctgagcttcagcggcctgcagaccctgaccgtgggcagcagcctggagctgaacgtgatcgtgaccgtgtggaacgccggcgaggacagctacggcaccgtggtgagcctgtactaccccgccggcctgagccacagaagagtgagcggcgcccagaagcagccccaccagagcgccctgagactggcctgcgagaccgtgcccaccgaggacgagggcctgagaagcagcagatgcagcgtgaaccaccccatcttccacgagggcagcaacggcaccttcatcgtgaccttcgacgtgagctacaaggccaccctgggcgacagaatgctgatgagagccagcgccagcagcgagaacaacaaggccagcagcagcaaggccaccttccagctggagctgcccgtgaagtacgccgtgtacaccatgatcagcagacaggaggagagcaccaagtacttcaacttcgccaccagcgacgagaagaagatgaaggaggccgagcacagatacagagtgaacaacctgagccagagagacctggccatcagcatcaacttctgggtgcccgtgctgctgaacggcgtggccgtgtgggacgtggtgatggaggcccccagccagagcctgccctgcgtgagcgagagaaagcccccccagcacagcgacttcctgacccagatcagcagaagccccatgctggactgcagcatcgccgactgcctgcagttcagatgcgacgtgcccagcttcagcgtgcaggaggagctggacttcaccctgaagggcaacctgagcttcggctgggtgagagagaccctgcagaagaaggtgctggtggtgagcgtggccgagatcaccttcgacaccagcgtgtacagccagctgcccggccaggaggccttcatgagagcccagatggagatggtgctggaggaggacgaggtgtacaacgccatccccatcatcatgggcagcagcgtgggcgccctgctgctgctggccctgatcaccgccaccctgtacaagctgggcttcttcaagagacactacaaggagatgctggaggacaagcccgaggacaccgccaccttcagcggcgacgacttcagctgcgtggcccccaacgtgcccctgagctag

SEQ ID NO: 85374 - DNA, 3534 bp, Artificial Sequence
  Description of Artificial Sequence: Synthetic coding sequence
tgcgccctgagccccaccttccacttccccagcaccagatgcagcggcatgaccttcggcaccgtgctgctgctgagcgtgctggccagctaccacggcttcaacctggacgtggaggagcccaccatcttccaggaggacgccggcggcttcggccagagcgtggtgcagttcggcggcagcagactggtggtgggcgcccccctggaggtggtggccgccaaccagaccggcagactgtacgactgcgccgccgccaccggcatgtgccagcccatccccctgcacatcagacccgaggccgtgaacatgagcctgggcctgaccctggccgccagcaccaacggcagcagactgctggcctgcggccccaccctgcacagagtgtgcggcgagaacagctacagcaagggcagctgcctgctgctgggcagcagatgggagatcatccagaccgtgcccgacgccacccccgagtgcccccaccaggagatggacatcgtgttcctgatcgacggcagcggcagcatcgaccagaacgacttcaaccagatgaagggcttcgtgcaggccgtgatgggccagttcgagggcaccgacaccctgttcgccctgatgcagtacagcaacctgctgaagatccacttcaccttcacccagttcagaaccagccccagccagcagagcctggtggaccccatcgtgcagctgaagggcctgaccttcaccgccaccggcatcctgaccgtggtgacccagctgttccaccacaagaacggcgccagaaagagcgccaagaagatcctgatcgtgatcaccgacggccagaagtacaaggaccccctggagtacagcgacgtgatcccccaggccgagaaggccggcatcatcagatacgccatcggcgtgggccacgccttccagggccccaccgccagacaggagctgaacaccatcagcagcgcccccccccaggaccacgtgttcaaggtggacaacttcgccgccctgggcagcatccagaagcagctgcaggagaagatctacgccgtggagggcacccagagcagagccagcagcagcttccagcacgagatgagccaggagggcttcagcaccgccctgaccatggacggcctgttcctgggcgccgtgggcagcttcagctggagcggcggcgccttcctgtacccccccaacatgagccccaccttcatcaacatgagccaggagaacgtggacatgagagacagctacctgggctacagcaccgagctggccctgtggaagggcgtgcagaacctggtgctgggcgcccccagataccagcacaccggcaaggccgtgatcttcacccaggtgagcagacagtggagaaagaaggccgaggtgaccggcacccagatcggcagctacttcggcgccagcctgtgcagcgtggacgtggacagcgacggcagcaccgacctgatcctgatcggcgccccccactactacgagcagaccagaggcggccaggtgagcgtgtgccccctgcccagaggcagagtgcagtggcagtgcgacgccgtgctgagaggcgagcagggccacccctggggcagattcggcgccgccctgaccgtgctgggcgacgtgaacgaggacaagctgatcgacgtggccatcggcgcccccggcgagcaggagaacagaggcgccgtgtacctgttccacggcgccagcgagagcggcatcagccccagccacagccagagaatcgccagcagccagctgagccccagactgcagtacttcggccaggccctgagcggcggccaggacctgacccaggacggcctgatggacctggccgtgggcgccagaggccaggtgctgctgctgagaagcctgcccgtgctgaaggtgggcgtggccatgagattcagccccgtggaggtggccaaggccgtgtacagatgctgggaggagaagcccagcgccctggaggccggcgacgccaccgtgtgcctgaccatccagaagagcagcctggaccagctgggcgacatccagagcagcgtgagattcgacctggccctggaccccggcagactgaccagcagagccatcttcaacgagaccaagaaccccaccctgaccagaagaaagaccctgggcctgggcatccactgcgagaccctgaagctgctgctgcccgactgcgtggaggacgtggtgagccccatcatcctgcacctgaacttcagcctggtgagagagcccatccccagcccccagaacctgagacccgtgctggccgtgggcagccaggacctgttcaccgccagcctgcccttcgagaagaactgcggccaggacggcctgtgcgagggcgacctgggcgtgaccctgagcttcagcggcctgcagaccctgaccgtgggcagcagcctggagctgaacgtgatcgtgaccgtgtggaacgccggcgaggacagctacggcaccgtggtgagcctgtactaccccgccggcctgagccacagaagagtgagcggcgcccagaagcagccccaccagagcgccctgagactggcctgcgagaccgtgcccaccgaggacgagggcctgagaagcagcagatgcagcgtgaaccaccccatcttccacgagggcagcaacggcaccttcatcgtgaccttcgacgtgagctacaaggccaccctgggcgacagaatgctgatgagagccagcgccagcagcgagaacaacaaggccagcagcagcaaggccaccttccagctggagctgcccgtgaagtacgccgtgtacaccatgatcagcagacaggaggagagcaccaagtacttcaacttcgccaccagcgacgagaagaagatgaaggaggccgagcacagatacagagtgaacaacctgagccagagagacctggccatcagcatcaacttctgggtgcccgtgctgctgaacggcgtggccgtgtgggacgtggtgatggaggcccccagccagagcctgccctgcgtgagcgagagaaagcccccccagcacagcgacttcctgacccagatcagcagaagccccatgctggactgcagcatcgccgactgcctgcagttcagatgcgacgtgcccagcttcagcgtgcaggaggagctggacttcaccctgaagggcaacctgagcttcggctgggtgagagagaccctgcagaagaaggtgctggtggtgagcgtggccgagatcaccttcgacaccagcgtgtacagccagctgcccggccaggaggccttcatgagagcccagatggagatggtgctggaggaggacgaggtgtacaacgccatccccatcatcatgggcagcagcgtgggcgccctgctgctgctggccctgatcaccgccaccctgtacaagctgggcttcttcaagagacactacaaggagatgctggaggacaagcccgaggacaccgccaccttcagcggcgacgacttcagctgcgtggcccccaacgtgcccctgagctag

SEQ ID NO: 85375 - DNA, 3513 bp, Artificial Sequence
  Description of Artificial Sequence: Synthetic coding sequence
atgaaggacagctgcatcaccgtgatggccatggccctgctgagcggcttcttcttcttcgcccccgccagcagctacaacctggacgtgagaggcgccagaagcttcagcccccccagagccggcagacacttcggctacagagtgctgcaggtgggcaacggcgtgatcgtgggcgcccccggcgagggcaacagcaccggcagcctgtaccagtgccagagcggcaccggccactgcctgcccgtgaccctgagaggcagcaactacaccagcaagtacctgggcatgaccctggccaccgaccccaccgacggcagcatcctggcctgcgaccccggcctgagcagaacctgcgaccagaacacctacctgagcggcctgtgctacctgttcagacagaacctgcagggccccatgctgcagggcagacccggcttccaggagtgcatcaagggcaacgtggacctggtgttcctgttcgacggcagcatgagcctgcagcccgacgagttccagaagatcctggacttcatgaaggacgtgatgaagaagctgagcaacaccagctaccagttcgccgccgtgcagttcagcaccagctacaagaccgagttcgacttcagcgactacgtgaagagaaaggaccccgacgccctgctgaagcacgtgaagcacatgctgctgctgaccaacaccttcggcgccatcaactacgtggccaccgaggtgttcagagaggagctgggcgccagacccgacgccaccaaggtgctgatcatcatcaccgacggcgaggccaccgacagcggcaacatcgacgccgccaaggacatcatcagatacatcatcggcatcggcaagcacttccagaccaaggagagccaggagaccctgcacaagttcgccagcaagcccgccagcgagttcgtgaagatcctggacaccttcgagaagctgaaggacctgttcaccgagctgcagaagaagatctacgtgatcgagggcaccagcaagcaggacctgaccagcttcaacatggagctgagcagcagcggcatcagcgccgacctgagcagaggccacgccgtggtgggcgccgtgggcgccaaggactgggccggcggcttcctggacctgaaggccgacctgcaggacgacaccttcatcggcaacgagcccctgacccccgaggtgagagccggctacctgggctacaccgtgacctggctgcccagcagacagaagaccagcctgctggccagcggcgcccccagataccagcacatgggcagagtgctgctgttccaggagccccagggcggcggccactggagccaggtgcagaccatccacggcacccagatcggcagctacttcggcggcgagctgtgcggcgtggacgtggaccaggacggcgagaccgagctgctgctgatcggcgcccccctgttctacggcgagcagagaggcggcagagtgttcatctaccagagaagacagctgggcttcgaggaggtgagcgagctgcagggcgaccccggctaccccctgggcagattcggcgaggccatcaccgccctgaccgacatcaacggcgacggcctggtggacgtggccgtgggcgcccccctggaggagcagggcgccgtgtacatcttcaacggcagacacggcggcctgagcccccagcccagccagagaatcgagggcacccaggtgctgagcggcatccagtggttcggcagaagcatccacggcgtgaaggacctggagggcgacggcctggccgacgtggccgtgggcgccgagagccagatgatcgtgctgagcagcagacccgtggtggacatggtgaccctgatgagcttcagccccgccgagatccccgtgcacgaggtggagtgcagctacagcaccagcaacaagatgaaggagggcgtgaacatcaccatctgcttccagatcaagagcctgatcccccagttccagggcagactggtggccaacctgacctacaccctgcagctggacggccacagaaccagaagaagaggcctgttccccggcggcagacacgagctgagaagaaacatcgccgtgaccaccagcatgagctgcaccgacttcagcttccacttccccgtgtgcgtgcaggacctgatcagccccatcaacgtgagcctgaacttcagcctgtgggaggaggagggcacccccagagaccagagagcccagggcaaggacatcccccccatcctgagacccagcctgcacagcgagacctgggagatccccttcgagaagaactgcggcgaggacaagaagtgcgaggccaacctgagagtgagcttcagccccgccagaagcagagccctgagactgaccgccttcgccagcctgagcgtggagctgagcctgagcaacctggaggaggacgcctactgggtgcagctggacctgcacttcccccccggcctgagcttcagaaaggtggagatgctgaagccccacagccagatccccgtgagctgcgaggagctgcccgaggagagcagactgctgagcagagccctgagctgcaacgtgagcagccccatcttcaaggccggccacagcgtggccctgcagatgatgttcaacaccctggtgaacagcagctggggcgacagcgtggagctgcacgccaacgtgacctgcaacaacgaggacagcgacctgctggaggacaacagcgccaccaccatcatccccatcctgtaccccatcaacatcctgatccaggaccaggaggacagcaccctgtacgtgagcttcacccccaagggccccaagatccaccaggtgaagcacatgtaccaggtgagaatccagcccagcatccacgaccacaacatccccaccctggaggccgtggtgggcgtgccccagccccccagcgagggccccatcacccaccagtggagcgtgcagatggagccccccgtgccctgccactacgaggacctggagagactgcccgacgccgccgagccctgcctgcccggcgccctgttcagatgccccgtggtgttcagacaggagatcctggtgcaggtgatcggcaccctggagctggtgggcgagatcgaggccagcagcatgttcagcctgtgcagcagcctgagcatcagcttcaacagcagcaagcacttccacctgtacggcagcaacgccagcctggcccaggtggtgatgaaggtggacgtggtgtacgagaagcagatgctgtacctgtacgtgctgagcggcatcggcggcctgctgctgctgctgctgatcttcatcgtgctgtacaaggtgggcttcttcaagagaaacctgaaggagaagatggaggccggcagaggcgtgcccaacggcatccccgccgaggacagcgagcagctggccagcggccaggaggccggcgaccccggctgcctgaagcccctgcacgagaaggacagcgagagcggcggcggcaaggactag

SEQ ID NO: 85376 - DNA, 3261 bp, Artificial Sequence
  Description of Artificial Sequence: Synthetic coding sequence
atgaaggacagctgcatcaccgtgatggccatggccctgctgagcggcttcttcttcttcgcccccgccagcagctacaacctggacgtgagaggcgccagaagcttcagcccccccagagccggcagacacttcggctacagagtgctgcaggtgggcaacggcgtgatcgtgggcgcccccggcgagggcaacagcaccggcagcctgtaccagtgccagagcggcaccggccactgcctgcccgtgaccctgagaggcagcaactacaccagcaagtacctgggcatgaccctggccaccgaccccaccgacggcagcatcctgttcgccgccgtgcagttcagcaccagctacaagaccgagttcgacttcagcgactacgtgaagagaaaggaccccgacgccctgctgaagcacgtgaagcacatgctgctgctgaccaacaccttcggcgccatcaactacgtggccaccgaggtgttcagagaggagctgggcgccagacccgacgccaccaaggtgctgatcatcatcaccgacggcgaggccaccgacagcggcaacatcgacgccgccaaggacatcatcagatacatcatcggcatcggcaagcacttccagaccaaggagagccaggagaccctgcacaagttcgccagcaagcccgccagcgagttcgtgaagatcctggacaccttcgagaagctgaaggacctgttcaccgagctgcagaagaagatctacgtgatcgagggcaccagcaagcaggacctgaccagcttcaacatggagctgagcagcagcggcatcagcgccgacctgagcagaggccacgccgtggtgggcgccgtgggcgccaaggactgggccggcggcttcctggacctgaaggccgacctgcaggacgacaccttcatcggcaacgagcccctgacccccgaggtgagagccggctacctgggctacaccgtgacctggctgcccagcagacagaagaccagcctgctggccagcggcgcccccagataccagcacatgggcagagtgctgctgttccaggagccccagggcggcggccactggagccaggtgcagaccatccacggcacccagatcggcagctacttcggcggcgagctgtgcggcgtggacgtggaccaggacggcgagaccgagctgctgctgatcggcgcccccctgttctacggcgagcagagaggcggcagagtgttcatctaccagagaagacagctgggcttcgaggaggtgagcgagctgcagggcgaccccggctaccccctgggcagattcggcgaggccatcaccgccctgaccgacatcaacggcgacggcctggtggacgtggccgtgggcgcccccctggaggagcagggcgccgtgtacatcttcaacggcagacacggcggcctgagcccccagcccagccagagaatcgagggcacccaggtgctgagcggcatccagtggttcggcagaagcatccacggcgtgaaggacctggagggcgacggcctggccgacgtggccgtgggcgccgagagccagatgatcgtgctgagcagcagacccgtggtggacatggtgaccctgatgagcttcagccccgccgagatccccgtgcacgaggtggagtgcagctacagcaccagcaacaagatgaaggagggcgtgaacatcaccatctgcttccagatcaagagcctgatcccccagttccagggcagactggtggccaacctgacctacaccctgcagctggacggccacagaaccagaagaagaggcctgttccccggcggcagacacgagctgagaagaaacatcgccgtgaccaccagcatgagctgcaccgacttcagcttccacttccccgtgtgcgtgcaggacctgatcagccccatcaacgtgagcctgaacttcagcctgtgggaggaggagggcacccccagagaccagagagccggcaaggacatcccccccatcctgagacccagcctgcacagcgagacctgggagatccccttcgagaagaactgcggcgaggacaagaagtgcgaggccaacctgagagtgagcttcagccccgccagaagcagagccctgagactgaccgccttcgccagcctgagcgtggagctgagcctgagcaacctggaggaggacgcctactgggtgcagctggacctgcacttcccccccggcctgagcttcagaaaggtggagatgctgaagccccacagccagatccccgtgagctgcgaggagctgcccgaggagagcagactgctgagcagagccctgagctgcaacgtgagcagccccatcttcaaggccggccacagcgtggccctgcagatgatgttcaacaccctggtgaacagcagctggggcgacagcgtggagctgcacgccaacgtgacctgcaacaacgaggacagcgacctgctggaggacaacagcgccaccaccatcatccccatcctgtaccccatcaacatcctgatccaggaccaggaggacagcaccctgtacgtgagcttcacccccaagggccccaagatccaccaggtgaagcacatgtaccaggtgagaatccagcccagcatccacgaccacaacatccccaccctggaggccgtggtgggcgtgccccagccccccagcgagggccccatcacccaccagtggagcgtgcagatggagccccccgtgccctgccactacgaggacctggagagactgcccgacgccgccgagccctgcctgcccggcgccctgttcagatgccccgtggtgttcagacaggagatcctggtgcaggtgatcggcaccctggagctggtgggcgagatcgaggccagcagcatgttcagcctgtgcagcagcctgagcatcagcttcaacagcagcaagcacttccacctgtacggcagcaacgccagcctggcccaggtggtgatgaaggtggacgtggtgtacgagaagcagatgctgtacctgtacgtgctgagcggcatcggcggcctgctgctgctgctgctgatcttcatcgtgctgtacaaggtgggcttcttcaagagaaacctgaaggagaagatggaggccggcagaggcgtgcccaacggcatccccgccgaggacagcgagcagctggccagcggccaggaggccggcgaccccggctgcctgaagcccctgcacgagaaggacagcgagagcggcggcggcaaggactag

SEQ ID NO: 85377 - DNA, 1215 bp, Artificial Sequence
  Description of Artificial Sequence: Synthetic coding sequence
atgaaggacagctgcatcaccgtgatggccatggccctgctgagcggcttcttcttcttcgcccccgccagcagctacaacctggacgtgagaggcgccagaagcttcagcccccccagagccggcagacacttcggctacagagtgctgcagatcaagagcctgatcccccagttccagggcagactggtggccaacctgacctacaccctgcagctggacggccacagaaccagaagaagaggcctgttccccggcggcagacacgagctgagaagaaacatcgccgtgaccaccagcatgagctgcaccgacttcagcttccacttccccatgatgttcaacaccctggtgaacagcagctggggcgacagcgtggagctgcacgccaacgtgacctgcaacaacgaggacagcgacctgctggaggacaacagcgccaccaccatcatccccatcctgtaccccatcaacatcctgatccaggaccaggaggacagcaccctgtacgtgagcttcacccccaagggccccaagatccaccaggtgaagcacatgtaccaggtgagaatccagcccagcatccacgaccacaacatccccaccctggaggccgtggtgggcgtgccccagccccccagcgagggccccatcacccaccagtggagcgtgcagatggagccccccgtgccctgccactacgaggacctggagagactgcccgacgccgccgagccctgcctgcccggcgccctgttcagatgccccgtggtgttcagacaggagatcctggtgcaggtgatcggcaccctggagctggtgggcgagatcgaggccagcagcatgttcagcctgtgcagcagcctgagcatcagcttcaacagcagcaagcacttccacctgtacggcagcaacgccagcctggcccaggtggtgatgaaggtggacgtggtgtacgagaagcagatgctgtacctgtacgtgctgagcggcatcggcggcctgctgctgctgctgctgatcttcatcgtgctgtacaaggtgggcttcttcaagagaaacctgaaggagaagatggaggccggcagaggcgtgcccaacggcatccccgccgaggacagcgagcagctggccagcggccaggaggccggcgaccccggctgcctgaagcccctgcacgagaaggacagcgagagcggcggcggcaaggactag

SEQ ID NO: 85378 - DNA, 489 bp, Artificial Sequence
  Description of Artificial Sequence: Synthetic coding sequence
atgaaggacagctgcatcaccgtgatggccatggccctgctgagcggcttcttcttcttcgcccccgccagcagctacaacctggacgtgagaggcgccagaagcttcagcccccccagagccggcagacacttcggctacagagtgctgcaggtgggcaacggcgtgatcgtgggcgcccccggcgagggcaacagcaccggcagcctgtaccagtgccagagcggcaccggccactgcctgcccgtgaccctgagaggcagcaactacaccagcaagtacctgggcatgaccctggccaccgaccccaccgacggcagcatcctggcctgcgaccccggcctgagcagaacctgcgaccagaacacctacctgagcggcctgtgctacctgttcagacagaacctgcagggccccatgctgcagggcagacccggcttccaggtgtgctgctgcagcgtgttccacaagctgcagaacagaatctag

SEQ ID NO: 85379 - DNA, 3459 bp, Artificial Sequence
  Description of Artificial Sequence: Synthetic coding sequence
atggccctgagagtgctgctgctgaccgccctgaccctgtgccacggcttcaacctggacaccgagaacgccatgaccttccaggagaacgccagaggcttcggccagagcgtggtgcagctgcagggcagcagagtggtggtgggcgccccccaggagatcgtggccgccaaccagagaggcagcctgtaccagtgcgactacagcaccggcagctgcgagcccatcagactgcaggtgcccgtggaggccgtgaacatgagcctgggcctgagcctggccgccaccaccagccccccccagctgctggcctgcggccccaccgtgcaccagacctgcagcgagaacacctacgtgaagggcctgtgcttcctgttcggcagcaacctgagacagcagccccagaagttccccgaggccctgagaggctgcccccaggaggacagcgacatcgccttcctgatcgacggcagcggcagcatcatcccccacgacttcagaagaatgaaggagttcgtgagcaccgtgatggagcagctgaagaagagcaagaccctgttcagcctgatgcagtacagcgaggagttcagaatccacttcaccttcaaggagttccagaacaaccccaaccccagaagcctggtgaagcccatcacccagctgctgggcagaacccacaccgccaccggcatcagaaaggtggtgagagagctgttcaacatcaccaacggcgccagaaagaacgccttcaagatcctggtggtgatcaccgacggcgagaagttcggcgaccccctgggctacgaggacgtgatccccgaggccgacagagagggcgtgatcagatacgtgatcggcgtgggcgacgccttcagaagcgagaagagcagacaggagctgaacaccatcgccagcaagccccccagagaccacgtgttccaggtgaacaacttcgaggccctgaagaccatccagaaccagctgagagagaagatcttcgccatcgagggcacccagaccggcagcagcagcagcttcgagcacgagatgagccaggagggcttcagcgccgccatcaccagcaacggccccctgctgagcaccgtgggcagctacgactgggccggcggcgtgttcctgtacaccagcaaggagaagagcaccttcatcaacatgaccagagtggacagcgacatgaacgacgcctacctgggctacgccgccgccatcatcctgagaaacagagtgcagagcctggtgctgggcgcccccagataccagcacatcggcctggtggccatgttcagacagaacaccggcatgtgggagagcaacgccaacgtgaagggcacccagatcggcgcctacttcggcgccagcctgtgcagcgtggacgtggacagcaacggcagcaccgacctggtgctgatcggcgccccccactactacgagcagaccagaggcggccaggtgagcgtgtgccccctgcccagaggcagagccagatggcagtgcgacgccgtgctgtacggcgagcagggccagccctggggcagattcggcgccgccctgaccgtgctgggcgacgtgaacggcgacaagctgaccgacgtggccatcggcgcccccggcgaggaggacaacagaggcgccgtgtacctgttccacggcaccagcggcagcggcatcagccccagccacagccagagaatcgccggcagcaagctgagccccagactgcagtacttcggccagagcctgagcggcggccaggacctgaccatggacggcctggtggacctgaccgtgggcgcccagggccacgtgctgctgctgagaagccagcccgtgctgagagtgaaggccatcatggagttcaaccccagagaggtggccagaaacgtgttcgagtgcaacgaccaggtggtgaagggcaaggaggccggcgaggtgagagtgtgcctgcacgtgcagaagagcaccagagacagactgagagagggccagatccagagcgtggtgacctacgacctggccctggacagcggcagaccccacagcagagccgtgttcaacgagaccaagaacagcaccagaagacagacccaggtgctgggcctgacccagacctgcgagaccctgaagctgcagctgcccaactgcatcgaggaccccgtgagccccatcgtgctgagactgaacttcagcctggtgggcacccccctgagcgccttcggcaacctgagacccgtgctggccgaggacgcccagagactgttcaccgccctgttccccttcgagaagaactgcggcaacgacaacatctgccaggacgacctgagcatcaccttcagcttcatgagcctggactgcctggtggtgggcggccccagagagttcaacgtgaccgtgaccgtgagaaacgacggcgaggacagctacagaacccaggtgaccttcttcttccccctggacctgagctacagaaaggtgagcaccctgcagaaccagagaagccagagaagctggagactggcctgcgagagcgccagcagcaccgaggtgagcggcgccctgaagagcaccagctgcagcatcaaccaccccatcttccccgagaacagcgaggtgaccttcaacatcaccttcgacgtggacagcaaggccagcctgggcaacaagctgctgctgaaggccaacgtgaccagcgagaacaacatgcccagaaccaacaagaccgagttccagctggagctgcccgtgaagtacgccgtgtacatggtggtgaccagccacggcgtgagcaccaagtacctgaacttcaccgccagcgagaacaccagcagagtgatgcagcaccagtaccaggtgagcaacctgggccagagaagcctgcccatcagcctggtgttcctggtgcccgtgagactgaaccagaccgtgatctgggacagaccccaggtgaccttcagcgagaacctgagcagcacctgccacaccaaggagagactgcccagccacagcgacttcctggccgagctgagaaaggcccccgtggtgaactgcagcatcgccgtgtgccagagaatccagtgcgacatccccttcttcggcatccaggaggagttcaacgccaccctgaagggcaacctgagcttcgactggtacatcaagaccagccacaaccacctgctgatcgtgagcaccgccgagatcctgttcaacgacagcgtgttcaccctgctgcccggccagggcgccttcgtgagaagccagaccgagaccaaggtggagcccttcgaggtgcccaaccccctgcccctgatcgtgggcagcagcgtgggcggcctgctgctgctggccctgatcaccgccgccctgtacaagctgggcttcttcaagagacagtacaaggacatgatgagcgagggcggcccccccggcgccgagccccagtag

SEQ ID NO: 85380 - DNA, 3462 bp, Artificial Sequence
  Description of Artificial Sequence: Synthetic coding sequence
atggccctgagagtgctgctgctgaccgccctgaccctgtgccacggcttcaacctggacaccgagaacgccatgaccttccaggagaacgccagaggcttcggccagagcgtggtgcagctgcagggcagcagagtggtggtgggcgccccccaggagatcgtggccgccaaccagagaggcagcctgtaccagtgcgactacagcaccggcagctgcgagcccatcagactgcaggtgcccgtggaggccgtgaacatgagcctgggcctgagcctggccgccaccaccagccccccccagctgctggcctgcggccccaccgtgcaccagacctgcagcgagaacacctacgtgaagggcctgtgcttcctgttcggcagcaacctgagacagcagccccagaagttccccgaggccctgagaggctgcccccaggaggacagcgacatcgccttcctgatcgacggcagcggcagcatcatcccccacgacttcagaagaatgaaggagttcgtgagcaccgtgatggagcagctgaagaagagcaagaccctgttcagcctgatgcagtacagcgaggagttcagaatccacttcaccttcaaggagttccagaacaaccccaaccccagaagcctggtgaagcccatcacccagctgctgggcagaacccacaccgccaccggcatcagaaaggtggtgagagagctgttcaacatcaccaacggcgccagaaagaacgccttcaagatcctggtggtgatcaccgacggcgagaagttcggcgaccccctgggctacgaggacgtgatccccgaggccgacagagagggcgtgatcagatacgtgatcggcgtgggcgacgccttcagaagcgagaagagcagacaggagctgaacaccatcgccagcaagccccccagagaccacgtgttccaggtgaacaacttcgaggccctgaagaccatccagaaccagctgagagagaagatcttcgccatcgagggcacccagaccggcagcagcagcagcttcgagcacgagatgagccaggagggcttcagcgccgccatcaccagcaacggccccctgctgagcaccgtgggcagctacgactgggccggcggcgtgttcctgtacaccagcaaggagaagagcaccttcatcaacatgaccagagtggacagcgacatgaacgacgcctacctgggctacgccgccgccatcatcctgagaaacagagtgcagagcctggtgctgggcgcccccagataccagcacatcggcctggtggccatgttcagacagaacaccggcatgtgggagagcaacgccaacgtgaagggcacccagatcggcgcctacttcggcgccagcctgtgcagcgtggacgtggacagcaacggcagcaccgacctggtgctgatcggcgccccccactactacgagcagaccagaggcggccaggtgagcgtgtgccccctgcccagaggccagagagccagatggcagtgcgacgccgtgctgtacggcgagcagggccagccctggggcagattcggcgccgccctgaccgtgctgggcgacgtgaacggcgacaagctgaccgacgtggccatcggcgcccccggcgaggaggacaacagaggcgccgtgtacctgttccacggcaccagcggcagcggcatcagccccagccacagccagagaatcgccggcagcaagctgagccccagactgcagtacttcggccagagcctgagcggcggccaggacctgaccatggacggcctggtggacctgaccgtgggcgcccagggccacgtgctgctgctgagaagccagcccgtgctgagagtgaaggccatcatggagttcaaccccagagaggtggccagaaacgtgttcgagtgcaacgaccaggtggtgaagggcaaggaggccggcgaggtgagagtgtgcctgcacgtgcagaagagcaccagagacagactgagagagggccagatccagagcgtggtgacctacgacctggccctggacagcggcagaccccacagcagagccgtgttcaacgagaccaagaacagcaccagaagacagacccaggtgctgggcctgacccagacctgcgagaccctgaagctgcagctgcccaactgcatcgaggaccccgtgagccccatcgtgctgagactgaacttcagcctggtgggcacccccctgagcgccttcggcaacctgagacccgtgctggccgaggacgcccagagactgttcaccgccctgttccccttcgagaagaactgcggcaacgacaacatctgccaggacgacctgagcatcaccttcagcttcatgagcctggactgcctggtggtgggcggccccagagagttcaacgtgaccgtgaccgtgagaaacgacggcgaggacagctacagaacccaggtgaccttcttcttccccctggacctgagctacagaaaggtgagcaccctgcagaaccagagaagccagagaagctggagactggcctgcgagagcgccagcagcaccgaggtgagcggcgccctgaagagcaccagctgcagcatcaaccaccccatcttccccgagaacagcgaggtgaccttcaacatcaccttcgacgtggacagcaaggccagcctgggcaacaagctgctgctgaaggccaacgtgaccagcgagaacaacatgcccagaaccaacaagaccgagttccagctggagctgcccgtgaagtacgccgtgtacatggtggtgaccagccacggcgtgagcaccaagtacctgaacttcaccgccagcgagaacaccagcagagtgatgcagcaccagtaccaggtgagcaacctgggccagagaagcctgcccatcagcctggtgttcctggtgcccgtgagactgaaccagaccgtgatctgggacagaccccaggtgaccttcagcgagaacctgagcagcacctgccacaccaaggagagactgcccagccacagcgacttcctggccgagctgagaaaggcccccgtggtgaactgcagcatcgccgtgtgccagagaatccagtgcgacatccccttcttcggcatccaggaggagttcaacgccaccctgaagggcaacctgagcttcgactggtacatcaagaccagccacaaccacctgctgatcgtgagcaccgccgagatcctgttcaacgacagcgtgttcaccctgctgcccggccagggcgccttcgtgagaagccagaccgagaccaaggtggagcccttcgaggtgcccaaccccctgcccctgatcgtgggcagcagcgtgggcggcctgctgctgctggccctgatcaccgccgccctgtacaagctgggcttcttcaagagacagtacaaggacatgatgagcgagggcggcccccccggcgccgagccccagtag

SEQ ID NO: 85381 - DNA, 3492 bp, Artificial Sequence
  Description of Artificial Sequence: Synthetic coding sequence
atgaccagaaccagagccgccctgctgctgttcaccgccctggccaccagcctgggcttcaacctggacaccgaggagctgaccgccttcagagtggacagcgccggcttcggcgacagcgtggtgcagtacgccaacagctgggtggtggtgggcgccccccagaagatcaccgccgccaaccagaccggcggcctgtaccagtgcggctacagcaccggcgcctgcgagcccatcggcctgcaggtgccccccgaggccgtgaacatgagcctgggcctgagcctggccagcaccaccagccccagccagctgctggcctgcggccccaccgtgcaccacgagtgcggcagaaacatgtacctgaccggcctgtgcttcctgctgggccccacccagctgacccagagactgcccgtgagcagacaggagtgccccagacaggagcaggacatcgtgttcctgatcgacggcagcggcagcatcagcagcagaaacttcgccaccatgatgaacttcgtgagagccgtgatcagccagttccagagacccagcacccagttcagcctgatgcagttcagcaacaagttccagacccacttcaccttcgaggagttcagaagaagcagcaaccccctgagcctgctggccagcgtgcaccagctgcagggcttcacctacaccgccaccgccatccagaacgtggtgcacagactgttccacgccagctacggcgccagaagagacgccgccaagatcctgatcgtgatcaccgacggcaagaaggagggcgacagcctggactacaaggacgtgatccccatggccgacgccgccggcatcatcagatacgccatcggcgtgggcctggccttccagaacagaaacagctggaaggagctgaacgacatcgccagcaagcccagccaggagcacatcttcaaggtggaggacttcgacgccctgaaggacatccagaaccagctgaaggagaagatcttcgccatcgagggcaccgagaccaccagcagcagcagcttcgagctggagatggcccaggagggcttcagcgccgtgttcacccccgacggccccgtgctgggcgccgtgggcagcttcacctggagcggcggcgccttcctgtacccccccaacatgagccccaccttcatcaacatgagccaggagaacgtggacatgagagacagctacctgggctacagcaccgagctggccctgtggaagggcgtgcagagcctggtgctgggcgcccccagataccagcacaccggcaaggccgtgatcttcacccaggtgagcagacagtggagaatgaaggccgaggtgaccggcacccagatcggcagctacttcggcgccagcctgtgcagcgtggacgtggacagcgacggcagcaccgacctggtgctgatcggcgccccccactactacgagcagaccagaggcggccaggtgagcgtgtgccccctgcccagaggctggagaagatggtggtgcgacgccgtgctgtacggcgagcagggccacccctggggcagattcggcgccgccctgaccgtgctgggcgacgtgaacggcgacaagctgaccgacgtggtgatcggcgcccccggcgaggaggagaacagaggcgccgtgtacctgttccacggcgtgctgggccccagcatcagccccagccacagccagagaatcgccggcagccagctgagcagcagactgcagtacttcggccaggccctgagcggcggccaggacctgacccaggacggcctggtggacctggccgtgggcgccagaggccaggtgctgctgctgagaaccagacccgtgctgtgggtgggcgtgagcatgcagttcatccccgccgagatccccagaagcgccttcgagtgcagagagcaggtggtgagcgagcagaccctggtgcagagcaacatctgcctgtacatcgacaagagaagcaagaacctgctgggcagcagagacctgcagagcagcgtgaccctggacctggccctggaccccggcagactgagccccagagccaccttccaggagaccaagaacagaagcctgagcagagtgagagtgctgggcctgaaggcccactgcgagaacttcaacctgctgctgcccagctgcgtggaggacagcgtgacccccatcaccctgagactgaacttcaccctggtgggcaagcccctgctggccttcagaaacctgagacccatgctggccgccgacgcccagagatacttcaccgccagcctgcccttcgagaagaactgcggcgccgaccacatctgccaggacaacctgggcatcagcttcagcttccccggcctgaagagcctgctggtgggcagcaacctggagctgaacgccgaggtgatggtgtggaacgacggcgaggacagctacggcaccaccatcaccttcagccaccccgccggcctgagctacagatacgtggccgagggccagaagcagggccagctgagaagcctgcacctgacctgcgacagcgcccccgtgggcagccagggcacctggagcaccagctgcagaatcaaccacctgatcttcagaggcggcgcccagatcaccttcctggccaccttcgacgtgagccccaaggccgtgctgggcgacagactgctgctgaccgccaacgtgagcagcgagaacaacacccccagaaccagcaagaccaccttccagctggagctgcccgtgaagtacgccgtgtacaccgtggtgagcagccacgagcagttcaccaagtacctgaacttcagcgagagcgaggagaaggagagccacgtggccatgcacagataccaggtgaacaacctgggccagagagacctgcccgtgagcatcaacttctgggtgcccgtggagctgaaccaggaggccgtgtggatggacgtggaggtgagccacccccagaaccccagcctgagatgcagcagcgagaagatcgccccccccgccagcgacttcctggcccacatccagaagaaccccgtgctggactgcagcatcgccggctgcctgagattcagatgcgacgtgcccagcttcagcgtgcaggaggagctggacttcaccctgaagggcaacctgagcttcggctgggtgagacagatcctgcagaagaaggtgagcgtggtgagcgtggccgagatcaccttcgacaccagcgtgtacagccagctgcccggccaggaggccttcatgagagcccagaccaccaccgtgctggagaagtacaaggtgcacaaccccacccccctgatcgtgggcagcagcatcggcggcctgctgctgctggccctgatcaccgccgtgctgtacaaggtgggcttcttcaagagacagtacaaggagatgatggaggaggccaacggccagatcgcccccgagaacggcacccagacccccagcccccccagcgagaagtag

SEQ ID NO: 85382 - DNA, 5469 bp, Artificial Sequence
  Description of Artificial Sequence: Synthetic coding sequence
atggccggccccagacccagcccctgggccagactgctgctggccgccctgatcagcgtgagcctgagcggcaccctggccaacagatgcaagaaggcccccgtgaagagctgcaccgagtgcgtgagagtggacaaggactgcgcctactgcaccgacgagatgttcagagacagaagatgcaacacccaggccgagctgctggccgccggctgccagagagagagcatcgtggtgatggagagcagcttccagatcaccgaggagacccagatcgacaccaccctgagaagaagccagatgagcccccagggcctgagagtgagactgagacccggcgaggagagacacttcgagctggaggtgttcgagcccctggagagccccgtggacctgtacatcctgatggacttcagcaacagcatgagcgacgacctggacaacctgaagaagatgggccagaacctggccagagtgctgagccagctgaccagcgactacaccatcggcttcggcaagttcgtggacaaggtgagcgtgccccagaccgacatgagacccgagaagctgaaggagccctggcccaacagcgacccccccttcagcttcaagaacgtgatcagcctgaccgaggacgtggacgagttcagaaacaagctgcagggcgagagaatcagcggcaacctggacgcccccgagggcggcttcgacgccatcctgcagaccgccgtgtgcaccagagacatcggctggagacccgacagcacccacctgctggtgttcagcaccgagagcgccttccactacgaggccgacggcgccaacgtgctggccggcatcatgagcagaaacgacgagagatgccacctggacaccaccggcacctacacccagtacagaacccaggactaccccagcgtgcccaccctggtgagactgctggccaagcacaacatcatccccatcttcgccgtgaccaactacagctacagctactacgagaagctgcacacctacttccccgtgagcagcctgggcgtgctgcaggaggacagcagcaacatcgtggagctgctggaggaggccttcaacagaatcagaagcaacctggacatcagagccctggacagccccagaggcctgagaaccgaggtgaccagcaagatgttccagaagaccagaaccggcagcttccacatcagaagaggcgaggtgggcatctaccaggtgcagctgagagccctggagcacgtggacggcacccacgtgtgccagctgcccgaggaccagaagggcaacatccacctgaagcccagcttcagcgacggcctgaagatggacgccggcatcatctgcgacgtgtgcacctgcgagctgcagaaggaggtgagaagcgccagatgcagcttcaacggcgacttcgtgtgcggccagtgcgtgtgcagcgagggctggagcggccagacctgcaactgcagcaccggcagcctgagcgacatccagccctgcctgagagagggcgaggacaagccctgcagcggcagaggcgagtgccagtgcggccactgcgtgtgctacggcgagggcagatacgagggccagttctgcgagtacgacaacttccagtgccccagaaccagcggcttcctgtgcaacgacagaggcagatgcagcatgggccagtgcgtgtgcgagcccggctggaccggccccagctgcgactgccccctgagcaacgccacctgcatcgacagcaacggcggcatctgcaacggcagaggccactgcgagtgcggcagatgccactgccaccagcagagcctgtacaccgacaccatctgcgagatcaactacagcgccatccaccccggcctgtgcgaggacctgagaagctgcgtgcagtgccaggcctggggcaccggcgagaagaagggcagaacctgcgaggagtgcaacttcaaggtgaagatggtggacgagctgaagagagccgaggaggtggtggtgagatgcagcttcagagacgaggacgacgactgcacctacagctacaccatggagggcgacggcgcccccggccccaacagcaccgtgctggtgcacaagaagaaggactgcccccccggcagcttctggtggctgatccccctgctgctgctgctgctgcccctgctggccctgctgctgctgctgtgctggaagtactgcgcctgctgcaaggcctgcctggccctgctgccctgctgcaacagaggccacatggtgggcttcaaggaggaccactacatgctgagagagaacctgatggccagcgaccacctggacacccccatgctgagaagcggcaacctgaagggcagagacgtggtgagatggaaggtgaccaacaacatgcagagacccggcttcgccacccacgccgccagcatcaaccccaccgagctggtgccctacggcctgagcctgagactggccagactgtgcaccgagaacctgctgaagcccgacaccagagagtgcgcccagctgagacaggaggtggaggagaacctgaacgaggtgtacagacagatcagcggcgtgcacaagctgcagcagaccaagttcagacagcagcccaacgccggcaagaagcaggaccacaccatcgtggacaccgtgctgatggcccccagaagcgccaagcccgccctgctgaagctgaccgagaagcaggtggagcagagagccttccacgacctgaaggtggcccccggctactacaccctgaccgccgaccaggacgccagaggcatggtggagttccaggagggcgtggagctggtggacgtgagagtgcccctgttcatcagacccgaggacgacgacgagaagcagctgctggtggaggccatcgacgtgcccgccggcaccgccaccctgggcagaagactggtgaacatcaccatcatcaaggagcaggccagagacgtggtgagcttcgagcagcccgagttcagcgtgagcagaggcgaccaggtggccagaatccccgtgatcagaagagtgctggacggcggcaagagccaggtgagctacagaacccaggacggcaccgcccagggcaacagagactacatccccgtggagggcgagctgctgttccagcccggcgaggcctggaaggagctgcaggtgaagctgctggagctgcaggaggtggacagcctgctgagaggcagacaggtgagaagattccacgtgcagctgagcaaccccaagttcggcgcccacctgggccagccccacagcaccaccatcatcatcagagaccccgacgagctggacagaagcttcaccagccagatgctgagcagccagccccccccccacggcgacctgggcgccccccagaaccccaacgccaaggccgccggcagcagaaagatccacttcaactggctgccccccagcggcaagcccatgggctacagagtgaagtactggatccagggcgacagcgagagcgaggcccacctgctggacagcaaggtgcccagcgtggagctgaccaacctgtacccctactgcgactacgagatgaaggtgtgcgcctacggcgcccagggcgagggcccctacagcagcctggtgagctgcagaacccaccaggaggtgcccagcgagcccggcagactggccttcaacgtggtgagcagcaccgtgacccagctgagctgggccgagcccgccgagaccaacggcgagatcaccgcctacgaggtgtgctacggcctggtgaacgacgacaacagacccatcggccccatgaagaaggtgctggtggacaaccccaagaacagaatgctgctgatcgagaacctgagagagagccagccctacagatacaccgtgaaggccagaaacggcgccggctggggccccgagagagaggccatcatcaacctggccacccagcccaagagacccatgagcatccccatcatccccgacatccccatcgtggacgcccagagcggcgaggactacgacagcttcctgatgtacagcgacgacgtgctgagaagccccagcggcagccagagacccagcgtgagcgacgacaccggctgcggctggaagttcgagcccctgctgggcgaggagctggacctgagaagagtgacctggagactgccccccgagctgatccccagactgagcgccagcagcggcagaagcagcgacgccgaggccccccacggcccccccgacgacggcggcgccggcggcaagggcggcagcctgcccagaagcgccacccccggcccccccggcgagcacctggtgaacggcagaatggacttcgccttccccggcagcaccaacagcctgcacagaatgaccaccaccagcgccgccgcctacggcacccacctgagcccccacgtgccccacagagtgctgagcaccagcagcaccctgaccagagactacaacagcctgaccagaagcgagcacagccacagcaccaccctgcccagagactacagcaccctgaccagcgtgagcagccacgacagcagactgaccgccggcgtgcccgacacccccaccagactggtgttcagcgccctgggccccaccagcctgagagtgagctggcaggagcccagatgcgagagacccctgcagggctacagcgtggagtaccagctgctgaacggcggcgagctgcacagactgaacatccccaaccccgcccagaccagcgtggtggtggaggacctgctgcccaaccacagctacgtgttcagagtgagagcccagagccaggagggctggggcagagagagagagggcgtgatcaccatcgagagccaggtgcacccccagagccccctgtgccccctgcccggcagcgccttcaccctgagcacccccagcgcccccggccccctggtgttcaccgccctgagccccgacagcctgcagctgagctgggagagacccagaagacccaacggcgacatcgtgggctacctggtgacctgcgagatggcccagggcggcggccccgccaccgccttcagagtggacggcgacagccccgagagcagactgaccgtgcccggcctgagcgagaacgtgccctacaagttcaaggtgcaggccagaaccaccgagggcttcggccccgagagagagggcatcatcaccatcgagagccaggacggcggccccttcccccagctgggcagcagagccggcctgttccagcaccccctgcagagcgagtacagcagcatcaccaccacccacaccagcgccaccgagcccttcctggtggacggcctgaccctgggcgcccagcacctggaggccggcggcagcctgaccagacacgtgacccaggagttcgtgagcagaaccctgaccaccagcggcaccctgagcacccacatggaccagcagttcttccagacctag

SEQ ID NO: 85383 - DNA, 5418 bp, Artificial Sequence
  Description of Artificial Sequence: Synthetic coding sequence
atggccggccccagacccagcccctgggccagactgctgctggccgccctgatcagcgtgagcctgagcggcaccctggccaacagatgcaagaaggcccccgtgaagagctgcaccgagtgcgtgagagtggacaaggactgcgcctactgcaccgacgagatgttcagagacagaagatgcaacacccaggccgagctgctggccgccggctgccagagagagagcatcgtggtgatggagagcagcttccagatcaccgaggagacccagatcgacaccaccctgagaagaagccagatgagcccccagggcctgagagtgagactgagacccggcgaggagagacacttcgagctggaggtgttcgagcccctggagagccccgtggacctgtacatcctgatggacttcagcaacagcatgagcgacgacctggacaacctgaagaagatgggccagaacctggccagagtgctgagccagctgaccagcgactacaccatcggcttcggcaagttcgtggacaaggtgagcgtgccccagaccgacatgagacccgagaagctgaaggagccctggcccaacagcgacccccccttcagcttcaagaacgtgatcagcctgaccgaggacgtggacgagttcagaaacaagctgcagggcgagagaatcagcggcaacctggacgcccccgagggcggcttcgacgccatcctgcagaccgccgtgtgcaccagagacatcggctggagacccgacagcacccacctgctggtgttcagcaccgagagcgccttccactacgaggccgacggcgccaacgtgctggccggcatcatgagcagaaacgacgagagatgccacctggacaccaccggcacctacacccagtacagaacccaggactaccccagcgtgcccaccctggtgagactgctggccaagcacaacatcatccccatcttcgccgtgaccaactacagctacagctactacgagaagctgcacacctacttccccgtgagcagcctgggcgtgctgcaggaggacagcagcaacatcgtggagctgctggaggaggccttcaacagaatcagaagcaacctggacatcagagccctggacagccccagaggcctgagaaccgaggtgaccagcaagatgttccagaagaccagaaccggcagcttccacatcagaagaggcgaggtgggcatctaccaggtgcagctgagagccctggagcacgtggacggcacccacgtgtgccagctgcccgaggaccagaagggcaacatccacctgaagcccagcttcagcgacggcctgaagatggacgccggcatcatctgcgacgtgtgcacctgcgagctgcagaaggaggtgagaagcgccagatgcagcttcaacggcgacttcgtgtgcggccagtgcgtgtgcagcgagggctggagcggccagacctgcaactgcagcaccggcagcctgagcgacatccagccctgcctgagagagggcgaggacaagccctgcagcggcagaggcgagtgccagtgcggccactgcgtgtgctacggcgagggcagatacgagggccagttctgcgagtacgacaacttccagtgccccagaaccagcggcttcctgtgcaacgacagaggcagatgcagcatgggccagtgcgtgtgcgagcccggctggaccggccccagctgcgactgccccctgagcaacgccacctgcatcgacagcaacggcggcatctgcaacggcagaggccactgcgagtgcggcagatgccactgccaccagcagagcctgtacaccgacaccatctgcgagatcaactacagcgccatccaccccggcctgtgcgaggacctgagaagctgcgtgcagtgccaggcctggggcaccggcgagaagaagggcagaacctgcgaggagtgcaacttcaaggtgaagatggtggacgagctgaagagagccgaggaggtggtggtgagatgcagcttcagagacgaggacgacgactgcacctacagctacaccatggagggcgacggcgcccccggccccaacagcaccgtgctggtgcacaagaagaaggactgcccccccggcagcttctggtggctgatccccctgctgctgctgctgctgcccctgctggccctgctgctgctgctgtgctggaagtactgcgcctgctgcaaggcctgcctggccctgctgccctgctgcaacagaggccacatggtgggcttcaaggaggaccactacatgctgagagagaacctgatggccagcgaccacctggacacccccatgctgagaagcggcaacctgaagggcagagacgtggtgagatggaaggtgaccaacaacatgcagagacccggcttcgccacccacgccgccagcatcaaccccaccgagctggtgccctacggcctgagcctgagactggccagactgtgcaccgagaacctgctgaagcccgacaccagagagtgcgcccagctgagacaggaggtggaggagaacctgaacgaggtgtacagacagatcagcggcgtgcacaagctgcagcagaccaagttcagacagcagcccaacgccggcaagaagcaggaccacaccatcgtggacaccgtgctgatggcccccagaagcgccaagcccgccctgctgaagctgaccgagaagcaggtggagcagagagccttccacgacctgaaggtggcccccggctactacaccctgaccgccgaccaggacgccagaggcatggtggagttccaggagggcgtggagctggtggacgtgagagtgcccctgttcatcagacccgaggacgacgacgagaagcagctgctggtggaggccatcgacgtgcccgccggcaccgccaccctgggcagaagactggtgaacatcaccatcatcaaggagcaggccagagacgtggtgagcttcgagcagcccgagttcagcgtgagcagaggcgaccaggtggccagaatccccgtgatcagaagagtgctggacggcggcaagagccaggtgagctacagaacccaggacggcaccgcccagggcaacagagactacatccccgtggagggcgagctgctgttccagcccggcgaggcctggaaggagctgcaggtgaagctgctggagctgcaggaggtggacagcctgctgagaggcagacaggtgagaagattccacgtgcagctgagcaaccccaagttcggcgcccacctgggccagccccacagcaccaccatcatcatcagagaccccgacgagctggacagaagcttcaccagccagatgctgagcagccagccccccccccacggcgacctgggcgccccccagaaccccaacgccaaggccgccggcagcagaaagatccacttcaactggctgccccccagcggcaagcccatgggctacagagtgaagtactggatccagggcgacagcgagagcgaggcccacctgctggacagcaaggtgcccagcgtggagctgaccaacctgtacccctactgcgactacgagatgaaggtgtgcgcctacggcgcccagggcgagggcccctacagcagcctggtgagctgcagaacccaccaggaggtgcccagcgagcccggcagactggccttcaacgtggtgagcagcaccgtgacccagctgagctgggccgagcccgccgagaccaacggcgagatcaccgcctacgaggtgtgctacggcctggtgaacgacgacaacagacccatcggccccatgaagaaggtgctggtggacaaccccaagaacagaatgctgctgatcgagaacctgagagagagccagccctacagatacaccgtgaaggccagaaacggcgccggctggggccccgagagagaggccatcatcaacctggccacccagcccaagagacccatgagcatccccatcatccccgacatccccatcgtggacgcccagagcggcgaggactacgacagcttcctgatgtacagcgacgacgtgctgagaagccccagcggcagccagagacccagcgtgagcgacgacaccgagcacctggtgaacggcagaatggacttcgccttccccggcagcaccaacagcctgcacagaatgaccaccaccagcgccgccgcctacggcacccacctgagcccccacgtgccccacagagtgctgagcaccagcagcaccctgaccagagactacaacagcctgaccagaagcgagcacagccacagcaccaccctgcccagagactacagcaccctgaccagcgtgagcagccacggcctgccccccatctgggagcacggcagaagcagactgcccctgagctgggccctgggcagcagaagcagagcccagatgaagggcttcccccccagcagaggccccagagacagcatcatcctggccggcagacccgccgcccccagctggggccccgacagcagactgaccgccggcgtgcccgacacccccaccagactggtgttcagcgccctgggccccaccagcctgagagtgagctggcaggagcccagatgcgagagacccctgcagggctacagcgtggagtaccagctgctgaacggcggcgagctgcacagactgaacatccccaaccccgcccagaccagcgtggtggtggaggacctgctgcccaaccacagctacgtgttcagagtgagagcccagagccaggagggctggggcagagagagagagggcgtgatcaccatcgagagccaggtgcacccccagagccccctgtgccccctgcccggcagcgccttcaccctgagcacccccagcgcccccggccccctggtgttcaccgccctgagccccgacagcctgcagctgagctgggagagacccagaagacccaacggcgacatcgtgggctacctggtgacctgcgagatggcccagggcggcggccccgccaccgccttcagagtggacggcgacagccccgagagcagactgaccgtgcccggcctgagcgagaacgtgccctacaagttcaaggtgcaggccagaaccaccgagggcttcggccccgagagagagggcatcatcaccatcgagagccaggacggcggccccttcccccagctgggcagcagagccggcctgttccagcaccccctgcagagcgagtacagcagcatcaccaccacccacaccagcgccaccgagcccttcctggtggacggcctgaccctgggcgcccagcacctggaggccggcggcagcctgaccagacacgtgacccaggagttcgtgagcagaaccctgaccaccagcggcaccctgagcacccacatggaccagcagttcttccagacctag

SEQ ID NO: 85384 - DNA, 5418 bp, Artificial Sequence; identical to SEQ ID NO: 85383
  Description of Artificial Sequence: Synthetic coding sequence

SEQ ID NO: 85385 - DNA, 1932 bp, Artificial Sequence
  Description of Artificial Sequence: Synthetic coding sequence
ggcggcatcgaggagacccagatcgacaccaccctgagaagaagccagatgagcccccagggcctgagagtgagactgagacccggcgaggagagacacttcgagctggaggtgttcgagcccctggagagccccgtggacctgtacatcctgatggacttcagcaacagcatgagcgacgacctggacaacctgaagaagatgggccagaacctggccagagtgctgagccagctgaccagcgactacaccatcggcttcggcaagttcgtggacaaggtgagcgtgccccagaccgacatgagacccgagaagctgaaggagccctggcccaacagcgacccccccttcagcttcaagaacgtgatcagcctgaccgaggacgtggacgagttcagaaacaagctgcagggcgagagaatcagcggcaacctggacgcccccgagggcggcttcgacgccatcctgcagaccgccgtgtgcaccagagacatcggctggagacccgacagcacccacctgctggtgttcagcaccgagagcgccttccactacgaggccgacggcgccaacgtgctggccggcatcatgagcagaaacgacgagagatgccacctggacaccaccggcacctacacccagtacagaacccaggactaccccagcgtgcccaccctggtgagactgctggccaagcacaacatcatccccatcttcgccgtgaccaactacagctacagctactacgagaagctgcacacctacttccccgtgagcagcctgggcgtgctgcaggaggacagcagcaacatcgtggagctgctggaggaggccttcaacagaatcagaagcaacctggacatcagagccctggacagccccagaggcctgagaaccgaggtgaccagcaagatgttccagaagaccagaaccggcagcttccacatcagaagaggcgaggtgggcatctaccaggtgcagctgagagccctggagcacgtggacggcacccacgtgtgccagctgcccgaggaccagaagggcaacatccacctgaagcccagcttcagcgacggcctgaagatggacgccggcatcatctgcgacgtgtgcacctgcgagctgcagaaggaggtgagaagcgccagatgcagcttcaacggcgacttcgtgtgcggccagtgcgtgtgcagcgagggctggagcggccagacctgcaactgcagcaccggcagcctgagcgacatccagccctgcctgagagagggcgaggacaagccctgcagcggcagaggcgagtgccagtgcggccactgcgtgtgctacggcgagggcagatacgagggccagttctgcgagtacgacaacttccagtgccccagaaccagcggcttcctgtgcaacgacagaggcagatgcagcatgggccagtgcgtgtgcgagcccggctggaccggccccagctgcgactgccccctgagcaacgccacctgcatcgacagcaacggcggcatctgcaacggcagaggccactgcgagtgcggcagatgccactgccaccagcagagcctgtacaccgacaccatctgcgagatcaactacagcgccatccaccccggcctgtgcgaggacctgagaagctgcgtgcagtgccaggcctggggcaccggcgagaagaagggcagaacctgcgaggagtgcaacttcaaggtgaagatggtggacgagctgaagagagccgaggaggtggtggtgagatgcagcttcagagacgaggacgacgactgcacctacagctacaccatggagggcgacggcgcccccggccccaacagcaccgtgctggtgcacaagaagaaggactgcccccccggcagcttctggtggctgatccccctgctgctgctgctgctgcccctgctggccctgtag

SEQ ID NO: 85386 - DNA, 2367 bp, Artificial Sequence
  Description of Artificial Sequence: Synthetic coding sequence
atgggcatcgagctgctgtgcctgttcttcctgttcctgggcagaaacgaccacgtgcagggcggctgcgccctgggcggcgccgagacctgcgaggactgcctgctgatcggcccccagtgcgcctggtgcgcccaggagaacttcacccaccccagcggcgtgggcgagagatgcgacacccccgccaacctgctggccaagggctgccagctgaacttcatcgagaaccccgtgagccaggtggagatcctgaagaacaagcccctgagcgtgggcagacagaagaacagcagcgacatcgtgcagatcgccccccagagcctgatcctgaagctgagacccggcggcgcccagaccctgcaggtgcacgtgagacagaccgaggactaccccgtggacctgtactacctgatggacctgagcgccagcatggacgacgacctgaacaccatcaaggagctgggcagcagactgagcaaggagatgagcaagctgaccagcaacttcagactgggcttcggcagcttcgtggagaagcccgtgagccccttcgtgaagaccacccccgaggagatcgccaacccctgcagcagcatcccctacttctgcctgcccaccttcggcttcaagcacatcctgcccctgaccaacgacgccgagagattcaacgagatcgtgaagaaccagaagatcagcgccaacatcgacacccccgagggcggcttcgacgccatcatgcaggccgccgtgtgcaaggagaagatcggctggagaaacgacagcctgcacctgctggtgttcgtgagcgacgccgacagccacttcggcatggacagcaagctggccggcatcgtgatccccaacgacggcctgtgccacctggacagcaagaacgagtacagcatgagcaccgtgctggagtaccccaccatcggccagctgatcgacaagctggtgcagaacaacgtgctgctgatcttcgccgtgacccaggagcaggtgcacctgtacgagaactacgccaagctgatccccggcgccaccgtgggcctgctgcagaaggacagcggcaacatcctgcagctgatcatcagcgcctacgaggagctgagaagcgaggtggagctggaggtgctgggcgacaccgagggcctgaacctgagcttcaccgccatctgcaacaacggcaccctgttccagcaccagaagaagtgcagccacatgaaggtgggcgacaccgccagcttcagcgtgaccgtgaacatcccccactgcgagagaagaagcagacacatcatcatcaagcccgtgggcctgggcgacgccctggagctgctggtgagccccgagtgcaactgcgactgccagaaggaggtggaggtgaacagcagcaagtgccaccacggcaacggcagcttccagtgcggcgtgtgcgcctgccaccccggccacatgggccccagatgcgagtgcggcgaggacatgctgagcaccgacagctgcaaggaggcccccgaccaccccagctgcagcggcagaggcgactgctactgcggccagtgcatctgccacctgagcccctacggcaacatctacggcccctactgccagtgcgacaacttcagctgcgtgagacacaagggcctgctgtgcggcggcaacggcgactgcgactgcggcgagtgcgtgtgcagaagcggctggaccggcgagtactgcaactgcaccaccagcaccgacagctgcgtgagcgaggacggcgtgctgtgcagcggcagaggcgactgcgtgtgcggcaagtgcgtgtgcaccaaccccggcgccagcggccccacctgcgagagatgccccacctgcggcgacccctgcaacagcaagagaagctgcatcgagtgccacctgagcgccgccggccaggccagagaggagtgcgtggacaagtgcaagctggccggcgccaccatcagcgaggaggaggacttcagcaaggacggcagcgtgagctgcagcctgcagggcgagaacgagtgcctgatcaccttcctgatcaccaccgacaacgagggcaagaccatcatccacagcatcaacgagaaggactgccccaagccccccaacatccccatgatcatgctgggcgtgagcctggccatcctgctgatcggcgtggtgctgctgtgcatctggaagctgctggtgagcttccacgacagaaaggaggtggccaagttcgaggccgagagaagcaaggccaagtggcagaccggcaccaaccccctgtacagaggcagcaccagcaccttcaagaacgtgacctacaagcacagagagaagcagaaggtggacctgagcaccgactgctag

SEQ ID NO: 85387 - DNA, 2367 bp, Artificial Sequence; identical to SEQ ID NO: 85386
  Description of Artificial Sequence: Synthetic coding sequence

SEQ ID NO: 85388 - DNA, 2397 bp, Artificial Sequence
  Description of Artificial Sequence: Synthetic coding sequence
atggtggccctgcccatggtgctggtgctgctgctggtgctgagcagaggcgagagcgagctggacgccaagatccccagcaccggcgacgccaccgagtggagaaacccccacctgagcatgctgggcagctgccagcccgcccccagctgccagaagtgcatcctgagccaccccagctgcgcctggtgcaagcagctgaacttcaccgccagcggcgaggccgaggccagaagatgcgccagaagagaggagctgctggccagaggctgccccctggaggagctggaggagcccagaggccagcaggaggtgctgcaggaccagcccctgagccagggcgccagaggcgagggcgccacccagctggccccccagagagtgagagtgaccctgagacccggcgagccccagcagctgcaggtgagattcctgagagccgagggctaccccgtggacctgtactacctgatggacctgagctacagcatgaaggacgacctggagagagtgagacagctgggccacgccctgctggtgagactgcaggaggtgacccacagcgtgagaatcggcttcggcagcttcgtggacaagaccgtgctgcccttcgtgagcaccgtgcccagcaagctgagacacccctgccccaccagactggagagatgccagagccccttcagcttccaccacgtgctgagcctgaccggcgacgcccaggccttcgagagagaggtgggcagacagagcgtgagcggcaacctggacagccccgagggcggcttcgacgccatcctgcaggccgccctgtgccaggagcagatcggctggagaaacgtgagcagactgctggtgttcaccagcgacgacaccttccacaccgccggcgacggcaagctgggcggcatcttcatgcccagcgacggccactgccacctggacagcaacggcctgtacagcagaagcaccgagttcgactaccccagcgtgggccaggtggcccaggccctgagcgccgccaacatccagcccatcttcgccgtgaccagcgccgccctgcccgtgtaccaggagctgagcaagctgatccccaagagcgccgtgggcgagctgagcgaggacagcagcaacgtggtgcagctgatcatggacgcctacaacagcctgagcagcaccgtgaccctggagcacagcagcctgccccccggcgtgcacatcagctacgagagccagtgcgagggccccgagaagagagagggcaaggccgaggacagaggccagtgcaaccacgtgagaatcaaccagaccgtgaccttctgggtgagcctgcaggccacccactgcctgcccgagccccacctgctgagactgagagccctgggcttcagcgaggagctgatcgtggagctgcacaccctgtgcgactgcaactgcagcgacacccagccccaggccccccactgcagcgacggccagggccacctgcagtgcggcgtgtgcagctgcgcccccggcagactgggcagactgtgcgagtgcagcgtggccgagctgagcagccccgacctggagagcggctgcagagcccccaacggcaccggccccctgtgcagcggcaagggccactgccagtgcggcagatgcagctgcagcggccagagcagcggccacctgtgcgagtgcgacgacgccagctgcgagagacacgagggcatcctgtgcggcggcttcggcagatgccagtgcggcgtgtgccactgccacgccaacagaaccggcagagcctgcgagtgcagcggcgacatggacagctgcatcagccccgagggcggcctgtgcagcggccacggcagatgcaagtgcaacagatgccagtgcctggacggctactacggcgccctgtgcgaccagtgccccggctgcaagaccccctgcgagagacacagagactgcgccgagtgcggcgccttcagaaccggccccctggccaccaactgcagcaccgcctgcgcccacaccaacgtgaccctggccctggcccccatcctggacgacggctggtgcaaggagagaaccctggacaaccagctgttcttcttcctggtggaggacgacgccagaggcaccgtggtgctgagagtgagaccccaggagaagggcgccgaccacacccaggccatcgtgctgggctgcgtgggcggcatcgtggccgtgggcctgggcctggtgctggcctacagactgagcgtggagatctacgacagaagagagtacagcagattcgagaaggagcagcagcagctgaactggaagcaggacagcaaccccctgtacaagagcgccatcaccaccaccatcaaccccagattccaggaggccgacagccccaccctgtag

SEQ ID NO: 85389 - DNA, 1953 bp, Artificial Sequence
  Description of Artificial Sequence: Synthetic coding sequence
atggtggccctgcccatggtgctggtgctgctgctggtgctgagcagaggcgagagcgagctggacgccaagatccccagcaccggcgacgccaccgagtggagaaacccccacctgagcatgctgggcagctgccagcccgcccccagctgccagaagtgcatcctgagccaccccagctgcgcctggtgcaagcagctgaacttcaccgccagcggcgaggccgaggccagaagatgcgccagaagagaggagctgctggccagaggctgccccctggaggagctggaggagcccagaggccagcaggaggtgctgcaggaccagcccctgagccagggcgccagaggcgagggcgccacccagctggccccccagagagtgagagtgaccctgagacccggcgagccccagcagctgcaggtgagattcctgagagccgagggctaccccgtggacctgtactacctgatggacctgagctacagcatgaaggacgacctggagagagtgagacagctgggccacgccctgctggtgagactgcaggaggtgacccacagcgtgagaatcggcttcggcagcttcgtggacaagaccgtgctgcccttcgtgagcaccgtgcccagcaagctgagacacccctgccccaccagactggagagatgccagagccccttcagcttccaccacgtgctgagcctgaccggcgacgcccaggccttcgagagagaggtgggcagacagagcgtgagcggcaacctggacagccccgagggcggcttcgacgccatcctgcaggccgccctgtgccaggagcagatcggctggagaaacgtgagcagactgctggtgttcaccagcgacgacaccttccacaccgccggcgacggcaagctgggcggcatcttcatgcccagcgacggccactgccacctggacagcaacggcctgtacagcagaagcaccgagttcgactaccccagcgtgggccaggtggcccaggccctgagcgccgccaacatccagcccatcttcgccgtgaccagcgccgccctgcccgtgtaccaggagctgagcaagctgatccccaagagcgccgtgggcgagctgagcgaggacagcagcaacgtggtgcagctgatcatggacgcctacaacagcctgagcagcaccgtgaccctggagcacagcagcctgccccccggcgtgcacatcagctacgagagccagtgcgagggccccgagaagagagagggcaaggccgaggacagaggccagtgcaaccacgtgagaatcaaccagaccgtgaccttctgggtgagcctgcaggccacccactgcctgcccgagccccacctgctgagactgagagccctgggcttcagcgaggagctgatcgtggagctgcacaccctgtgcgactgcaactgcagcgacacccagccccaggccccccactgcagcgacggccagggccacctgcagtgcggcgtgtgcagagactgcgccgagtgcggcgccttcagaaccggccccctggccaccaactgcagcaccgcctgcgcccacaccaacgtgaccctggccctggcccccatcctggacgacggctggtgcaaggagagaaccctggacaaccagctgttcttcttcctggtggaggacgacgccagaggcaccgtggtgctgagagtgagaccccaggagaagggcgccgaccacacccaggccatcgtgctgggctgcgtgggcggcatcgtggccgtgggcctgggcctggtgctggcctacagactgagcgtggagatctacgacagaagagagtacagcagattcgagaaggagcagcagcagctgaactggaagcaggacagcaaccccctgtacaagagcgccatcaccaccaccatcaaccccagattccaggaggccgacagccccaccctgtag

SEQ ID NO: 85390 - DNA, 2397 bp, Artificial Sequence; identical to SEQ ID NO: 85388
  Description of Artificial Sequence: Synthetic coding sequence

SEQ ID NO: 85391 - DNA, 1206 bp, Artificial Sequence
  Description of Artificial Sequence: Synthetic coding sequence
atgaacctggtggccgtgatgggcgccttcaacaagggccacggcaagtgcgactgcggcaagtgcaagtgcgaccagggctggtacggcgacgcctgccagtaccccaccaactgcgacctgaccaagaagaagagcaaccagatgtgcaagaacagccaggacatcatctgcagcaacgccggcacctgccactgcggcagatgcaagtgcgacaacagcgacggcagcggcctggtgtacggcaagttctgcgagtgcgacgacagagagtgcatcgacgacgagaccgaggagatctgcggcggccacggcaagtgctactgcggcaactgctactgcaaggccggctggcacggcgacaagtgcgagttccagtgcgacatcaccccctgggagagcaagagaagatgcaccagccccgacggcaagatctgcagcaacagaggcacctgcgtgtgcggcgagtgcacctgccacgacgtggaccccaccggcgactggggcgacatccacggcgacacctgcgagtgcgacgagagagactgcagagccgtgtacgacagatacagcgacgacttctgcagcggccacggccagtgcaactgcggcagatgcgactgcaaggccggctggtacggcaagaagtgcgagcacccccagagctgcaccctgagcgccgaggagagcatcagaaagtgccagggcagcagcgacctgccctgcagcggcagaggcaagtgcgagtgcggcaagtgcacctgctacccccccggcgacagaagagtgtacggcaagacctgcgagtgcgacgacagaagatgcgaggacctggacggcgtggtgtgcggcggccacggcacctgcagctgcggcagatgcgtgtgcgagagaggctggttcggcaagctgtgccagcaccccagaaagtgcaacatgaccgaggagcagagcaagaacctgtgcgagagcgccgacggcatcctgtgcagcggcaagggcagctgccactgcggcaagtgcatctgcagcgccgaggagtggtacatcagcggcgagttctgcgactgcgacgacagagactgcgacaagcacgacggcctgatctgcaccggcaacggcatctgcagctgcggcaactgcgagtgctgggacggctggaacggcaacgcctgcgagatctggctgggcagcgagtacccctag

SEQ ID NO: 85392 - DNA, 1485 bp, Artificial Sequence
  Description of Artificial Sequence: Synthetic coding sequence
atgagaccccccggcttcagaaacttcctgctgctggccagcagcctgctgttcgccggcctgagcgccgtgccccagagcttcagccccagcctgagaagctggcccggcgccgcctgcagactgagcagagccgagagcgagagaagatgcagagcccccggccagccccccggcgccgccctgtgccacggcagaggcagatgcgactgcggcgtgtgcatctgccacgtgaccgagcccggcatgttcttcggccccctgtgcgagtgccacgagtgggtgtgcgagacctacgacggcagcacctgcgccggccacggcaagtgcgactgcggcaagtgcaagtgcgaccagggctggtacggcgacgcctgccagtaccccaccaactgcgacctgaccaagaagaagagcaaccagatgtgcaagaacagccaggacatcatctgcagcaacgccggcacctgccactgcggcagatgcaagtgcgacaacagcgacggcagcggcctggtgtacggcaagttctgcgagtgcgacgacagagagtgcatcgacgacgagaccgaggagatctgcggcggccacggcaagtgctactgcggcaactgctactgcaaggccggctggcacggcgacaagtgcgagttccagtgcgacatcaccccctgggagagcaagagaagatgcaccagccccgacggcaagatctgcagcaacagaggcacctgcgtgtgcggcgagtgcacctgccacgacgtggaccccaccggcgactggggcgacatccacggcgacacctgcgagtgcgacgagagagactgcagagccgtgtacgacagatacagcgacgacttctgcagcggccacggccagtgcaactgcggcagatgcgactgcaaggccggctggtacggcaagaagtgcgagcacccccagagctgcaccctgagcgccgaggagagcatcagaaagtgccagggcagcagcgacctgccctgcagcggcagaggcaagtgcgagtgcggcaagtgcacctgctacccccccggcgacagaagagtgtacggcaagacctgcgagtgcgacgacagaagatgcgaggacctggacggcgtggtgtgcggcggccacggcacctgcagctgcggcagatgcgtgtgcgagagaggctggttcggcaagctgtgccagcaccccagaaagtgcaacatgaccgaggagcagagcaagaacctgtgcgagagcgccgacggcatcctgtgcagcggcaagggcagctgccactgcggcaagtgcatctgcagcgccgaggagtggtacatcagcggcgagttctgcgactgcgacgacagagactgcgacaagcacgacggcctgatctgcaccggcaacggcatctgcagctgcggcaactgcgagtgctgggacggctggaacggcaacgcctgcgagatctggctgggcagcgagtacccctag

SEQ ID NO: 85393 - DNA, 1209 bp, Artificial Sequence
  Description of Artificial Sequence: Synthetic coding sequence
atgagcggctgcgccagacccaccaccggcgcccccgtgcaggccatggtgagcgtgaccggcaagtgcaagtgcgaccagggctggtacggcgacgcctgccagtaccccaccaactgcgacctgaccaagaagaagagcaaccagatgtgcaagaacagccaggacatcatctgcagcaacgccggcacctgccactgcggcagatgcaagtgcgacaacagcgacggcagcggcctggtgtacggcaagttctgcgagtgcgacgacagagagtgcatcgacgacgagaccgaggagatctgcggcggccacggcaagtgctactgcggcaactgctactgcaaggccggctggcacggcgacaagtgcgagttccagtgcgacatcaccccctgggagagcaagagaagatgcaccagccccgacggcaagatctgcagcaacagaggcacctgcgtgtgcggcgagtgcacctgccacgacgtggaccccaccggcgactggggcgacatccacggcgacacctgcgagtgcgacgagagagactgcagagccgtgtacgacagatacagcgacgacttctgcagcggccacggccagtgcaactgcggcagatgcgactgcaaggccggctggtacggcaagaagtgcgagcacccccagagctgcaccctgagcgccgaggagagcatcagaaagtgccagggcagcagcgacctgccctgcagcggcagaggcaagtgcgagtgcggcaagtgcacctgctacccccccggcgacagaagagtgtacggcaagacctgcgagtgcgacgacagaagatgcgaggacctggacggcgtggtgtgcggcggccacggcacctgcagctgcggcagatgcgtgtgcgagagaggctggttcggcaagctgtgccagcaccccagaaagtgcaacatgaccgaggagcagagcaagaacctgtgcgagagcgccgacggcatcctgtgcagcggcaagggcagctgccactgcggcaagtgcatctgcagcgccgaggagtggtacatcagcggcgagttctgcgactgcgacgacagagactgcgacaagcacgacggcctgatctgcaccggcaacggcatctgcagctgcggcaactgcgagtgctgggacggctggaacggcaacgcctgcgagatctggctgggcagcgagtacccctag

SEQ ID NO: 85394 - DNA, 1062 bp, Artificial Sequence
  Description of Artificial Sequence: Synthetic coding sequence
atgtgcaagaacagccaggacatcatctgcagcaacgccggcacctgccactgcggcagatgcaagtgcgacaacagcgacggcagcggcctggtgtacggcaagttctgcgagtgcgacgacagagagtgcatcgacgacgagaccgaggagatctgcggcggccacggcaagtgctactgcggcaactgctactgcaaggccggctggcacggcgacaagtgcgagttccagtgcgacatcaccccctgggagagcaagagaagatgcaccagccccgacggcaagatctgcagcaacagaggcacctgcgtgtgcggcgagtgcacctgccacgacgtggaccccaccggcgactggggcgacatccacggcgacacctgcgagtgcgacgagagagactgcagagccgtgtacgacagatacagcgacgacttctgcagcggccacggccagtgcaactgcggcagatgcgactgcaaggccggctggtacggcaagaagtgcgagcacccccagagctgcaccctgagcgccgaggagagcatcagaaagtgccagggcagcagcgacctgccctgcagcggcagaggcaagtgcgagtgcggcaagtgcacctgctacccccccggcgacagaagagtgtacggcaagacctgcgagtgcgacgacagaagatgcgaggacctggacggcgtggtgtgcggcggccacggcacctgcagctgcggcagatgcgtgtgcgagagaggctggttcggcaagctgtgccagcaccccagaaagtgcaacatgaccgaggagcagagcaagaacctgtgcgagagcgccgacggcatcctgtgcagcggcaagggcagctgccactgcggcaagtgcatctgcagcgccgaggagtggtacatcagcggcgagttctgcgactgcgacgacagagactgcgacaagcacgacggcctgatctgcaccggcaacggcatctgcagctgcggcaactgcgagtgctgggacggctggaacggcaacgcctgcgagatctggctgggcagcgagtacccctag

SEQ ID NO: 85395 - DNA, 1062 bp, Artificial Sequence; identical to SEQ ID NO: 85394
  Description of Artificial Sequence: Synthetic coding sequence

SEQ ID NO: 85396 - DNA, 903 bp, Artificial Sequence
  Description of Artificial Sequence: Synthetic coding sequence
atggccaactgcgagttcagccccgtgagcggcgacaagccctgctgcagactgagcagaagagcccagctgtgcctgggcgtgagcatcctggtgctgatcctggtggtggtgctggccgtggtggtgcccagatggagacagcagtggagcggccccggcaccaccaagagattccccgagaccgtgctggccagatgcgtgaagtacaccgagatccaccccgagatgagacacgtggactgccagagcgtgtgggacgccttcaagggcgccttcatcagcaagcacccctgcaacatcaccgaggaggactaccagcccctgatgaagctgggcacccagaccgtgccctgcaacaagatcctgctgtggagcagaatcaaggacctggcccaccagttcacccaggtgcagagagacatgttcaccctggaggacaccctgctgggctacctggccgacgacctgacctggtgcggcgagttcaacaccagcaagatcaactaccagagctgccccgactggagaaaggactgcagcaacaaccccgtgagcgtgttctggaagaccgtgagcagaagattcgccgaggccgcctgcgacgtggtgcacgtgatgctgaacggcagcagaagcaagatcttcgacaagaacagcaccttcggcagcgtggaggtgcacaacctgcagcccgagaaggtgcagaccctggaggcctgggtgatccacggcggcagagaggacagcagagacctgtgccaggaccccaccatcaaggagctggagagcatcatcagcaagagaaacatccagttcagctgcaagaacatctacagacccgacaagttcctgcagtgcgtgaagaaccccgaggacagcagctgcaccagcgagatctag

SEQ ID NO: 85397 - DNA, 942 bp, Artificial Sequence
  Description of Artificial Sequence: Synthetic coding sequence
atgaaccagctgagcttcctgctgttcctgatcgccaccaccagaggctggagcaccgacgaggccaacacctacttcaaggagtggacctgcagcagcagccccagcctgcccagaagctgcaaggagatcaaggacgagtgccccagcgccttcgacggcctgtacttcctgagaaccgagaacggcgtgatctaccagaccttctgcgacatgaccagcggcggcggcggctggaccctggtggccagcgtgcacgagaacgacatgagaggcaagtgcaccgtgggcgacagatggagcagccagcagggcagcaaggccgtgtaccccgagggcgacggcaactgggccaactacaacaccttcggcagcgccgaggccgccaccagcgacgactacaagaaccccggctactacgacatccaggccaaggacctgggcatctggcacgtgcccaacaagagccccatgcagcactggagaaacagcagcctgctgagatacagaaccgacaccggcttcctgcagaccctgggccacaacctgttcggcatctaccagaagtaccccgtgaagtacggcgagggcaagtgctggaccgacaacggccccgtgatccccgtggtgtacgacttcggcgacgcccagaagaccgccagctactacagcccctacggccagagagagttcaccgccggcttcgtgcagttcagagtgttcaacaacgagagagccgccaacgccctgtgcgccggcatgagagtgaccggctgcaacaccgagcaccactgcatcggcggcggcggctacttccccgaggccagcccccagcagtgcggcgacttcagcggcttcgactggagcggctacggcacccacgtgggctacagcagcagcagagagatcaccgaggccgccgtgctgctgttctacagatag

SEQ ID NO: 85398 - DNA, 978 bp, Artificial Sequence
  Description of Artificial Sequence: Synthetic coding sequence
atgctgagcatgctgagaaccatgaccagactgtgcttcctgctgttcttcagcgtggccaccagcggctgcagcgccgccgccgccagcagcctggagatgctgagcagagagttcgagacctgcgccttcagcttcagcagcctgcccagaagctgcaaggagatcaaggagagatgccacagcgccggcgacggcctgtacttcctgagaaccaagaacggcgtggtgtaccagaccttctgcgacatgaccagcggcggcggcggctggaccctggtggccagcgtgcacgagaacgacatgagaggcaagtgcaccgtgggcgacagatggagcagccagcagggcaacaaggccgactaccccgagggcgacggcaactgggccaactacaacaccttcggcagcgccgaggccgccaccagcgacgactacaagaaccccggctactacgacatccaggccaaggacctgggcatctggcacgtgcccaacaagagccccatgcagcactggagaaacagcgccctgctgagatacagaaccaacaccggcttcctgcagagactgggccacaacctgttcggcatctaccagaagtaccccgtgaagtacagaagcggcaagtgctggaacgacaacggccccgccatccccgtggtgtacgacttcggcgacgccaagaagaccgccagctactacagcccctacggccagagagagttcgtggccggcttcgtgcagttcagagtgttcaacaacgagagagccgccaacgccctgtgcgccggcatcaaggtgaccggctgcaacaccgagcaccactgcatcggcggcggcggcttcttcccccagggcaagcccagacagtgcggcgacttcagcgccttcgactgggacggctacggcacccacgtgaagagcagctgcagcagagagatcaccgaggccgccgtgctgctgttctacagatag

SEQ ID NO: 85399 - DNA, 2736 bp, Artificial Sequence
  Description of Artificial Sequence: Synthetic coding sequence
atggacggcgccatgggccccagaggcctgctgctgtgcatgtacctggtgagcctgctgatcctgcaggccatgcccgccctgggcagcgccaccggcagaagcaagagcagcgagaagagacaggccgtggacaccgccgtggacggcgtgttcatcagaagcctgaaggtgaactgcaaggtgaccagcagattcgcccactacgtggtgaccagccaggtggtgaacaccgccaacgaggccagagaggtggccttcgacctggagatccccaagaccgccttcatcagcgacttcgccgtgaccgccgacggcaacgccttcatcggcgacatcaaggacaaggtgaccgcctggaagcagtacagaaaggccgccatcagcggcgagaacgccggcctggtgagagccagcggcagaaccatggagcagttcaccatccacctgaccgtgaacccccagagcaaggtgaccttccagctgacctacgaggaggtgctgaagagaaaccacatgcagtacgagatcgtgatcaaggtgaagcccaagcagctggtgcaccacttcgagatcgacgtggacatcttcgagccccagggcatcagcaagctggacgcccaggccagcttcctgcccaaggagctggccgcccagaccatcaagaagagcttcagcggcaagaagggccacgtgctgttcagacccaccgtgagccagcagcagagctgccccacctgcagcaccagcctgctgaacggccacttcaaggtgacctacgacgtgagcagagacaagatctgcgacctgctggtggccaacaaccacttcgcccacttcttcgccccccagaacctgaccaacatgaacaagaacgtggtgttcgtgatcgacatcagcggcagcatgagaggccagaaggtgaagcagaccaaggaggccctgctgaagatcctgggcgacatgcagcccggcgactacttcgacctggtgctgttcggcaccagagtgcagagctggaagggcagcctggtgcaggccagcgaggccaacctgcaggccgcccaggacttcgtgagaggcttcagcctggacgaggccaccaacctgaacggcggcctgctgagaggcatcgagatcctgaaccaggtgcaggagagcctgcccgagctgagcaaccacgccagcatcctgatcatgctgaccgacggcgaccccaccgagggcgtgaccgacagaagccagatcctgaagaacgtgagaaacgccatcagaggcagattccccctgtacaacctgggcttcggccacaacgtggacttcaacttcctggaggtgatgagcatggagaacaacggcagagcccagagaatctacgaggaccacgacgccacccagcagctgcagggcttctacagccaggtggccaagcccctgctggtggacgtggacctgcagtacccccaggacgccgtgctggccctgacccagaaccaccacaagcagtactacgagggcagcgagatcgtggtggccggcagaatcgccgacaacaagcagagcagcttcaaggccgacgtgcaggcccacggcgagggccaggagttcagcatcacctgcctggtggacgaggaggagatgaagaagctgctgagagagagaggccacatgctggagaaccacgtggagagactgtgggcctacctgaccatccaggagctgctggccaagagaatgaaggtggacagagaggagagagccaacctgagcagccaggccctgcagatgagcctggactacggcttcgtgacccccctgaccagcatgagcatcagaggcatggccgaccaggacggcctgaagcccaccatcgacaagcccagcgaggacagcccccccctggagatgctgggccccagaagaaccttcgtgctgagcgccctgcagcccagccccacccacagcagcagcaacacccagagactgcccgacagagtgaccggcgtggacaccgacccccacttcatcatccacgtgccccagaaggaggacaccctgtgcttcaacatcaacgaggagcccggcgtgatcctgagcctggtgcaggaccccaacaccggcttcagcgtgaacggccagctgatcggcaacaaggccagaagccccggccagcacgacggcacctacttcggcagactgggcatcgccaaccccgccaccgacttccagctggaggtgaccccccagaacatcaccctgaaccccggcttcggcggccccgtgttcagctggagagaccaggccgtgctgagacaggacggcgtggtggtgaccatcaacaagaagagaaacctggtggtgagcgtggacgacggcggcaccttcgaggtggtgctgcacagagtgtggaagggcagcagcgtgcaccaggacttcctgggcttctacgtgctggacagccacagaatgagcgccagaacccacggcctgctgggccagttcttccaccccatcggcttcgaggtgagcgacatccaccccggcagcgaccccaccaagcccgacgccaccatggtggtgagaaacagaagactgaccgtgaccagaggcctgcagaaggactacagcaaggacccctggcacggcgccgaggtgagctgctggttcatccacaacaacggcgccggcctgatcgacggcgcctacaccgactacatcgtgcccgacatcttctag

SEQ ID NO: 85400 - DNA, 1872 bp, Artificial Sequence
  Description of Artificial Sequence: Synthetic coding sequence
atgaacaagaacgtggtgttcgtgatcgacatcagcggcagcatgagaggccagaaggtgaagcagaccaaggaggccctgctgaagatcctgggcgacatgcagcccggcgactacttcgacctggtgctgttcggcaccagagtgcagagctggaagggcagcctggtgcaggccagcgaggccaacctgcaggccgcccaggacttcgtgagaggcttcagcctggacgaggccaccaacctgaacggcggcctgctgagaggcatcgagatcctgaaccaggtgcaggagagcctgcccgagctgagcaaccacgccagcatcctgatcatgctgaccgacggcgaccccaccgagggcgtgaccgacagaagccagatcctgaagaacgtgagaaacgccatcagaggcagattccccctgtacaacctgggcttcggccacaacgtggacttcaacttcctggaggtgatgagcatggagaacaacggcagagcccagagaatctacgaggaccacgacgccacccagcagctgcagggcttctacagccaggtggccaagcccctgctggtggacgtggacctgcagtacccccaggacgccgtgctggccctgacccagaaccaccacaagcagtactacgagggcagcgagatcgtggtggccggcagaatcgccgacaacaagcagagcagcttcaaggccgacgtgcaggcccacggcgagggccaggagttcagcatcacctgcctggtggacgaggaggagatgaagaagctgctgagagagagaggccacatgctggagaaccacgtggagagactgtgggcctacctgaccatccaggagctgctggccaagagaatgaaggtggacagagaggagagagccaacctgagcagccaggccctgcagatgagcctggactacggcttcgtgacccccctgaccagcatgagcatcagaggcatggccgaccaggacggcctgaagcccaccatcgacaagcccagcgaggacagcccccccctggagatgctgggccccagaagaaccttcgtgctgagcgccctgcagcccagccccacccacagcagcagcaacacccagagactgcccgacagagtgaccggcgtggacaccgacccccacttcatcatccacgtgccccagaaggaggacaccctgtgcttcaacatcaacgaggagcccggcgtgatcctgagcctggtgcaggaccccaacaccggcttcagcgtgaacggccagctgatcggcaacaaggccagaagccccggccagcacgacggcacctacttcggcagactgggcatcgccaaccccgccaccgacttccagctggaggtgaccccccagaacatcaccctgaaccccggcttcggcggccccgtgttcagctggagagaccaggccgtgctgagacaggacggcgtggtggtgaccatcaacaagaagagaaacctggtggtgagcgtggacgacggcggcaccttcgaggtggtgctgcacagagtgtggaagggcagcagcgtgcaccaggacttcctgggcttctacgtgctggacagccacagaatgagcgccagaacccacggcctgctgggccagttcttccaccccatcggcttcgaggtgagcgacatccaccccggcagcgaccccaccaagcccgacgccaccatggtggtgagaaacagaagactgaccgtgaccagaggcctgcagaaggactacagcaaggacccctggcacggcgccgaggtgagctgctggttcatccacaacaacggcgccggcctgatcgacggcgcctacaccgactacatcgtgcccgacatcttctag

SEQ ID NO: 85401 - DNA, 2310 bp, Artificial Sequence
  Description of Artificial Sequence: Synthetic coding sequence
atggagcagttcaccatccacctgaccgtgaacccccagagcaaggtgaccttccagctgacctacgaggaggtgctgaagagaaaccacatgcagtacgagatcgtgatcaaggtgaagcccaagcagctggtgcaccacttcgagatcgacgtggacatcttcgagccccagggcatcagcaagctggacgcccaggccagcttcctgcccaaggagctggccgcccagaccatcaagaagagcttcagcggcaagaagggccacgtgctgttcagacccaccgtgagccagcagcagagctgccccacctgcagcaccagcctgctgaacggccacttcaaggtgacctacgacgtgagcagagacaagatctgcgacctgctggtggccaacaaccacttcgcccacttcttcgccccccagaacctgaccaacatgaacaagaacgtggtgttcgtgatcgacatcagcggcagcatgagaggccagaaggtgaagcagaccaaggaggccctgctgaagatcctgggcgacatgcagcccggcgactacttcgacctggtgctgttcggcaccagagtgcagagctggaagggcagcctggtgcaggccagcgaggccaacctgcaggccgcccaggacttcgtgagaggcttcagcctggacgaggccaccaacctgaacggcggcctgctgagaggcatcgagatcctgaaccaggtgcaggagagcctgcccgagctgagcaaccacgccagcatcctgatcatgctgaccgacggcgaccccaccgagggcgtgaccgacagaagccagatcctgaagaacgtgagaaacgccatcagaggcagattccccctgtacaacctgggcttcggccacaacgtggacttcaacttcctggaggtgatgagcatggagaacaacggcagagcccagagaatctacgaggaccacgacgccacccagcagctgcagggcttctacagccaggtggccaagcccctgctggtggacgtggacctgcagtacccccaggacgccgtgctggccctgacccagaaccaccacaagcagtactacgagggcagcgagatcgtggtggccggcagaatcgccgacaacaagcagagcagcttcaaggccgacgtgcaggcccacggcgagggccaggagttcagcatcacctgcctggtggacgaggaggagatgaagaagctgctgagagagagaggccacatgctggagaaccacgtggagagactgtgggcctacctgaccatccaggagctgctggccaagagaatgaaggtggacagagaggagagagccaacctgagcagccaggccctgcagatgagcctggactacggcttcgtgacccccctgaccagcatgagcatcagaggcatggccgaccaggacggcctgaagcccaccatcgacaagcccagcgaggacagcccccccctggagatgctgggccccagaagaaccttcgtgctgagcgccctgcagcccagccccacccacagcagcagcaacacccagagactgcccgacagagtgaccggcgtggacaccgacccccacttcatcatccacgtgccccagaaggaggacaccctgtgcttcaacatcaacgaggagcccggcgtgatcctgagcctggtgcaggaccccaacaccggcttcagcgtgaacggccagctgatcggcaacaaggccagaagccccggccagcacgacggcacctacttcggcagactgggcatcgccaaccccgccaccgacttccagctggaggtgaccccccagaacatcaccctgaaccccggcttcggcggccccgtgttcagctggagagaccaggccgtgctgagacaggacggcgtggtggtgaccatcaacaagaagagaaacctggtggtgagcgtggacgacggcggcaccttcgaggtggtgctgcacagagtgtggaagggcagcagcgtgcaccaggacttcctgggcttctacgtgctggacagccacagaatgagcgccagaacccacggcctgctgggccagttcttccaccccatcggcttcgaggtgagcgacatccaccccggcagcgaccccaccaagcccgacgccaccatggtggtgagaaacagaagactgaccgtgaccagaggcctgcagaaggactacagcaaggacccctggcacggcgccgaggtgagctgctggttcatccacaacaacggcgccggcctgatcgacggcgcctacaccgactacatcgtgcccgacatcttctag

SEQ ID NO: 85402 - DNA, 1938 bp, Artificial Sequence
  Description of Artificial Sequence: Synthetic coding sequence
atggacggcgccatgggccccagaggcctgctgctgtgcatgtacctggtgagcctgctgatcctgcaggccatgcccgccctgggcagcgccaccggcagaagcaagagcagcgagaagagacaggccgtggacaccgccgtggacggcgtgttcatcagaagcctgaaggtgaactgcaaggtgaccagcagattcgcccactacgtggtgaccagccaggtggtgaacaccgccaacgaggccagagaggtggccttcgacctggagatccccaagaccgccttcatcagcgacttcgccgtgaccgccgacggcaacgccttcatcggcgacatcaaggacaaggtgaccgcctggaagcagtacagaaaggccgccatcagcggcgagaacgccggcctggtgagagccagcggcagaaccatggagcagttcaccatccacctgaccgtgaacccccagagcaaggtgaccttccagctgacctacgaggaggtgctgaagagaaaccacatgcagtacgagatcgtgatcaaggtgaagcccaagcagctggtgcaccacttcgagatcgacgtggacatcttcgagccccagggcatcagcaagctggacgcccaggccagcttcctgcccaaggagctggccgcccagaccatcaagaagagcttcagcggcaagaagggccacgtgctgttcagacccaccgtgagccagcagcagagctgccccacctgcagcaccagcctgctgaacggccacttcaaggtgacctacgacgtgagcagagacaagatctgcgacctgctggtggccaacaaccacttcgcccacttcttcgccccccagaacctgaccaacatgaacaagaacgtggtgttcgtgatcgacatcagcggcagcatgagaggccagaaggtgaagcagaccaaggaggccctgctgaagatcctgggcgacatgcagcccggcgactacttcgacctggtgctgttcggcaccagagtgcagagctggaagggcagcctggtgcaggccagcgaggccaacctgcaggccgcccaggacttcgtgagaggcttcagcctggacgaggccaccaacctgaacggcggcctgctgagaggcatcgagatcctgaaccaggtgcaggagagcctgcccgagctgagcaaccacgccagcatcctgatcatgctgaccgacggcgaccccaccgagggcgtgaccgacagaagccagatcctgaagaacgtgagaaacgccatcagaggcagattccccctgtacaacctgggcttcggccacaacgtggacttcaacttcctggaggtgatgagcatggagaacaacggcagagcccagagaatctacgaggaccacgacgccacccagcagctgcagggcttctacagccaggtggccaagcccctgctggtggacgtggacctgcagtacccccaggacgccgtgctggccctgacccagaaccaccacaagcagtactacgagggcagcgagatcgtggtggccggcagaatcgccgacaacaagcagagcagcttcaaggccgacgtgcaggcccacggcgagggccaggagttcagcatcacctgcctggtggacgaggaggagatgaagaagctgctgagagagagaggccacatgctggagaaccacgtggagagactgtgggcctacctgaccatccaggagctgctggccaagagaatgaaggtggacagagaggagagagccaacctgagcagccaggccctgcagatgagcctggactacggcttcgtgacccccctgaccagcatgagcatcagaggcatggccgaccaggacggcctgaagcccaccatcgacaagcccagcctgcaccaccccagagcccccgagagaggccaccccgtgctgcagcaccagtag

SEQ ID NO: 85403 - DNA, 2841 bp, Artificial Sequence
  Description of Artificial Sequence: Synthetic coding sequence
atgaagagactgacctgcttcttcatctgcttcttcctgagcgaggtgagcggcttcgagatccccatcaacggcctgagcgagttcgtggactacgaggacctggtggagctggcccccggcaagttccagctggtggccgagaacagaagataccagagaagcctgcccggcgagagcgaggagatgatggaggaggtggaccaggtgaccctgtacagctacaaggtgcagagcaccatcaccagcagaatggccaccaccatgatccagagcaaggtggtgaacaacagcccccagccccagaacgtggtgttcgacgtgcagatccccaagggcgccttcatcagcaacttcagcatgaccgtggacggcaagaccttcagaagcagcatcaaggagaagaccgtgggcagagccctgtacgcccaggccagagccaagggcaagaccgccggcctggtgagaagcagcgccctggacatggagaacttcagaaccgaggtgaacgtgctgcccggcgccaaggtgcagttcgagctgcactaccaggaggtgaagtggagaaagctgggcagctacgagcacagaatctacctgcagcccggcagactggccaagcacctggaggtggacgtgtgggtgatcgagccccagggcctgagattcctgcacgtgcccgacaccttcgagggccacttcgacggcgtgcccgtgatcagcaagggccagcagaaggcccacgtgagcttcaagcccaccgtggcccagcagagaatctgccccaactgcagagagaccgccgtggacggcgagctggtggtgctgtacgacgtgaagagagaggagaaggccggcgagctggaggtgttcaacggctacttcgtgcacttcttcgcccccgacaacctggaccccatccccaagaacatcctgttcgtgatcgacgtgagcggcagcatgtggggcgtgaagatgaagcagaccgtggaggccatgaagaccatcctggacgacctgagagccgaggaccacttcagcgtgatcgacttcaaccagaacatcagaacctggagaaacgacctgatcagcgccaccaagacccaggtggccgacgccaagagatacatcgagaagatccagcccagcggcggcaccaacatcaacgaggccctgctgagagccatcttcatcctgaacgaggccaacaacctgggcctgctggaccccaacagcgtgagcctgatcatcctggtgagcgacggcgaccccaccgtgggcgagctgaagctgagcaagatccagaagaacgtgaaggagaacatccaggacaacatcagcctgttcagcctgggcatgggcttcgacgtggactacgacttcctgaagagactgagcaacgagaaccacggcatcgcccagagaatctacggcaaccaggacaccagcagccagctgaagaagttctacaaccaggtgagcacccccctgctgagaaacgtgcagttcaactacccccacaccagcgtgaccgacgtgacccagaacaacttccacaactacttcggcggcagcgagatcgtggtggccggcaagttcgaccccgccaagctggaccagatcgagagcgtgatcaccgccaccagcgccaacacccagctggtgctggagaccctggcccagatggacgacctgcaggacttcctgagcaaggacaagcacgccgaccccgacttcaccagaaagctgtgggcctacctgaccatcaaccagctgctggccgagagaagcctggcccccaccgccgccgccaagagaagaatcaccagaagcatcctgcagatgagcctggaccaccacatcgtgacccccctgaccagcctggtgatcgagaacgaggccggcgacgagagaatgctggccgacgcccccccccaggaccccagctgctgcagcggcgccctgtactacggcagcaaggtggtgcccgacagcacccccagctgggccaaccccagccccacccccgtgatcagcatgctggcccagggcagccaggtgctggagagcaccccccccccccacgtgatgagagtggagaacgacccccacttcatcatctacctgcccaagagccagaagaacatctgcttcaacatcgacagcgagcccggcaagatcctgaacctggtgagcgaccccgagagcggcatcgtggtgaacggccagctggtgggcgccaagaagcccaacaacggcaagctgagcacctacttcggcaagctgggcttctacttccagagcgaggacatcaagatcgagatcagcaccgagaccatcaccctgagccacggcagcagcaccttcagcctgagctggagcgacaccgcccaggtgaccaaccagagagtgcagatcagcgtgaagaaggagaaggtggtgaccatcaccctggacaaggagatgagcttcagcgtgctgctgcacagagtgtggaagaagcaccccgtgaacgtggacttcctgggcatctacatcccccccaccaacaagttcagccccaaggcccacggcctgatcggccagttcatgcaggagcccaagatccacatcttcaacgagagacccggcaaggaccccgagaagcccgaggccagcatggaggtgaagggccagaagctgatcatcaccagaggcctgcagaaggactacagaaccgacctggtgttcggcaccgacgtgacctgctggttcgtgcacaacagcggcaagggcttcatcgacggccactacaaggactacttcgtgccccagctgtacagcttcctgaagagaccctag

SEQ ID NO: 85404 - DNA, 2658 bp, Artificial Sequence
  Description of Artificial Sequence: Synthetic coding sequence
atggtggccctgagccacctgggcagcgccctgcagctgggcagcctgttccccagaagccccttcagactgctgggcaagagaagcctgcccgagggcgtggccaacggcatcgaggtgtacagcaccaagatcaacagcaaggtgaccagcagattcgcccacaacgtggtgaccatgagagccgtgaacagagccgacaccgccaaggaggtgagcttcgacgtggagctgcccaagaccgccttcatcaccaacttcaccctgaccatcgacggcgtgacctaccccggcaacgtgaaggagaaggaggtggccaagaagcagtacgagaaggccgtgagccagggcaagaccgccggcctggtgaaggccagcggcagaaagctggagaagttcaccgtgagcgtgaacgtggccgccggcagcaaggtgaccttcgagctgacctacgaggagctgctgaagagacacaagggcaagtacgagatgtacctgaaggtgcagcccaagcagctggtgaagcacttcgagatcgaggtggacatcttcgagccccagggcatcagcatgctggacgccgaggccagcttcatcaccaacgacctgctgggcagcgccctgaccaagagcttcagcggcaagaagggccacgtgagcttcaagcccagcctggaccagcagagaagctgccccacctgcaccgacagcctgctgaacggcgacttcaccatcacctacgacgtgaacagagagagccccggcaacgtgcagatcgtgaacggctacttcgtgcacttcttcgccccccagggcctgcccgtggtgcccaagaacgtggccttcgtgatcgacatcagcggcagcatggccggcagaaagctggagcagaccaaggaggccctgctgagaatcctggaggacatgcaggaggaggactacctgaacttcatcctgttcagcggcgacgtgagcacctggaaggagcacctggtgcaggccacccccgagaacctgcaggaggccagaaccttcgtgaagagcatggaggacaagggcatgaccaacatcaacgacggcctgctgagaggcatcagcatgctgaacaaggccagagaggagcacagaatccccgagagaagcaccagcatcgtgatcatgctgaccgacggcgacgccaacgtgggcgagagcagacccgagaagatccaggagaacgtgagaaacgccatcggcggcaagttccccctgtacaacctgggcttcggcaacaacctgaactacaacttcctggagaacatggccctggagaaccacggcttcgccagaagaatctacgaggacagcgacgccgacctgcagctgcagggcttctacgaggaggtggccaaccccctgctgaccggcgtggagatggagtaccccgagaacgccatcctggacctgacccagaacacctaccagcacttctacgacggcagcgagatcgtggtggccggcagactggtggacgaggacatgaacagcttcaaggccgacgtgaagggccacggcgccaccaacgacctgaccttcaccgaggaggtggacatgaaggagatggagaaggccctgcaggagagagactacatcttcggcaactacatcgagagactgtgggcctacctgaccatcgagcagctgctggagaagagaaagaacgcccacggcgaggagaaggagaacctgaccgccagagccctggacctgagcctgaagtaccacttcgtgacccccctgaccagcatggtggtgaccaagcccgaggacaacgaggacgagagagccatcgccgacaagcccggcgagggcttcagcgccacccccgtgagccccgccatgagctacctgaccagctaccagcccccccagaacccctactactacgtggacggcgacccccacttcatcatccagatccccgagaaggacgacgccctgtgcttcaacatcgacgaggcccccggcaccgtgctgagactgatccaggacgccgtgaccggcctgaccgtgaacggccagatcaccggcgacaagagaggcagccccgacagcaagaccagaaagacctacttcggcaagctgggcatcgccaacgcccagatggacttccaggtggaggtgaccaccgagaagatcaccctgtggaacagagccgtgcccagcaccttcagctggctggacaccgtgaccgtgacccaggacggcctgagcatgatgatcaacagaaagaacatggtggtgagcttcggcgacggcgtgaccttcgtggtggtgctgcaccaggtgtggaagaagcaccccgtgcacagagacttcctgggcttctacgtggtggacagccacagaatgagcgcccagacccacggcctgctgggccagttcttccagcccttcgacttcaaggtgagcgacatcagacccggcagcgaccccaccaagcccgacgccaccctggtggtgaagaaccaccagctgatcgtgaccagaggcagccagaaggactacagaaaggacgccagcatcggcaccaaggtggtgtgctggttcgtgcacaacaacggcgagggcctgatcgacggcgtgcacaccgactacatcgtgcccaacctgttctag

SEQ ID NO: 85405 - DNA, 2013 bp, Artificial Sequence
  Description of Artificial Sequence: Synthetic coding sequence
atggccttcgcctggtggccctgcctgatcctggccctgctgagcagcctggccgccagcggcttccccagaagccccttcagactgctgggcaagagaagcctgcccgagggcgtggccaacggcatcgaggtgtacagcaccaagatcaacagcaaggtgaccagcagattcgcccacaacgtggtgaccatgagagccgtgaacagagccgacaccgccaaggaggtgagcttcgacgtggagctgcccaagaccgccttcatcaccaacttcaccctgaccatcgacggcgtgacctaccccggcaacgtgaaggagaaggaggtggccaagaagcagtacgagaaggccgtgagccagggcaagaccgccggcctggtgaaggccagcggcagaaagctggagaagttcaccgtgagcgtgaacgtggccgccggcagcaaggtgaccttcgagctgacctacgaggagctgctgaagagacacaagggcaagtacgagatgtacctgaaggtgcagcccaagcagctggtgaagcacttcgagatcgaggtggacatcttcgagccccagggcatcagcatgctggacgccgaggccagcttcatcaccaacgacctgctgggcagcgccctgaccaagagcttcagcggcaagaagggccacgtgagcttcaagcccagcctggaccagcagagaagctgccccacctgcaccgacagcctgctgaacggcgacttcaccatcacctacgacgtgaacagagagagccccggcaacgtgcagatcgtgaacggctacttcgtgcacttcttcgccccccagggcctgcccgtggtgcccaagaacgtggccttcgtgatcgacatcagcggcagcatggccggcagaaagctggagcagaccaaggaggccctgctgagaatcctggaggacatgcaggaggaggactacctgaacttcatcctgttcagcggcgacgtgagcacctggaaggagcacctggtgcaggccacccccgagaacctgcaggaggccagaaccttcgtgaagagcatggaggacaagggcatgaccaacatcaacgacggcctgctgagaggcatcagcatgctgaacaaggccagagaggagcacagaatccccgagagaagcaccagcatcgtgatcatgctgaccgacggcgacgccaacgtgggcgagagcagacccgagaagatccaggagaacgtgagaaacgccatcggcggcaagttccccctgtacaacctgggcttcggcaacaacctgaactacaacttcctggagaacatggccctggagaaccacggcttcgccagaagaatctacgaggacagcgacgccgacctgcagctgcagggcttctacgaggaggtggccaaccccctgctgaccggcgtggagatggagtaccccgagaacgccatcctggacctgacccagaacacctaccagcacttctacgacggcagcgagatcgtggtggccggcagactggtggacgaggacatgaacagcttcaaggccgacgtgaagggccacggcgccaccaacgacctgaccttcaccgaggaggtggacatgaaggagatggagaaggccctgcaggagagagactacatcttcggcaactacatcgagagactgtgggcctacctgaccatcgagcagctgctggagaagagaaagaacgcccacggcgaggagaaggagaacctgaccgccagagccctggacctgagcctgaagtaccacttcgtgacccccctgaccagcatggtggtgaccaagcccgaggacaacgaggacgagagagccatcgccgacaagcccggcgagggcggcgacagccacaccggcgagcccagacacgtgctgcccgaccagctgcccgccagcagcaagcccctgctgctgtgcggcagaggcagccccctgcaccaccccaacagcggcgagagaagatgccccctgctgcagcacagatag

SEQ ID NO: 85406 - DNA, 2673 bp, Artificial Sequence
  Description of Artificial Sequence: Synthetic coding sequence
atggccttcgcctggtggccctgcctgatcctggccctgctgagcagcctggccgccagcggcttccccagaagccccttcagactgctgggcaagagaagcctgcccgagggcgtggccaacggcatcgaggtgtacagcaccaagatcaacagcaaggtgaccagcagattcgcccacaacgtggtgaccatgagagccgtgaacagagccgacaccgccaaggaggtgagcttcgacgtggagctgcccaagaccgccttcatcaccaacttcaccctgaccatcgacggcgtgacctaccccggcaacgtgaaggagaaggaggtggccaagaagcagtacgagaaggccgtgagccagggcaagaccgccggcctggtgaaggccagcggcagaaagctggagaagttcaccgtgagcgtgaacgtggccgccggcagcaaggtgaccttcgagctgacctacgaggagctgctgaagagacacaagggcaagtacgagatgtacctgaaggtgcagcccaagcagctggtgaagcacttcgagatcgaggtggacatcttcgagccccagggcatcagcatgctggacgccgaggccagcttcatcaccaacgacctgctgggcagcgccctgaccaagagcttcagcggcaagaagggccacgtgagcttcaagcccagcctggaccagcagagaagctgccccacctgcaccgacagcctgctgaacggcgacttcaccatcacctacgacgtgaacagagagagccccggcaacgtgcagatcgtgaacggctacttcgtgcacttcttcgccccccagggcctgcccgtggtgcccaagaacgtggccttcgtgatcgacatcagcggcagcatggccggcagaaagctggagcagaccaaggaggccctgctgagaatcctggaggacatgcaggaggaggactacctgaacttcatcctgttcagcggcgacgtgagcacctggaaggagcacctggtgcaggccacccccgagaacctgcaggaggccagaaccttcgtgaagagcatggaggacaagggcatgaccaacatcaacgacggcctgctgagaggcatcagcatgctgaacaaggccagagaggagcacagaatccccgagagaagcaccagcatcgtgatcatgctgaccgacggcgacgccaacgtgggcgagagcagacccgagaagatccaggagaacgtgagaaacgccatcggcggcaagttccccctgtacaacctgggcttcggcaacaacctgaactacaacttcctggagaacatggccctggagaaccacggcttcgccagaagaatctacgaggacagcgacgccgacctgcagctgcagggcttctacgaggaggtggccaaccccctgctgaccggcgtggagatggagtaccccgagaacgccatcctggacctgacccagaacacctaccagcacttctacgacggcagcgagatcgtggtggccggcagactggtggacgaggacatgaacagcttcaaggccgacgtgaagggccacggcgccaccaacgacctgaccttcaccgaggaggtggacatgaaggagatggagaaggccctgcaggagagagactacatcttcggcaactacatcgagagactgtgggcctacctgaccatcgagcagctgctggagaagagaaagaacgcccacggcgaggagaaggagaacctgaccgccagagccctggacctgagcctgaagtaccacttcgtgacccccctgaccagcatggtggtgaccaagcccgaggacaacgaggacgagagagccatcgccgacaagcccggcgaggacgccgaggccacccccgtgagccccgccatgagctacctgaccagctaccagcccccccagaacccctactactacgtggacggcgacccccacttcatcatccagatccccgagaaggacgacgccctgtgcttcaacatcgacgaggcccccggcaccgtgctgagactgatccaggacgccgtgaccggcctgaccgtgaacggccagatcaccggcgacaagagaggcagccccgacagcaagaccagaaagacctacttcggcaagctgggcatcgccaacgcccagatggacttccaggtggaggtgaccaccgagaagatcaccctgtggaacagagccgtgcccagcaccttcagctggctggacaccgtgaccgtgacccaggacggcctgagcatgatgatcaacagaaagaacatggtggtgagcttcggcgacggcgtgaccttcgtggtggtgctgcaccaggtgtggaagaagcaccccgtgcacagagacttcctgggcttctacgtggtggacagccacagaatgagcgcccagacccacggcctgctgggccagttcttccagcccttcgacttcaaggtgagcgacatcagacccggcagcgaccccaccaagcccgacgccaccctggtggtgaagaaccaccagctgatcgtgaccagaggcagccagaaggactacagaaaggacgccagcatcggcaccaaggtggtgtgctggttcgtgcacaacaacggcgagggcctgatcgacggcgtgcacaccgactacatcgtgcccaacctgttctag

SEQ ID NO: 85407 - DNA, 1977 bp, Artificial Sequence
  Description of Artificial Sequence: Synthetic coding sequence
atggccttcgcctggtggccctgcctgatcctggccctgctgagcagcctggccgccagcggcttccccagaagccccttcagactgctgggcaagagaagcctgcccgagggcgtggccaacggcatcgaggtgtacagcaccaagatcaacagcaaggtgaccagcagattcgcccacaacgtggtgaccatgagagccgtgaacagagccgacaccgccaaggaggtgagcttcgacgtggagctgcccaagaccgccttcatcaccaacttcaccctgaccatcgacggcgtgacctaccccggcaacgtgaaggagaaggaggtggccaagaagcagtacgagaaggccgtgagccagggcaagaccgccggcctggtgaaggccagcggcagaaagctggagaagttcaccgtgagcgtgaacgtggccgccggcagcaagagacacaagggcaagtacgagatgtacctgaaggtgcagcccaagcagctggtgaagcacttcgagatcgaggtggacatcttcgagccccagggcatcagcatgctggacgccgaggccagcttcatcaccaacgacctgctgggcagcgccctgaccaagagcttcagcggcaagaagggccacgtgagcttcaagcccagcctggaccagcagagaagctgccccacctgcaccgacagcctgctgaacggcgacttcaccatcacctacgacgtgaacagagagagccccggcaacgtgcagatcgtgaacggctacttcgtgcacttcttcgccccccagggcctgcccgtggtgcccaagaacgtggccttcgtgatcgacatcagcggcagcatggccggcagaaagctggagcagaccaaggaggccctgctgagaatcctggaggacatgcaggaggaggactacctgaacttcatcctgttcagcggcgacgtgagcacctggaaggagcacctggtgcaggccacccccgagaacctgcaggaggccagaaccttcgtgaagagcatggaggacaagggcatgaccaacatcaacgacggcctgctgagaggcatcagcatgctgaacaaggccagagaggagcacagaatccccgagagaagcaccagcatcgtgatcatgctgaccgacggcgacgccaacgtgggcgagagcagacccgagaagatccaggagaacgtgagaaacgccatcggcggcaagttccccctgtacaacctgggcttcggcaacaacctgaactacaacttcctggagaacatggccctggagaaccacggcttcgccagaagaatctacgaggacagcgacgccgacctgcagctgcagggcttctacgaggaggtggccaaccccctgctgaccggcgtggagatggagtaccccgagaacgccatcctggacctgacccagaacacctaccagcacttctacgacggcagcgagatcgtggtggccggcagactggtggacgaggacatgaacagcttcaaggccgacgtgaagggccacggcgccaccaacgacctgaccttcaccgaggaggtggacatgaaggagatggagaaggccctgcaggagagagactacatcttcggcaactacatcgagagactgtgggcctacctgaccatcgagcagctgctggagaagagaaagaacgcccacggcgaggagaaggagaacctgaccgccagagccctggacctgagcctgaagtaccacttcgtgacccccctgaccagcatggtggtgaccaagcccgaggacaacgaggacgagagagccatcgccgacaagcccggcgagggcggcgacagccacaccggcgagcccagacacgtgctgcccgaccagctgcccgccagcagcaagcccctgctgctgtgcggcagaggcagccccctgcaccaccccaacagcggcgagagaagatgccccctgctgcagcacagatag

SEQ ID NO: 85408 - DNA, 2793 bp, Artificial Sequence
  Description of Artificial Sequence: Synthetic coding sequence
atgaagccccccagacccgtgagaacctgcagcaaggtgctggtgctgctgagcctgctggccatccaccagaccaccaccgccgagaagaacggcatcgacatctacagcctgaccgtggacagcagagtgagcagcagattcgcccacaccgtggtgaccagcagagtggtgaacagagccaacaccgtgcaggaggccaccttccagatggagctgcccaagaaggccttcatcaccaacttcagcatgatcatcgacggcatgacctaccccggcatcatcaaggagaaggccgaggcccaggcccagtacagcgccgccgtggccaagggcaagagcgccggcctggtgaaggccaccggcagaaacatggagcagttccaggtgagcgtgagcgtggcccccaacgccaagatcaccttcgagctggtgtacgaggagctgctgaagagaagactgggcgtgtacgagctgctgctgaaggtgagaccccagcagctggtgaagcacctgcagatggacatccacatcttcgagccccagggcatcagcttcctggagaccgagagcaccttcatgaccaaccagctggtggacgccctgaccacctggcagaacaagaccaaggcccacatcagattcaagcccaccctgagccagcagcagaagagccccgagcagcaggagaccgtgctggacggcaacctgatcatcagatacgacgtggacagagccatcagcggcggcagcatccagatcgagaacggctacttcgtgcactacttcgcccccgagggcctgaccaccatgcccaagaacgtggtgttcgtgatcgacaagagcggcagcatgagcggcagaaagatccagcagaccagagaggccctgatcaagatcctggacgacctgagccccagagaccagttcaacctgatcgtgttcagcaccgaggccacccagtggagacccagcctggtgcccgccagcgccgagaacgtgaacaaggccagaagcttcgccgccggcatccaggccctgggcggcaccaacatcaacgacgccatgctgatggccgtgcagctgctggacagcagcaaccaggaggagagactgcccgagggcagcgtgagcctgatcatcctgctgaccgacggcgaccccaccgtgggcgagaccaaccccagaagcatccagaacaacgtgagagaggccgtgagcggcagatacagcctgttctgcctgggcttcggcttcgacgtgagctacgccttcctggagaagctggccctggacaacggcggcctggccagaagaatccacgaggacagcgacagcgccctgcagctgcaggacttctaccaggaggtggccaaccccctgctgaccgccgtgaccttcgagtaccccagcaacgccgtggaggaggtgacccagaacaacttcagactgctgttcaagggcagcgagatggtggtggccggcaagctgcaggacagaggccccgacgtgctgaccgccaccgtgagcggcaagctgcccacccagaacatcaccttccagaccgagagcagcgtggccgagcaggaggccgagttccagagccccaagtacatcttccacaacttcatggagagactgtgggcctacctgaccatccagcagctgctggagcagaccgtgagcgccagcgacgccgaccagcaggccctgagaaaccaggccctgaacctgagcctggcctacagcttcgtgacccccctgaccagcatggtggtgaccaagcccgacgaccaggagcagagccaggtggccgagaagcccatggagggcgagagcagaaacagaaacgtgcacagcggcagcaccttcttcaagtactacctgcagggcgccaagatccccaagcccgaggccagcttcagccccagaagaggctggaacagacaggccggcgccgccggcagcagaatgaacttcagacccggcgtgctgagcagcagacagctgggcctgcccggcccccccgacgtgcccgaccacgccgcctaccaccccttcagaagactggccatcctgcccgccagcgccccccccgccaccagcaaccccgaccccgccgtgagcagagtgatgaacatgaagatcgaggagaccaccatgaccacccagacccccgcccccatccaggcccccagcgccatcctgcccctgcccggccagagcgtggagagactgtgcgtggaccccagacacagacagggccccgtgaacctgctgagcgaccccgagcagggcgtggaggtgaccggccagtacgagagagagaaggccggcttcagctggatcgaggtgaccttcaagaaccccctggtgtgggtgcacgccagccccgagcacgtggtggtgaccagaaacagaagaagcagcgcctacaagtggaaggagaccctgttcagcgtgatgcccggcctgaagatgaccatggacaagaccggcctgctgctgctgagcgaccccgacaaggtgaccatcggcctgctgttctgggacggcagaggcgagggcctgagactgctgctgagagacaccgacagattcagcagccacgtgggcggcaccctgggccagttctaccaggaggtgctgtggggcagccccgccgccagcgacgacggcagaagaaccctgagagtgcagggcaacgaccacagcgccaccagagagagaagactggactaccaggagggcccccccggcgtggagatcagctgctggagcgtggagctgtag

SEQ ID NO: 85409 - DNA, 2745 bp, Artificial Sequence
  Description of Artificial Sequence: Synthetic coding sequence
atgaagccccccagacccgtgagaacctgcagcaaggtgctggtgctgctgagcctgctggccatccaccagaccaccaccgccgagaagaacggcatcgacatctacagcctgaccgtggacagcagagtgagcagcagattcgcccacaccgtggtgaccagcagagtggtgaacagagccaacaccgtgcaggaggccaccttccagatggagctgcccaagaaggccttcatcaccaacttcagcatgatcatcgacggcatgacctaccccggcatcatcaaggagaaggccgaggcccaggcccagtacagcgccgccgtggccaagggcaagagcgccggcctggtgaaggccaccggcagaaacatggagcagttccaggtgagcgtgagcgtggcccccaacgccaagatcaccttcgagctggtgtacgaggagctgctgaagagaagactgggcgtgtacgagctgctgctgaaggtgagaccccagcagctggtgaagcacctgcagatggacatccacatcttcgagccccagggcatcagcttcctggagaccgagagcaccttcatgaccaaccagctggtggacgccctgaccacctggcagaacaagaccaaggcccacatcagattcaagcccaccctgagccagcagcagaagagccccgagcagcaggagaccgtgctggacggcaacctgatcatcagatacgacgtggacagagccatcagcggcggcagcatccagatcgagaacggctacttcgtgcactacttcgcccccgagggcctgaccaccatgcccaagaacgtggtgttcgtgatcgacaagagcggcagcatgagcggcagaaagatccagcagaccagagaggccctgatcaagatcctggacgacctgagccccagagaccagttcaacctgatcgtgttcagcaccgaggccacccagtggagacccagcctggtgcccgccagcgccgagaacgtgaacaaggccagaagcttcgccgccggcatccaggccctgggcggcaccaacatcaacgacgccatgctgatggccgtgcagctgctggacagcagcaaccaggaggagagactgcccgagggcagcgtgagcctgatcatcctgctgaccgacggcgaccccaccgtgggcgagaccaaccccagaagcatccagaacaacgtgagagaggccgtgagcggcagatacagcctgttctgcctgggcttcggcttcgacgtgagctacgccttcctggagaagctggccctggacaacggcggcctggccagaagaatccacgaggacagcgacagcgccctgcagctgcaggacttctaccaggaggtggccaaccccctgctgaccgccgtgaccttcgagtaccccagcaacgccgtggaggaggtgacccagaacaacttcagactgctgttcaagggcagcgagatggtggtggccggcaagctgcaggacagaggccccgacgtgctgaccgccaccgtgagcggcaagctgcccacccagaacatcaccttccagaccgagagcagcgtggccgagcaggaggccgagttccagagccccaagtacatcttccacaacttcatggagagactgtgggcctacctgaccatccagcagctgctggagcagaccgtgagcgccagcgacgccgaccagcaggccctgagaaaccaggccctgaacctgagcctggcctacagcttcgtgacccccctgaccagcatggtggtgaccaagcccgacgaccaggagcagagccaggtggccgagaagcccatggagggcgagagcagaaacagaaacgtgcacagcgccggcgccgccggcagcagaatgaacttcagacccggcgtgctgagcagcagacagctgggcctgcccggcccccccgacgtgcccgaccacgccgcctaccaccccttcagaagactggccatcctgcccgccagcgccccccccgccaccagcaaccccgaccccgccgtgagcagagtgatgaacatgaagatcgaggagaccaccatgaccacccagacccccgcctgccccagctgcagcagaagcagagcccccgccgtgcccgcccccatccaggcccccagcgccatcctgcccctgcccggccagagcgtggagagactgtgcgtggaccccagacacagacagggccccgtgaacctgctgagcgaccccgagcagggcgtggaggtgaccggccagtacgagagagagaaggccggcttcagctggatcgaggtgaccttcaagaaccccctggtgtgggtgcacgccagccccgagcacgtggtggtgaccagaaacagaagaagcagcgcctacaagtggaaggagaccctgttcagcgtgatgcccggcctgaagatgaccatggacaagaccggcctgctgctgctgagcgaccccgacaaggtgaccatcggcctgctgttctgggacggcagaggcgagggcctgagactgctgctgagagacaccgacagattcagcagccacgtgggcggcaccctgggccagttctaccaggaggtgctgtggggcagccccgccgccagcgacgacggcagaagaaccctgagagtgcagggcaacgaccacagcgccaccagagagagaagactggactaccaggagggcccccccggcgtggagatcagctgctggagcgtggagctgtag

SEQ ID NO: 85410 - DNA, 2703 bp, Artificial Sequence
  Description of Artificial Sequence: Synthetic coding sequence
atgaagccccccagacccgtgagaacctgcagcaaggtgctggtgctgctgagcctgctggccatccaccagaccaccaccgccgagaagaacggcatcgacatctacagcctgaccgtggacagcagagtgagcagcagattcgcccacaccgtggtgaccagcagagtggtgaacagagccaacaccgtgcaggaggccaccttccagatggagctgcccaagaaggccttcatcaccaacttcagcatgatcatcgacggcatgacctaccccggcatcatcaaggagaaggccgaggcccaggcccagtacagcgccgccgtggccaagggcaagagcgccggcctggtgaaggccaccggcagaaacatggagcagttccaggtgagcgtgagcgtggcccccaacgccaagatcaccttcgagctggtgtacgaggagctgctgaagagaagactgggcgtgtacgagctgctgctgaaggtgagaccccagcagctggtgaagcacctgcagatggacatccacatcttcgagccccagggcatcagcttcctggagaccgagagcaccttcatgaccaaccagctggtggacgccctgaccacctggcagaacaagaccaaggcccacatcagattcaagcccaccctgagccagcagcagaagagccccgagcagcaggagaccgtgctggacggcaacctgatcatcagatacgacgtggacagagccatcagcggcggcagcatccagatcgagaacggctacttcgtgcactacttcgcccccgagggcctgaccaccatgcccaagaacgtggtgttcgtgatcgacaagagcggcagcatgagcggcagaaagatccagcagaccagagaggccctgatcaagatcctggacgacctgagccccagagaccagttcaacctgatcgtgttcagcaccgaggccacccagtggagacccagcctggtgcccgccagcgccgagaacgtgaacaaggccagaagcttcgccgccggcatccaggccctgggcggcaccaacatcaacgacgccatgctgatggccgtgcagctgctggacagcagcaaccaggaggagagactgcccgagggcagcgtgagcctgatcatcctgctgaccgacggcgaccccaccgtgggcgagaccaaccccagaagcatccagaacaacgtgagagaggccgtgagcggcagatacagcctgttctgcctgggcttcggcttcgacgtgagctacgccttcctggagaagctggccctggacaacggcggcctggccagaagaatccacgaggacagcgacagcgccctgcagctgcaggacttctaccaggaggtggccaaccccctgctgaccgccgtgaccttcgagtaccccagcaacgccgtggaggaggtgacccagaacaacttcagactgctgttcaagggcagcgagatggtggtggccggcaagctgcaggacagaggccccgacgtgctgaccgccaccgtgagcggcaagctgcccacccagaacatcaccttccagaccgagagcagcgtggccgagcaggaggccgagttccagagccccaagtacatcttccacaacttcatggagagactgtgggcctacctgaccatccagcagctgctggagcagaccgtgagcgccagcgacgccgaccagcaggccctgagaaaccaggccctgaacctgagcctggcctacagcttcgtgacccccctgaccagcatggtggtgaccaagcccgacgaccaggagcagagccaggtggccgagaagcccatggagggcgagagcagaaacagaaacgtgcacagcgccggcgccgccggcagcagaatgaacttcagacccggcgtgctgagcagcagacagctgggcctgcccggcccccccgacgtgcccgaccacgccgcctaccaccccttcagaagactggccatcctgcccgccagcgccccccccgccaccagcaaccccgaccccgccgtgagcagagtgatgaacatgaagatcgaggagaccaccatgaccacccagacccccgcccccatccaggcccccagcgccatcctgcccctgcccggccagagcgtggagagactgtgcgtggaccccagacacagacagggccccgtgaacctgctgagcgaccccgagcagggcgtggaggtgaccggccagtacgagagagagaaggccggcttcagctggatcgaggtgaccttcaagaaccccctggtgtgggtgcacgccagccccgagcacgtggtggtgaccagaaacagaagaagcagcgcctacaagtggaaggagaccctgttcagcgtgatgcccggcctgaagatgaccatggacaagaccggcctgctgctgctgagcgaccccgacaaggtgaccatcggcctgctgttctgggacggcagaggcgagggcctgagactgctgctgagagacaccgacagattcagcagccacgtgggcggcaccctgggccagttctaccaggaggtgctgtggggcagccccgccgccagcgacgacggcagaagaaccctgagagtgcagggcaacgaccacagcgccaccagagagagaagactggactaccaggagggcccccccggcgtggagatcagctgctggagcgtggagctgtag

SEQ ID NO: 85411 - DNA, 1683 bp, Artificial Sequence
  Description of Artificial Sequence: Synthetic coding sequence
atgacctaccccggcatcatcaaggagaaggccgaggcccaggcccagtacagcgccgccgtggccaagggcaagagcgccggcctggtgaaggccaccggcagaaacatggagcagttccaggtgagcgtgagcgtggcccccaacgccaagatcaccttcgagctggtgtacgaggagctgctgaagagaagactgggcgtgtacgagctgctgctgaaggtgagaccccagcagctggtgaagcacctgcagatggacatccacatcttcgagccccagggcatcagcttcctggagaccgagagcaccttcatgaccaaccagctggtggacgccctgaccacctggcagaacaagaccaaggcccacatcagattcaagcccaccctgagccagcagcagaagagccccgagcagcaggagaccgtgctggacggcaacctgatcatcagatacgacgtggacagagccatcagcggcggcagcatccagatcgagaacggctacttcgtgcactacttcgcccccgagggcctgaccaccatgcccaagaacgtggtgttcgtgatcgacaagagcggcagcatgagcggcagaaagatccagcagaccagagaggccctgatcaagatcctggacgacctgagccccagagaccagttcaacctgatcgtgttcagcaccgaggccacccagtggagacccagcctggtgcccgccagcgccgagaacgtgaacaaggccagaagcttcgccgccggcatccaggccctgggcggcaccaacatcaacgacgccatgctgatggccgtgcagctgctggacagcagcaaccaggaggagagactgcccgagggcagcgtgagcctgatcatcctgctgaccgacggcgaccccaccgtgggcgagaccaaccccagaagcatccagaacaacgtgagagaggccgtgagcggcagatacagcctgttctgcctgggcttcggcttcgacgtgagctacgccttcctggagaagctggccctggacaacggcggcctggccagaagaatccacgaggacagcgacagcgccctgcagctgcaggacttctaccaggaggtggccaaccccctgctgaccgccgtgaccttcgagtaccccagcaacgccgtggaggaggtgacccagaacaacttcagactgctgttcaagggcagcgagatggtggtggccggcaagctgcaggacagaggccccgacgtgctgaccgccaccgtgagcggcaagctgcccacccagaacatcaccttccagaccgagagcagcgtggccgagcaggaggccgagttccagagccccaagtacatcttccacaacttcatggagagactgtgggcctacctgaccatccagcagctgctggagcagaccgtgagcgccagcgacgccgaccagcaggccctgagaaaccaggccctgaacctgagcctggcctacagcttcgtgacccccctgaccagcatggtggtgaccaagcccgacgaccaggagcagagccaggtggccgagaagcccatggagggcgagagcagaaacagaaacgtgcacagcggcagcaccttcttcaagtactacctgcagggcgccaagatccccaagcccggcgacaaggtgggcggcggcggcagaggcgactag

SEQ ID NO: 85412 - DNA, 2667 bp, Artificial Sequence
  Description of Artificial Sequence: Synthetic coding sequence
atgaagccccccagacccgtgagaacctgcagcaaggtgctggtgctgctgagcctgctggccatccaccagaccaccaccgccgagaagaacggcatcgacatctacagcctgaccgtggacagcagagtgagcagcagattcgcccacaccgtggtgaccagcagagtggtgaacagagccaacaccgtgcaggaggccaccttccagatggagctgcccaagaaggccttcatcaccaacttcagcatgatcatcgacggcatgacctaccccggcatcatcaaggagaaggccgaggcccaggcccagtacagcgccgccgtggccaagggcaagagcgccggcctggtgaaggccaccggcagaaacatggagcagttccaggtgagcgtgagcgtggcccccaacgccaagagaagactgggcgtgtacgagctgctgctgaaggtgagaccccagcagctggtgaagcacctgcagatggacatccacatcttcgagccccagggcatcagcttcctggagaccgagagcaccttcatgaccaaccagctggtggacgccctgaccacctggcagaacaagaccaaggcccacatcagattcaagcccaccctgagccagcagcagaagagccccgagcagcaggagaccgtgctggacggcaacctgatcatcagatacgacgtggacagagccatcagcggcggcagcatccagatcgagaacggctacttcgtgcactacttcgcccccgagggcctgaccaccatgcccaagaacgtggtgttcgtgatcgacaagagcggcagcatgagcggcagaaagatccagcagaccagagaggccctgatcaagatcctggacgacctgagccccagagaccagttcaacctgatcgtgttcagcaccgaggccacccagtggagacccagcctggtgcccgccagcgccgagaacgtgaacaaggccagaagcttcgccgccggcatccaggccctgggcggcaccaacatcaacgacgccatgctgatggccgtgcagctgctggacagcagcaaccaggaggagagactgcccgagggcagcgtgagcctgatcatcctgctgaccgacggcgaccccaccgtgggcgagaccaaccccagaagcatccagaacaacgtgagagaggccgtgagcggcagatacagcctgttctgcctgggcttcggcttcgacgtgagctacgccttcctggagaagctggccctggacaacggcggcctggccagaagaatccacgaggacagcgacagcgccctgcagctgcaggacttctaccaggaggtggccaaccccctgctgaccgccgtgaccttcgagtaccccagcaacgccgtggaggaggtgacccagaacaacttcagactgctgttcaagggcagcgagatggtggtggccggcaagctgcaggacagaggccccgacgtgctgaccgccaccgtgagcggcaagctgcccacccagaacatcaccttccagaccgagagcagcgtggccgagcaggaggccgagttccagagccccaagtacatcttccacaacttcatggagagactgtgggcctacctgaccatccagcagctgctggagcagaccgtgagcgccagcgacgccgaccagcaggccctgagaaaccaggccctgaacctgagcctggcctacagcttcgtgacccccctgaccagcatggtggtgaccaagcccgacgaccaggagcagagccaggtggccgagaagcccatggagggcgagagcagaaacagaaacgtgcacagcgccggcgccgccggcagcagaatgaacttcagacccggcgtgctgagcagcagacagctgggcctgcccggcccccccgacgtgcccgaccacgccgcctaccaccccttcagaagactggccatcctgcccgccagcgccccccccgccaccagcaaccccgaccccgccgtgagcagagtgatgaacatgaagatcgaggagaccaccatgaccacccagacccccgcccccatccaggcccccagcgccatcctgcccctgcccggccagagcgtggagagactgtgcgtggaccccagacacagacagggccccgtgaacctgctgagcgaccccgagcagggcgtggaggtgaccggccagtacgagagagagaaggccggcttcagctggatcgaggtgaccttcaagaaccccctggtgtgggtgcacgccagccccgagcacgtggtggtgaccagaaacagaagaagcagcgcctacaagtggaaggagaccctgttcagcgtgatgcccggcctgaagatgaccatggacaagaccggcctgctgctgctgagcgaccccgacaaggtgaccatcggcctgctgttctgggacggcagaggcgagggcctgagactgctgctgagagacaccgacagattcagcagccacgtgggcggcaccctgggccagttctaccaggaggtgctgtggggcagccccgccgccagcgacgacggcagaagaaccctgagagtgcagggcaacgaccacagcgccaccagagagagaagactggactaccaggagggcccccccggcgtggagatcagctgctggagcgtggagctgtag

SEQ ID NO: 85413 - DNA, 2871 bp, Artificial Sequence
  Description of Artificial Sequence: Synthetic coding sequence
atgctgctgctgctgggcctgtgcctgggcctgagcctgtgcgtgggcagccaggaggaggcccagagctggggccacagcagcgagcaggacggcctgagagtgcccagacaggtgagactgctgcagagactgaagaccaagcccctgatgaccgagttcagcgtgaagagcaccatcatcagcagatacgccttcaccaccgtgagctgcagaatgctgaacagagccagcgaggaccaggacatcgagttccagatgcagatccccgccgccgccttcatcaccaacttcaccatgctgatcggcgacaaggtgtaccagggcgagatcaccgagagagagaagaagagcggcgacagagtgaaggagaagagaaacaagaccaccgaggagaacggcgagaagggcaccgagatcttcagagccagcgccgtgatccccagcaaggacaaggccgccttcttcctgagctacgaggagctgctgcagagaagactgggcaagtacgagcacagcatcagcgtgagaccccagcagctgagcggcagactgagcgtggacgtgaacatcctggagagcgccggcatcgccagcctggaggtgctgcccctgcacaacagcagacagagaggcagcggcagaggcgaggacgacagcggccccccccccagcaccgtgatcaaccagaacgagaccttcgccaacatcatcttcaagcccaccgtggtgcagcaggccagaatcgcccagaacggcatcctgggcgacttcatcatcagatacgacgtgaacagagagcagagcatcggcgacatccaggtgctgaacggctacttcgtgcactacttcgcccccaaggacctgccccccctgcccaagaacgtggtgttcgtgctggacagcagcgccagcatggtgggcaccaagctgagacagaccaaggacgccctgttcaccatcctgcacgacctgagaccccaggacagattcagcatcatcggcttcagcaacagaatcaaggtgtggaaggaccacctgatcagcgtgacccccgacagcatcagagacggcaaggtgtacatccaccacatgagccccaccggcggcaccgacatcaacggcgccctgcagagagccatcagactgctgaacaagtacgtggcccacagcggcatcggcgacagaagcgtgagcctgatcgtgttcctgaccgacggcaagcccaccgtgggcgagacccacaccctgaagatcctgaacaacaccagagaggccgccagaggccaggtgtgcatcttcaccatcggcatcggcaacgacgtggacttcagactgctggagaagctgagcctggagaactgcggcctgaccagaagagtgcacgaggaggaggacgccggcagccagctgatcggcttctacgacgagatcagaacccccctgctgagcgacatcagaatcgactacccccccagcagcgtggtgcaggccaccaagaccctgttccccaactacttcaacggcagcgagatcatcatcgccggcaagctggtggacagaaagctggaccacctgcacgtggaggtgaccgccagcaacagcaagaagttcatcatcctgaagaccgacgtgcccgtgagaccccagaaggccggcaaggacgtgaccggcagccccagacccggcggcgacggcgagggcgacaccaaccacatcgagagactgtggagctacctgaccaccaaggagctgctgagcagctggctgcagagcgacgacgagcccgagaaggagagactgagacagagagcccaggccctggccgtgagctacagattcctgacccccttcaccagcatgaagctgagaggccccgtgcccagaatggacggcctggaggaggcccacggcatgagcgccgccatgggccccgagcccgtggtgcagagcgtgagaggcgccggcacccagcccggccccctgctgaagaagccctaccagcccagaatcaagatcagcaagaccagcgtggacggcgacccccacttcgtggtggacttccccctgagcagactgaccgtgtgcttcaacatcgacggccagcccggcgacatcctgagactggtgagcgaccacagagacagcggcgtgaccgtgaacggcgagctgatcggcgcccccgccccccccaacggccacaagaagcagagaacctacctgagaaccatcaccatcctgatcaacaagcccgagagaagctacctggagatcacccccagcagagtgatcctggacggcggcgacagactggtgctgccctgcaaccagagcgtggtggtgggcagctggggcctggaggtgagcgtgagcgccaacgccaacgtgaccgtgaccatccagggcagcatcgccttcgtgatcctgatccacctgtacaagaagcccgcccccttccagagacaccacctgggcttctacatcgccaacagcgagggcctgagcagcaactgccacggcctgctgggccagttcctgaaccaggacgccagactgaccgaggaccccgccggccccagccagaacctgacccaccccctgctgctgcaggtgggcgagggccccgaggccgtgctgaccgtgaagggccaccaggtgcccgtggtgtggaagcagagaaagatctacaacggcgaggagcagatcgactgctggttcgccagaaacaacgccgccaagctgatcgacggcgagtacaaggactacctggccttccaccccttcgacaccggcatggacacctggcccggcaacgtgcagggcgccctgaagctggccgccctgaagatgcaggtgcacgagggccagtag

SEQ ID NO: 85414 - DNA, 2229 bp, Artificial Sequence
  Description of Artificial Sequence: Synthetic coding sequence
atgagaaactacgacagcggccccccccccagcaccgtgatcaaccagaacgagaccttcgccaacatcatcttcaagcccaccgtggtgcagcaggccagaatcgcccagaacggcatcctgggcgacttcatcatcagatacgacgtgaacagagagcagagcatcggcgacatccaggtgctgaacggctacttcgtgcactacttcgcccccaaggacctgccccccctgcccaagaacgtggtgttcgtgctggacagcagcgccagcatggtgggcaccaagctgagacagaccaaggacgccctgttcaccatcctgcacgacctgagaccccaggacagattcagcatcatcggcttcagcaacagaatcaaggtgtggaaggaccacctgatcagcgtgacccccgacagcatcagagacggcaaggtgtacatccaccacatgagccccaccggcggcaccgacatcaacggcgccctgcagagagccatcagactgctgaacaagtacgtggcccacagcggcatcggcgacagaagcgtgagcctgatcgtgttcctgaccgacggcaagcccaccgtgggcgagacccacaccctgaagatcctgaacaacaccagagaggccgccagaggccaggtgtgcatcttcaccatcggcatcggcaacgacgtggacttcagactgctggagaagctgagcctggagaactgcggcctgaccagaagagtgcacgaggaggaggacgccggcagccagctgatcggcttctacgacgagatcagaacccccctgctgagcgacatcagaatcgactacccccccagcagcgtggtgcaggccaccaagaccctgttccccaactacttcaacggcagcgagatcatcatcgccggcaagctggtggacagaaagctggaccacctgcacgtggaggtgaccgccagcaacagcaagaagttcatcatcctgaagaccgacgtgcccgtgagaccccagaaggccggcaaggacgtgaccggcagccccagacccggcggcgacggcgagggcgacaccaaccacatcgagagactgtggagctacctgaccaccaaggagctgctgagcagctggctgcagagcgacgacgagcccgagaaggagagactgagacagagagcccaggccctggccgtgagctacagattcctgacccccttcaccagcatgaagctgagaggccccgtgcccagaatggacggcctggaggaggcccacggcatgagcgccgccatgggccccgagcccgtggtgcagagcgtgagaggcgccggcacccagcccggccccctgctgaagaagccctaccagcccagaatcaagatcagcaagaccagcgtggacggcgacccccacttcgtggtggacttccccctgagcagactgaccgtgtgcttcaacatcgacggccagcccggcgacatcctgagactggtgagcgaccacagagacagcggcgtgaccgtgaacggcgagctgatcggcgcccccgccccccccaacggccacaagaagcagagaacctacctgagaaccatcaccatcctgatcaacaagcccgagagaagctacctggagatcacccccagcagagtgatcctggacggcggcgacagactggtgctgccctgcaaccagagcgtggtggtgggcagctggggcctggaggtgagcgtgagcgccaacgccaacgtgaccgtgaccatccagggcagcatcgccttcgtgatcctgatccacctgtacaagaagcccgcccccttccagagacaccacctgggcttctacatcgccaacagcgagggcctgagcagcaactgccacggcctgctgggccagttcctgaaccaggacgccagactgaccgaggaccccgccggccccagccagaacctgacccaccccctgctgctgcaggtgggcgagggccccgaggccgtgctgaccgtgaagggccaccaggtgcccgtggtgtggaagcagagaaagatctacaacggcgaggagcagatcgactgctggttcgccagaaacaacgccgccaagctgatcgacggcgagtacaaggactacctggccttccaccccttcgacaccggcatggacacctggcccggcaacgtgcagggcgccctgaagctggccgccctgaagatgcaggtgcacgagggccagtag

SEQ ID NO: 85415 - DNA, 2109 bp, Artificial Sequence
  Description of Artificial Sequence: Synthetic coding sequence
atgctgctgctgctgggcctgtgcctgggcctgagcctgtgcgtgggcagccaggaggaggcccagagctggggccacagcagcgagcaggacggcctgagagtgcccagacaggtgagactgctgcagagactgaagaccaagcccctgatgaccgagttcagcgtgaagagcaccatcatcagcagatacgccttcaccaccgtgagctgcagaatgctgaacagagccagcgaggaccaggacatcgagttccagatgcagatccccgccgccgccttcatcaccaacttcaccatgctgatcggcgacaaggtgtaccagggcgagatcaccgagagagagaagaagagcggcgacagagtgaaggagaagagaaacaagaccaccgaggagaacggcgagaagggcaccgagatcttcagagccagcgccgtgatccccagcaaggacaaggccgccttcttcctgagctacgaggagctgctgcagagaagactgggcaagtacgagcacagcatcagcgtgagaccccagcagctgagcggcagactgagcgtggacgtgaacatcctggagagcgccggcatcgccagcctggaggtgctgcccctgcacaacagcagacagagaggcagcggcagaggcgaggacgacagcggccccccccccagcaccgtgatcaaccagaacgagaccttcgccaacatcatcttcaagcccaccgtggtgcagcaggccagaatcgcccagaacggcatcctgggcgacttcatcatcagatacgacgtgaacagagagcagagcatcggcgacatccaggtgctgaacggctacttcgtgcactacttcgcccccaaggacctgccccccctgcccaagaacgtggtgttcgtgctggacagcagcgccagcatggtgggcaccaagctgagacagaccaaggacgccctgttcaccatcctgcacgacctgagaccccaggacagattcagcatcatcggcttcagcaacagaatcaaggtgtggaaggaccacctgatcagcgtgacccccgacagcatcagagacggcaaggtgtacatccaccacatgagccccaccggcggcaccgacatcaacggcgccctgcagagagccatcagactgctgaacaagtacgtggcccacagcggcatcggcgacagaagcgtgagcctgatcgtgttcctgaccgacggcaagcccaccgtgggcgagacccacaccctgaagatcctgaacaacaccagagaggccgccagaggccaggtgtgcatcttcaccatcggcatcggcaacgacgtggacttcagactgctggagaagctgagcctggagaactgcggcctgaccagaagagtgcacgaggaggaggacgccggcagccagctgatcggcttctacgacgagatcagaacccccctgctgagcgacatcagaatcgactacccccccagcagcgtggtgcaggccaccaagaccctgttccccaactacttcaacggcagcgagatcatcatcgccggcaagctggtggacagaaagctggaccacctgcacgtggaggtgaccgccagcaacagcaagaagttcatcatcctgaagaccgacgtgcccgtgagaccccagaaggccggcaaggacgtgaccggcagccccagacccggcggcgacggcgagggcgacaccaaccacatcgagagactgtggagctacctgaccaccaaggagctgctgagcagctggctgcagagcgacgacgagcccgagaaggagagactgagacagagagcccaggccctggccgtgagctacagattcctgacccccttcaccagcatgaagctgagaggccccgtgcccagaatggacggcctggaggaggcccacggcatgagcgccgccatgggccccgagcccgtggtgcagagcgtgagaggcgccggcacccagcccggccccctgctgaagaagccctaccagcccagaatcaagatcagcaagaccagcgtgagaggcttcagaagagaggagcagatcttcagcaacgtgatgaagttccccttcgccagcatcctggagctgtag

SEQ ID NO: 85416 - DNA, 2088 bp, Artificial Sequence
  Description of Artificial Sequence: Synthetic coding sequence
atgctgctgctgctgggcctgtgcctgggcctgagcctgtgcgtgggcagccaggaggaggcccagagctggggccacagcagcgagcaggacggcctgagagtgcccagacaggtgagactgctgcagagactgaagaccaagcccctgatgaccgagttcagcgtgaagagcaccatcatcagcagatacgccttcaccaccgtgagctgcagaatgctgaacagagccagcgaggaccaggacatcgagttccagatgcagatccccgccgccgccttcatcaccaacttcaccatgctgatcggcgacaaggtgtaccagggcgagatcaccgagagagagaagaagagcggcgacagagtgaaggagaagagaaacaagaccaccgaggagaacggcgagaagggcaccgagatcttcagagccagcgccgtgatccccagcaaggacaaggccgccttcttcctgagctacgaggagctgctgcagagaagactgggcaagtacgagcacagcatcagcgtgagaccccagcagctgagcggcagactgagcgtggacgtgaacatcctggagagcgccggcatcgccagcctggaggtgctgcccctgcacaacagcagacagagaggcagcggcagaggcgaggacgacagcggccccccccccagcaccgtgatcaaccagaacgagaccttcgccaacatcatcttcaagcccaccgtggtgcagcaggccagaatcgcccagaacggcatcctgggcgacttcatcatcagatacgacgtgaacagagagcagagcatcggcgacatccaggtgctgaacggctacttcgtgcactacttcgcccccaaggacctgccccccctgcccaagaacgtggtgttcgtgctggacagcagcgccagcatggtgggcaccaagctgagacagaccaaggacgccctgttcaccatcctgcacgacctgagaccccaggacagattcagcatcatcggcttcagcaacagaatcaaggtgtggaaggaccacctgatcagcgtgacccccgacagcatcagagacggcaaggtgtacatccaccacatgagccccaccggcggcaccgacatcaacggcgccctgcagagagccatcagactgctgaacaagtacgtggcccacagcggcatcggcgacagaagcgtgagcctgatcgtgttcctgaccgacggcaagcccaccgtgggcgagacccacaccctgaagatcctgaacaacaccagagaggccgccagaggccaggtgtgcatcttcaccatcggcatcggcaacgacgtggacttcagactgctggagaagctgagcctggagaactgcggcctgaccagaagagtgcacgaggaggaggacgccggcagccagctgatcggcttctacgacgagatcagaacccccctgctgagcgacatcagaatcgactacccccccagcagcgtggtgcaggccaccaagaccctgttccccaactacttcaacggcagcgagatcatcatcgccggcaagctggtggacagaaagctggaccacctgcacgtggaggtgaccgccagcaacagcaagaagttcatcatcctgaagaccgacgtgcccgtgagaccccagaaggccggcaaggacgtgaccggcagccccagacccggcggcgacggcgagggcgacaccaaccacatcgagagactgtggagctacctgaccaccaaggagctgctgagcagctggctgcagagcgacgacgagcccgagaaggagagactgagacagagagcccaggccctggccgtgagctacagattcctgacccccttcaccagcatgaagctgagaggccccgtgcccagaatggacggcctggaggaggcccacggcatgagcgccgccatgggccccgagcccgtggtgcagagcgtgagaggcgccggcacccagcccggccccctgctgaagaagccccccaacagcgtgaagaagaagcagaacaagaccaagaagagacacggcagagacggcgtgttccccctgcaccacctgggcatcagatag

SEQ ID NO: 85417 - DNA, 2172 bp, Artificial Sequence
  Description of Artificial Sequence: Synthetic coding sequence
gacagcggccccccccccagcaccgtgatcaaccagaacgagaccttcgccaacatcatcttcaagcccaccgtggtgcagcaggccagaatcgcccagaacggcatcctgggcgacttcatcatcagatacgacgtgaacagagagcagagcatcggcgacatccaggtgctgaacggctacttcgtgcactacttcgcccccaaggacctgccccccctgcccaagaacgtggtgttcgtgctggacagcagcgccagcatggtgggcaccaagctgagacagaccaaggacgccctgttcaccatcctgcacgacctgagaccccaggacagattcagcatcatcggcttcagcaacagaatcaaggtgtggaaggaccacctgatcagcgtgacccccgacagcatcagagacggcaaggtgtacatccaccacatgagccccaccggcggcaccgacatcaacggcgccctgcagagagccatcagactgctgaacaagtacgtggcccacagcggcatcggcgacagaagcgtgagcctgatcgtgttcctgaccgacggcaagcccaccgtgggcgagacccacaccctgaagatcctgaacaacaccagagaggccgccagaggccaggtgtgcatcttcaccatcggcatcggcaacgacgtggacttcagactgctggagaagctgagcctggagaactgcggcctgaccagaagagtgcacgaggaggaggacgccggcagccagctgatcggcttctacgacgagatcagaacccccctgctgagcgacatcagaatcgactacccccccagcagcgtggtgcaggccaccaagaccctgttccccaactacttcaacggcagcgagatcatcatcgccggcaagctggtggacagaaagctggaccacctgcacgtggaggtgaccgccagcaacagcaagaagttcatcatcctgaagaccgacgtgcccgtgagaccccagaaggccggcaaggacgtgaccggcagccccagacccggcggcgacggcgagggcgacaccaaccacatcgagagactgtggagctacctgaccaccaaggagctgctgagcagctggctgcagagcgacgacgagcccgagaaggagagactgagacagagagcccaggccctggccgtgagctacagattcctgacccccttcaccagcatgaagctgagaggccccgtgcccagaatggacggcctggaggaggcccacggcatgagcgccgccatgggccccgagcccgtggtgcagagcgtgagaggcgccggcacccagcccggccccctgctgaagaagccctaccagcccagaatcaagatcagcaagaccagcgtggacggcgacccccacttcgtggtggacttccccctgagcagactgaccgtgtgcttcaacatcgacggccagcccggcgacatcctgagactggtgagcgaccacagagacagcggcgtgaccgtgaacggcgagctgatcggcgcccccgccccccccaacggccacaagaagcagagaacctacctgagaaccatcaccatcctgatcaacaagcccgagagaagctacctggagatcacccccagcagagtgatcctggacggcggcgacagactggtgctgccctgcaaccagagcgtggtggtgggcagctggggcctggaggtgagcgtgagcgccaacgccaacgtgaccgtgaccatccagggcagcatcgccttcgtgatcctgatccacctgtacaagaagcccgcccccttccagagacaccacctgggcttctacatcgccaacagcgagggcctgagcagcaactgccacggcctgctgggccagttcctgaaccaggacgccagactgaccgaggaccccgccggccccagccagaacctgacccaccccctgctgctgcaggtgggcgagggccccgaggccgtgctgaccgtgaagggccaccaggtgcccgtggtgtggaagcagagaaagatctacaacggcgaggagcagatcgactgctggttcgccagaaacaacgccgccaagctgatcgacggcgagtacaaggactacctggccttccaccccttcgacaccggcatgctgggcagaggcatgagcagagagctgtag

SEQ ID NO: 85418 - DNA, 1599 bp, Artificial Sequence
  Description of Artificial Sequence: Synthetic coding sequence
atggcccccagcagccccagacccgccctgcccgccctgctggtgctgctgggcgccctgttccccggccccggcaacgcccagaccagcgtgagccccagcaaggtgatcctgcccagaggcggcagcgtgctggtgacctgcagcaccagctgcgaccagcccaagctgctgggcatcgagacccccctgcccaagaaggagctgctgctgcccggcaacaacagaaaggtgtacgagctgagcaacgtgcaggaggacagccagcccatgtgctacagcaactgccccgacggccagagcaccgccaagaccttcctgaccgtgtactggacccccgagagagtggagctggcccccctgcccagctggcagcccgtgggcaagaacctgaccctgagatgccaggtggagggcggcgcccccagagccaacctgaccgtggtgctgctgagaggcgagaaggagctgaagagagagcccgccgtgggcgagcccgccgaggtgaccaccaccgtgctggtgagaagagaccaccacggcgccaacttcagctgcagaaccgagctggacctgagaccccagggcctggagctgttcgagaacaccagcgccccctaccagctgcagaccttcgtgctgcccgccacccccccccagctggtgagccccagagtgctggaggtggacacccagggcaccgtggtgtgcagcctggacggcctgttccccgtgagcgaggcccaggtgcacctggccctgggcgaccagagactgaaccccaccgtgacctacggcaacgacagcttcagcgccaaggccagcgtgagcgtgaccgccgaggacgagggcacccagagactgacctgcgccgtgatcctgggcaaccagagccaggagaccctgcagaccgtgaccatctacagcttccccgcccccaacgtgatcctgaccaagcccgaggtgagcgagggcaccgaggtgaccgtgaagtgcgaggcccaccccagagccaaggtgaccctgaacggcgtgcccgcccagcccctgggccccagagcccagctgctgctgaaggccacccccgaggacaacggcagaagcttcagctgcagcgccaccctggaggtggccggccagctgatccacaagaaccagaccagagagctgagagtgctgtacggccccagactggacgagagagactgccccggcaactggacctggcccgagaacagccagcagacccccatgtgccaggcctggggcaaccccctgcccgagctgaagtgcctgaaggacggcaccttccccctgcccatcggcgagagcgtgaccgtgaccagagacctggagggcacctacctgtgcagagccagaagcacccagggcgaggtgaccagaaaggtgaccgtgaacgtgctgagccccagatacgagatcgtgatcatcaccgtggtggccgccgccgtgatcatgggcaccgccggcctgagcacctacctgtacaacagacagagaaagatcaagaagtacagactgcagcaggcccagaagggcacccccatgaagcccaacacccaggccacccccccctag

SEQ ID NO: 85419 - DNA, 933 bp, Artificial Sequence
  Description of Artificial Sequence: Synthetic coding sequence
atggcccccagcagccccagacccgccctgcccgccctgctggtgctgctgggcgccctgttccccgtgagcgaggcccaggtgcacctggccctgggcgaccagagactgaaccccaccgtgacctacggcaacgacagcttcagcgccaaggccagcgtgagcgtgaccgccgaggacgagggcacccagagactgacctgcgccgtgatcctgggcaaccagagccaggagaccctgcagaccgtgaccatctacagcttccccgcccccaacgtgatcctgaccaagcccgaggtgagcgagggcaccgaggtgaccgtgaagtgcgaggcccaccccagagccaaggtgaccctgaacggcgtgcccgcccagcccctgggccccagagcccagctgctgctgaaggccacccccgaggacaacggcagaagcttcagctgcagcgccaccctggaggtggccggccagctgatccacaagaaccagaccagagagctgagagtgctgtacggccccagactggacgagagagactgccccggcaactggacctggcccgagaacagccagcagacccccatgtgccaggcctggggcaaccccctgcccgagctgaagtgcctgaaggacggcaccttccccctgcccatcggcgagagcgtgaccgtgaccagagacctggagggcacctacctgtgcagagccagaagcacccagggcgaggtgaccagaaaggtgaccgtgaacgtgctgagccccagatacgagatcgtgatcatcaccgtggtggccgccgccgtgatcatgggcaccgccggcctgagcacctacctgtacaacagacagagaaagatcaagaagtacagactgcagcaggcccagaagggcacccccatgaagcccaacacccaggccacccccccctag

SEQ ID NO: 85420 - DNA, 828 bp, Artificial Sequence
  Description of Artificial Sequence: Synthetic coding sequence
atgagcagcttcggctacagaaccctgaccgtggccctgttcaccctgatctgctgccccggcagcgacgagaaggtgttcgaggtgcacgtgagacccaagaagctggccgtggagcccaagggcagcctggaggtgaactgcagcaccacctgcaaccagcccgaggtgggcggcctggagaccagcctggacaagatcctgctggacgagcaggcccagtggaagcactacctggtgagcaacatcagccacgacaccgtgctgcagtgccacttcacctgcagcggcaagcaggagagcatgaacagcaacgtgagcgtgtaccagccccccagacaggtgatcctgaccctgcagcccaccctggtggccgtgggcaagagcttcaccatcgagtgcagagtgcccaccgtggagcccctggacagcctgaccctgttcctgttcagaggcaacgagaccctgcactacgagaccttcggcaaggccgcccccgccccccaggaggccaccgccaccttcaacagcaccgccgacagagaggacggccacagaaacttcagctgcctggccgtgctggacctgatgagcagaggcggcaacatcttccacaagcacagcgcccccaagatgctggagatctacgagcccgtgagcgacagccagatggtgatcatcgtgaccgtggtgagcgtgctgctgagcctgttcgtgaccagcgtgctgctgtgcttcatcttcggccagcacctgagacagcagagaatgggcacctacggcgtgagagccgcctggagaagactgccccaggccttcagaccctag

SEQ ID NO: 85421 - DNA, 828 bp, Artificial Sequence; identical to SEQ ID NO: 85420
  Description of Artificial Sequence: Synthetic coding sequence

SEQ ID NO: 85422 - DNA, 828 bp, Artificial Sequence; identical to SEQ ID NO: 85420
  Description of Artificial Sequence: Synthetic coding sequence

SEQ ID NO: 85423 - DNA, 828 bp, Artificial Sequence; identical to SEQ ID NO: 85420
  Description of Artificial Sequence: Synthetic coding sequence

SEQ ID NO: 85424 - DNA, 828 bp, Artificial Sequence; identical to SEQ ID NO: 85420
  Description of Artificial Sequence: Synthetic coding sequence

SEQ ID NO: 85425 - DNA, 1644 bp, Artificial Sequence
  Description of Artificial Sequence: Synthetic coding sequence
atggccaccatggtgcccagcgtgctgtggcccagagcctgctggaccctgctggtgtgctgcctgctgacccccggcgtgcagggccaggagttcctgctgagagtggagccccagaaccccgtgctgagcgccggcggcagcctgttcgtgaactgcagcaccgactgccccagcagcgagaagatcgccctggagaccagcctgagcaaggagctggtggccagcggcatgggctgggccgccttcaacctgagcaacgtgaccggcaacagcagaatcctgtgcagcgtgtactgcaacggcagccagatcaccggcagcagcaacatcaccgtgtacagactgcccgagagagtggagctggcccccctgcccccctggcagcccgtgggccagaacttcaccctgagatgccaggtggaggacggcagccccagaaccagcctgaccgtggtgctgctgagatgggaggaggagctgagcagacagcccgccgtggaggagcccgccgaggtgaccgccaccgtgctggccagcagagacgaccacggcgcccccttcagctgcagaaccgagctggacatgcagccccagggcctgggcctgttcgtgaacaccagcgcccccagacagctgagaaccttcgtgctgcccgtgaccccccccagactggtggcccccagattcctggaggtggagaccagctggcccgtggactgcaccctggacggcctgttccccgccagcgaggcccaggtgtacctggccctgggcgaccagatgctgaacgccaccgtgatgaaccacggcgacaccctgaccgccaccgccaccgccaccgccagagccgaccaggagggcgccagagagatcgtgtgcaacgtgaccctgggcggcgagagaagagaggccagagagaacctgaccgtgttcagcttcctgggccccatcgtgaacctgagcgagcccaccgcccacgagggcagcaccgtgaccgtgagctgcatggccggcgccagagtgcaggtgaccctggacggcgtgcccgccgccgcccccggccagcccgcccagctgcagctgaacgccaccgagagcgacgacggcagaagcttcttctgcagcgccaccctggaggtggacggcgagttcctgcacagaaacagcagcgtgcagctgagagtgctgtacggccccaagatcgacagagccacctgcccccagcacctgaagtggaaggacaagaccagacacgtgctgcagtgccaggccagaggcaacccctaccccgagctgagatgcctgaaggagggcagcagcagagaggtgcccgtgggcatccccttcttcgtgaacgtgacccacaacggcacctaccagtgccaggccagcagcagcagaggcaagtacaccctggtggtggtgatggacatcgaggccggcagcagccacttcgtgcccgtgttcgtggccgtgctgctgaccctgggcgtggtgaccatcgtgctggccctgatgtacgtgttcagagagcaccagagaagcggcagctaccacgtgagagaggagagcacctacctgcccctgaccagcatgcagcccaccgaggccatgggcgaggagcccagcagagccgagtag

SEQ ID NO: 85426 - DNA, 819 bp, Artificial Sequence
  Description of Artificial Sequence: Synthetic coding sequence
atgggcagcctgttccccctgagcctgctgttcttcctggccgccgcctaccccggcgtgggcagcgccctgggcagaagaaccaagagagcccagagccccaagggcagccccctggcccccagcggcaccagcgtgcccttctgggtgagaatgagccccgagttcgtggccgtgcagcccggcaagagcgtgcagctgaactgcagcaacagctgcccccagccccagaacagcagcctgagaacccccctgagacagggcaagaccctgagaggccccggctgggtgagctaccagctgctggacgtgagagcctggagcagcctggcccactgcctggtgacctgcgccggcaagaccagatgggccaccagcagaatcaccgcctacagcgtgcccggcggcctgctgggcggcgaccccgaggcctggaagcccggccacctgttcagaaagcccggcgccctgcacagacccggcagcggccagagagacctggacctgagagtgtgctgctggacccccagactgctggccgccagagacctgcccagagccccccagagcagaagacccggcggcccccagcagctgggcacccactacaccgacgccagactggagcccagagcccacagcttcggcctgagattccacagatgcccctgcagagaccccccccactgcggcagatgcgtgcccatgcaggtgcccagctacgaggtgcccggcgtgaagggcgacgtgctgtgcagactgagcgagaagaagagaaacatgaagcagagcggcgagatggccatccacggcggctag

SEQ ID NO: 85427 - DNA, 816 bp, Artificial Sequence
  Description of Artificial Sequence: Synthetic coding sequence
atgggcagcctgttccccctgagcctgctgttcttcctggccgccgcctaccccggcgtgggcagcgccctgggcagaagaaccaagagagcccagagccccaagggcagccccctggcccccagcggcaccagcgtgcccttctgggtgagaatgagccccgagttcgtggccgtgcagcccggcaagagcgtgcagctgaactgcagcaacagctgcccccagccccagaacagcagcctgagaacccccctgagacagggcaagaccctgagaggccccggctgggtgagctaccagctgctggacgtgagagcctggagcagcctggcccactgcctggtgacctgcgccggcaagaccagatgggccaccagcagaatcaccgcctacaagcccccccacagcgtgatcctggagccccccgtgctgaagggcagaaagtacaccctgagatgccacgtgacccaggtgttccccgtgggctacctggtggtgaccctgagacacggcagcagagtgatctacagcgagagcctggagagattcaccggcctggacctggccaacgtgaccctgacctacgagttcgccgccggccccagagacttctggcagcccgtgatctgccacgccagactgaacctggacggcctggtggtgagaaacagcagcgcccccatcaccctgatgctggcctggagccccgcccccaccgccctggccagcggcagcatcgccgccctggtgggcatcctgctgaccgtgggcgccgcctacctgtgcaagtgcctggccatgaagagccaggcctag

SEQ ID NO: 85428 - DNA, 714 bp, Artificial Sequence
  Description of Artificial Sequence: Synthetic coding sequence
atgggcagcctgttccccctgagcctgctgttcttcctggccgccgcctaccccggcgtgggcagcgccctgggcagaagaaccaagagagcccagagccccaagggcagccccctggcccccagcggcaccagcgtgcccttctgggtgagaatgagccccgagttcgtggccgtgcagcccggcaagagcgtgcagctgaactgcagcaacagctgcccccagccccagaacagcagcctgagaacccccctgagacagggcaagaccctgagaggccccggctgggtgagctaccagctgctggacgtgagagcctggagcagcctggcccactgcctggtgacctgcgccggcaagaccagatgggccaccagcagaatcaccgcctacaagcccccccacagcgtgatcctggagccccccgtgctgaagggcagaaagtacaccctgagatgccacgtgacccaggtgttccccgtgggctacctggtggtgaccctgagacacggcagcagagtgatctacagcgagagcctggagagattcaccggcctggacctggccaacgtgaccctgacctacgagttcgccgccggccccagagacttctggcagcccgtgatctgccacgccagactgaacctggacggcctggtggtgagaaacagcagcgcccccatcaccctgatgctgggcgaggcccccctgtag

SEQ ID NO: 85429 - DNA, 498 bp, Artificial Sequence
  Description of Artificial Sequence: Synthetic coding sequence
atggagctgtgcagaagcctggccctgctgggcggcagcctgggcctgatgttctgcctgatcgccctgagcaccgacttctggttcgaggccgtgggccccacccacagcgcccacagcggcctgtggcccaccggccacggcgacatcatcagcggctacatccacgtgacccagaccttcagcatcatggccgtgctgtgggccctggtgagcgtgagcttcctggtgctgagctgcttccccagcctgttcccccccggccacggccccctggtgagcaccaccgccgccttcgccgccgccatcagcatggtggtggccatggccgtgtacaccagcgagagatgggaccagcccccccacccccagatccagaccttcttcagctggagcttctacctgggctgggtgagcgccatcctgctgctgtgcaccggcgccctgagcctgggcgcccactgcggcggccccagacccggctacgagaccctgtag

SEQ ID NO: 85430 - DNA, 1674 bp, Artificial Sequence
  Description of Artificial Sequence: Synthetic coding sequence
atgatggtggtgctgctgggcgccaccaccctggtgctggtggccgtggccccctgggtgctgagcgccgccgccggcggcaagaacctgaagagcccccagaaggtggaggtggacatcatcgacgacaacttcatcctgagatggaacagaagcgacgagagcgtgggcaacgtgaccttcagcttcgactaccagaagaccggcatggacaactggatcaagctgagcggctgccagaacatcaccagcaccaagtgcaacttcagcagcctgaagctgaacgtgtacgaggagatcaagctgagaatcagagccgagaaggagaacaccagcagctggtacgaggtggacagcttcacccccttcagaaaggcccagatcggcccccccgaggtgcacctggaggccgaggacaaggccatcgtgatccacatcagccccggcaccaaggacagcgtgatgtgggccctggacggcctgagcttcacctacagcctggtgatctggaagaacagcagcggcgtggaggagagaatcgagaacatctacagcagacacaagatctacaagctgagccccgagaccacctactgcctgaaggtgaaggccgccctgctgaccagctggaagatcggcgtgtacagccccgtgcactgcatcaagaccaccgtggagaacgagctgcccccccccgagaacatcgaggtgagcgtgcagaaccagaactacgtgctgaagtgggactacacctacgccaacatgaccttccaggtgcagtggctgcacgccttcctgaagagaaaccccggcaaccacctgtacaagtggaagcagatccccgactgcgagaacgtgaagaccacccagtgcgtgttcccccagaacgtgttccagaagggcatctacctgctgagagtgcaggccagcgacggcaacaacaccagcttctggagcgaggagatcaagttcgacaccgagatccaggccttcctgctgccccccgtgttcaacatcagaagcctgagcgacagcttccacatctacatcggcgcccccaagcagagcggcaacacccccgtgatccaggactaccccctgatctacgagatcatcttctgggagaacaccagcaacgccgagagaaagatcatcgagaagaagaccgacgtgaccgtgcccaacctgaagcccctgaccgtgtactgcgtgaaggccagagcccacaccatggacgagaagctgaacaagagcagcgtgttcagcgacgccgtgtgcgagaagaccaagcccggcaacaccagcaagatctggctgatcgtgggcatctgcatcgccctgttcgccctgcccttcgtgatctacgccgccaaggtgttcctgagatgcatcaactacgtgttcttccccagcctgaagcccagcagcagcatcgacgagtacttcagcgagcagcccctgaagaacctgctgctgagcaccagcgaggagcagatcgagaagtgcttcatcatcgagaacatcagcaccatcgccaccgtggaggagaccaaccagaccgacgaggaccacaagaagtacagcagccagaccagccaggacagcggcaactacagcaacgaggacgagagcgagagcaagaccagcgaggagctgcagcaggacttcgtgtag

SEQ ID NO: 85431 - DNA, 1467 bp, Artificial Sequence
  Description of Artificial Sequence: Synthetic coding sequence
atggacaactggatcaagctgagcggctgccagaacatcaccagcaccaagtgcaacttcagcagcctgaagctgaacgtgtacgaggagatcaagctgagaatcagagccgagaaggagaacaccagcagctggtacgaggtggacagcttcacccccttcagaaaggcccagatcggcccccccgaggtgcacctggaggccgaggacaaggccatcgtgatccacatcagccccggcaccaaggacagcgtgatgtgggccctggacggcctgagcttcacctacagcctggtgatctggaagaacagcagcggcgtggaggagagaatcgagaacatctacagcagacacaagatctacaagctgagccccgagaccacctactgcctgaaggtgaaggccgccctgctgaccagctggaagatcggcgtgtacagccccgtgcactgcatcaagaccaccgtggagaacgagctgcccccccccgagaacatcgaggtgagcgtgcagaaccagaactacgtgctgaagtgggactacacctacgccaacatgaccttccaggtgcagtggctgcacgccttcctgaagagaaaccccggcaaccacctgtacaagtggaagcagatccccgactgcgagaacgtgaagaccacccagtgcgtgttcccccagaacgtgttccagaagggcatctacctgctgagagtgcaggccagcgacggcaacaacaccagcttctggagcgaggagatcaagttcgacaccgagatccaggccttcctgctgccccccgtgttcaacatcagaagcctgagcgacagcttccacatctacatcggcgcccccaagcagagcggcaacacccccgtgatccaggactaccccctgatctacgagatcatcttctgggagaacaccagcaacgccgagagaaagatcatcgagaagaagaccgacgtgaccgtgcccaacctgaagcccctgaccgtgtactgcgtgaaggccagagcccacaccatggacgagaagctgaacaagagcagcgtgttcagcgacgccgtgtgcgagaagaccaagcccggcaacaccagcaagatctggctgatcgtgggcatctgcatcgccctgttcgccctgcccttcgtgatctacgccgccaaggtgttcctgagatgcatcaactacgtgttcttccccagcctgaagcccagcagcagcatcgacgagtacttcagcgagcagcccctgaagaacctgctgctgagcaccagcgaggagcagatcgagaagtgcttcatcatcgagaacatcagcaccatcgccaccgtggaggagaccaaccagaccgacgaggaccacaagaagtacagcagccagaccagccaggacagcggcaactacagcaacgaggacgagagcgagagcaagaccagcgaggagctgcagcaggacttcgtgtag

SEQ ID NO: 85432 - DNA, 1491 bp, Artificial Sequence
  Description of Artificial Sequence: Synthetic coding sequence
atgatggtggtgctgctgggcgccaccaccctggtgctggtggccgtggccccctgggtgctgagcgccgccgccggcggcaagaacctgaagagcccccagaaggtggaggtggacatcatcgacgacaacttcatcctgagatggaacagaagcgacgagagcgtgggcaacgtgaccttcagcttcgactaccagaagaccggcatggacaactggatcaagctgagcggctgccagaacatcaccagcaccaagtgcaacttcagcagcctgaagctgaacgtgtacgaggagatcaagctgagaatcagagccgagaaggagaacaccagcagctggtacgaggtggacagcttcacccccttcagaaaggcccagatcggcccccccgaggtgcacctggaggccgaggacaaggccatcgtgatccacatcagccccggcaccaaggacagcgtgatgtgggccctggacggcctgagcttcacctacagcctggtgatctggaagaacagcagcggcgtggaggagagaatcgagaacatctacagcagacacaagatctacaagctgagccccgagaccacctactgcctgaaggtgaaggccgccctgctgaccagctggaagatcggcgtgtacagccccgtgcactgcatcaagaccaccgtggagaacgagctgcccccccccgagaacatcgaggtgagcgtgcagaaccagaactacgtgctgaagtgggactacacctacgccaacatgaccttccaggtgcagtggctgcacgccttcctgaagagaaaccccggcaaccacctgtacaagtggaagcagatccccgactgcgagaacgtgaagaccacccagtgcgtgttcccccagaacgtgttccagaagggcatctacctgctgagagtgcaggccagcgacggcaacaacaccagcttctggagcgaggagatcaagttcgacaccgagatccaggccttcctgctgccccccgtgttcaacatcagaagcctgagcgacagcttccacatctacatcggcgcccccaagcagagcggcaacacccccgtgatccaggactaccccctgatctacgagatcatcttctgggagaacaccagcaacgccgagagaaagatcatcgagaagaagaccgacgtgaccgtgcccaacctgaagcccctgaccgtgtactgcgtgaaggccagagcccacaccatggacgagaacgacgccgtgtgcgagtacttcagcgagcagcccctgaagaacctgctgctgagcaccagcgaggagcagatcgagaagtgcttcatcatcgagaacatcagcaccatcgccaccgtggaggagaccaaccagaccgacgaggaccacaagaagtacagcagccagaccagccaggacagcggcaactacagcaacgaggacgagagcgagagcaagaccagcgaggagctgcagcaggacttcgtgtag

SEQ ID NO: 85433 - DNA, 1548 bp, Artificial Sequence
  Description of Artificial Sequence: Synthetic coding sequence
atgctgctgagccagaacgccttcatcttcagaagcctgaacctggtgctgatggtgtacatcagcctggtgttcggcatcagctacgacagccccgactacaccgacgagagctgcaccttcaagatcagcctgagaaacttcagaagcatcctgagctgggagctgaagaaccacagcatcgtgcccacccactacaccctgctgtacaccatcatgagcaagcccgaggacctgaaggtggtgaagaactgcgccaacaccaccagaagcttctgcgacctgaccgacgagtggagaagcacccacgaggcctacgtgaccgtgctggagggcttcagcggcaacaccaccctgttcagctgcagccacaacttctggctggccatcgacatgagcttcgagccccccgagttcgagatcgtgggcttcaccaaccacatcaacgtgatggtgaagttccccagcatcgtggaggaggagctgcagttcgacctgagcctggtgatcgaggagcagagcgagggcatcgtgaagaagcacaagcccgagatcaagggcaacatgagcggcaacttcacctacatcatcgacaagctgatccccaacaccaactactgcgtgagcgtgtacctggagcacagcgacgagcaggccgtgatcaagagccccctgaagtgcaccctgctgccccccggccaggagagcgagagcgccgagagcgccaagatcggcggcatcatcaccgtgttcctgatcgccctggtgctgaccagcaccatcgtgaccctgaagtggatcggctacatctgcctgagaaacagcctgcccaaggtgctgaacttccacaacttcctggcctggcccttccccaacctgccccccctggaggccatggacatggtggaggtgatctacatcaacagaaagaagaaggtgtgggactacaactacgacgacgagagcgacagcgacaccgaggccgcccccagaaccagcggcggcggctacaccatgcacggcctgaccgtgagacccctgggccaggccagcgccaccagcaccgagagccagctgatcgaccccgagagcgaggaggagcccgacctgcccgaggtggacgtggagctgcccaccatgcccaaggacagcccccagcagctggagctgctgagcggcccctgcgagagaagaaagagccccctgcaggaccccttccccgaggaggactacagcagcaccgagggcagcggcggcagaatcaccttcaacgtggacctgaacagcgtgttcctgagagtgctggacgacgaggacagcgacgacctggaggcccccctgatgctgagcagccacctggaggagatggtggaccccgaggaccccgacaacgtgcagagcaaccacctgctggccagcggcgagggcacccagcccaccttccccagccccagcagcgagggcctgtggagcgaggacgcccccagcgaccagagcgacaccagcgagagcgacgtggacctgggcgacggctacatcatgagatag

SEQ ID NO: 85434 - DNA, 1548 bp, Artificial Sequence; identical to SEQ ID NO: 85433
  Description of Artificial Sequence: Synthetic coding sequence

SEQ ID NO: 85435 - DNA, 996 bp, Artificial Sequence
  Description of Artificial Sequence: Synthetic coding sequence
atgctgctgagccagaacgccttcatcttcagaagcctgaacctggtgctgatggtgtacatcagcctggtgttcggcatcagctacgacagccccgactacaccgacgagagctgcaccttcaagatcagcctgagaaacttcagaagcatcctgagctgggagctgaagaaccacagcatcgtgcccacccactacaccctgctgtacaccatcatgagcaagcccgaggacctgaaggtggtgaagaactgcgccaacaccaccagaagcttctgcgacctgaccgacgagtggagaagcacccacgaggcctacgtgaccgtgctggagggcttcagcggcaacaccaccctgttcagctgcagccacaacttctggctggccatcgacatgagcttcgagccccccgagttcgagatcgtgggcttcaccaaccacatcaacgtgatggtgaagttccccagcatcgtggaggaggagctgcagttcgacctgagcctggtgatcgaggagcagagcgagggcatcgtgaagaagcacaagcccgagatcaagggcaacatgagcggcaacttcacctacatcatcgacaagctgatccccaacaccaactactgcgtgagcgtgtacctggagcacagcgacgagcaggccgtgatcaagagccccctgaagtgcaccctgctgccccccggccaggagagcgagagcgccgagagcgccaagatcggcggcatcatcaccgtgttcctgatcgccctggtgctgaccagcaccatcgtgaccctgaagtggatcggctacatctgcctgagaaacagcctgcccaaggtgctgagacagggcctggccaagggctggaacgccgtggccatccacagatgcagccacaacgccctgcagagcgagacccccgagctgaagcagagcagctgcctgagcttccccagcagctgggactacaagagagccagcctgtgccccagcgactag

SEQ ID NO: 85436 - DNA, 996 bp, Artificial Sequence; identical to SEQ ID NO: 85435
  Description of Artificial Sequence: Synthetic coding sequence

SEQ ID NO: 85437 - DNA, 561 bp, Artificial Sequence
  Description of Artificial Sequence: Synthetic coding sequence
atgctgctgaagagccccgagaacagcctgctgcagttccagttcaagtacggcgtgcccacccccaccaacgtgaccatcgagagctacaacatgaaccccatcgtgtactgggagtaccagatcatgccccaggtgcccgtgttcaccgtggaggtgaagaactacggcgtgaagaacagcgagtggatcgacgcctgcatcaacatcagccaccactactgcaacatcagcgaccacgtgggcgaccccagcaacagcctgtgggtgagagtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtacaacgtgtacgtgagaatgaacggcagcgagatcaagagaagctgcgccttcagcctgttcagcttcttcatctag

SEQ ID NO: 85438 - DNA, 1470 bp, Artificial Sequence
  Description of Artificial Sequence: Synthetic coding sequence
atggccctgctgttcctgctgcccctggtgatgcagggcgtgagcagagccgagatgggcaccgccgacctgggccccagcagcgtgcccacccccaccaacgtgaccatcgagagctacaacatgaaccccatcgtgtactgggagtaccagatcatgccccaggtgcccgtgttcaccgtggaggtgaagaactacggcgtgaagaacagcgagtggatcgacgcctgcatcaacatcagccaccactactgcaacatcagcgaccacgtgggcgaccccagcaacagcctgtgggtgagagtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtacaacgtgtacgtgagaatgaacggcagcgagatccagtacaagatcctgacccagaaggaggacgactgcgacgagatccagtgccagctggccatccccgtgagcagcctgaacagccagtactgcgtgagcgccgagggcgtgctgcacgtgtggggcgtgaccaccgagaagagcaaggaggtgtgcatcaccatcttcaacagcagcatcaagggcagcctgtggatccccgtggtggccgccctgctgctgttcctggtgctgagcctggtgttcatctgcttctacatcaagaagatcaaccccctgaaggagaagagcatcatcctgcccaagagcctgatcagcgtggtgagaagcgccaccctggagaccaagcccgagagcaagtacgtgagcctgatcaccagctaccagcccttcagcctggagaaggaggtggtgtgcgaggagcccctgagccccgccaccgtgcccggcatgcacaccgaggacaaccccggcaaggtggagcacaccgaggagctgagcagcatcaccgaggtggtgaccaccgaggagaacatccccgacgtggtgcccggcagccacctgacccccatcgagagagagagcagcagccccctgagcagcaaccagagcgagcccggcagcatcgccctgaacagctaccacagcagaaactgcagcgagagcgaccacagcagaaacggcttcgacaccgacagcagctgcctggagagccacagcagcctgagcgacagcgagttcccccccaacaacaagggcgagatcaagaccgagggccaggagctgatcaccgtgatcaaggcccccaccagcttcggctacgacaagccccacgtgctggtggacctgctggtggacgacagcggcaaggagagcctgatcggctacagacccaccgaggacagcaaggagttcagctag

SEQ ID NO: 85439 - DNA, 486 bp, Artificial Sequence
  Description of Artificial Sequence: Synthetic coding sequence
atgctgctgaagagccccgagaacagcctgctgcagttccagttcaagtacggcgtgcccacccccaccaacgtgaccatcgagagctacaacatgaaccccatcgtgtactgggagtaccagatcatgccccaggtgcccgtgttcaccgtggaggtgaagaactacggcgtgaagaacagcgagtggatcgacgcctgcatcaacatcagccaccactactgcaacatcagcgaccacgtgggcgaccccagcaacagcctgtgggtgagagtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtag

SEQ ID NO: 85440 - DNA, 825 bp, Artificial Sequence
  Description of Artificial Sequence: Synthetic coding sequence
atggccctgctgttcctgctgcccctggtgatgcagggcgtgagcagagccgagatgggcaccgccgacctgggccccagcagcgtgcccacccccaccaacgtgaccatcgagagctacaacatgaaccccatcgtgtactgggagtaccagatcatgccccaggtgcccgtgttcaccgtggaggtgaagaactacggcgtgaagaacagcgagtggatcgacgcctgcatcaacatcagccaccactactgcaacatcagcgaccacgtgggcgaccccagcaacagcctgtgggtgagagtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtacaacgtgtacgtgagaatgaacggcagcgagatccagtacaagatcctgacccagaaggaggacgactgcgacgagatccagtgccagctggccatccccgtgagcagcctgaacagccagtactgcgtgagcgccgagggcgtgctgcacgtgtggggcgtgaccaccgagaagagcaaggaggtgtgcatcaccatcttcaacagcagcatcaagggcagcctgtggatccccgtggtggccgccctgctgctgttctgcctggcctggtacagcagcgtgttcatcctgagaaagctgatccactag

SEQ ID NO: 85441 - DNA, 633 bp, Artificial Sequence
  Description of Artificial Sequence: Synthetic coding sequence
atggccctgctgttcctgctgcccctggtgatgcagggcgtgagcagagccgagatgggcaccgccgacctgggccccagcagcgtgcccacccccaccaacgtgaccatcgagagctacaacatgaaccccatcgtgtactgggagtaccagatcatgccccaggtgcccgtgttcaccgtggaggtgaagaactacggcgtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtacaacgtgtacgtgagaatgaacggcagcgagatccagtacaagatcctgacccagaaggaggacgactgcgacgagatccagtgccagctggccatccccgtgagcagcctgaacagccagtactgcgtgagcgccgagggcgtgctgcacgtgtggggcgtgaccaccgagaagagcaaggaggtgtgcatcaccatcttcaacagcagcatcaagtag

SEQ ID NO: 85442 - DNA, 1386 bp, Artificial Sequence
  Description of Artificial Sequence: Synthetic coding sequence
atgcccacccccaccaacgtgaccatcgagagctacaacatgaaccccatcgtgtactgggagtaccagatcatgccccaggtgcccgtgttcaccgtggaggtgaagaactacggcgtgaagaacagcgagtggatcgacgcctgcatcaacatcagccaccactactgcaacatcagcgaccacgtgggcgaccccagcaacagcctgtgggtgagagtgaaggccagagtgggccagaaggagagcgcctacgccaagagcgaggagttcgccgtgtgcagagacggcaagatcggcccccccaagctggacatcagaaaggaggagaagcagatcatgatcgacatcttccaccccagcgtgttcgtgaacggcgacgagcaggaggtggactacgaccccgagaccacctgctacatcagagtgtacaacgtgtacgtgagaatgaacggcagcgagatccagtacaagatcctgacccagaaggaggacgactgcgacgagatccagtgccagctggccatccccgtgagcagcctgaacagccagtactgcgtgagcgccgagggcgtgctgcacgtgtggggcgtgaccaccgagaagagcaaggaggtgtgcatcaccatcttcaacagcagcatcaagggcagcctgtggatccccgtggtggccgccctgctgctgttcctggtgctgagcctggtgttcatctgcttctacatcaagaagatcaaccccctgaaggagaagagcatcatcctgcccaagagcctgatcagcgtggtgagaagcgccaccctggagaccaagcccgagagcaagtacgtgagcctgatcaccagctaccagcccttcagcctggagaaggaggtggtgtgcgaggagcccctgagccccgccaccgtgcccggcatgcacaccgaggacaaccccggcaaggtggagcacaccgaggagctgagcagcatcaccgaggtggtgaccaccgaggagaacatccccgacgtggtgcccggcagccacctgacccccatcgagagagagagcagcagccccctgagcagcaaccagagcgagcccggcagcatcgccctgaacagctaccacagcagaaactgcagcgagagcgaccacagcagaaacggcttcgacaccgacagcagctgcctggagagccacagcagcctgagcgacagcgagttcccccccaacaacaagggcgagatcaagaccgagggccaggagctgatcaccgtgatcaaggcccccaccagcttcggctacgacaagccccacgtgctggtggacctgctggtggacgacagcggcaaggagagcctgatcggctacagacccaccgaggacagcaaggagttcagctag

SEQ ID NO: 85443 - DNA, 1014 bp, Artificial Sequence
  Description of Artificial Sequence: Synthetic coding sequence
atgagacccaccctgctgtggagcctgctgctgctgctgggcgtgttcgccgccgccgccgccgccccccccgaccccctgagccagctgcccgccccccagcaccccaagatcagactgtacaacgccgagcaggtgctgagctgggagcccgtggccctgagcaacagcaccagacccgtggtgtaccaggtgcagttcaagtacaccgacagcaagtggttcaccgccgacatcatgagcatcggcgtgaactgcacccagatcaccgccaccgagtgcgacttcaccgccgccagccccagcgccggcttccccatggacttcaacgtgaccctgagactgagagccgagctgggcgccctgcacagcgcctgggtgaccatgccctggttccagcactacagaaacgtgaccgtgggcccccccgagaacatcgaggtgacccccggcgagggcagcctgatcatcagattcagcagccccttcgacatcgccgacaccagcaccgccttcttctgctactacgtgcactactgggagaagggcggcatccagcaggtgaagggccccttcagaagcaacagcatcagcctggacaacctgaagcccagcagagtgtactgcctgcaggtgcaggcccagctgctgtggaacaagagcaacatcttcagagtgggccacctgagcaacatcagctgctacgagaccatggccgacgccagcaccgagctgcagcaggtgatcctgatcagcgtgggcaccttcagcctgctgagcgtgctggccggcgcctgcttcttcctggtgctgaagtacagaggcctgatcaagtactggttccacaccccccccagcatccccctgcagatcgaggagtacctgaaggaccccacccagcccatcctggaggccctggacaaggacagcagccccaaggacgacgtgtgggacagcgtgagcatcatcagcttccccgagaaggagcaggaggacgtgctgcagaccctgtag

SEQ ID NO: 85444 - DNA, 378 bp, Artificial Sequence
  Description of Artificial Sequence: Synthetic coding sequence
atgcacaaggaggagcacgaggtggccgtgctgggccccccccccagcaccatcctgcccagaagcaccgtgatcaacatccacagcgagaccagcgtgcccgaccacgtggtgtggagcctgttcaacaccctgttcctgaactggtgctgcctgggcttcatcgccttcgcctacagcgtgaagagcagagacagaaagatggtgggcgacgtgaccggcgcccaggcctacgccagcaccgccaagtgcctgaacatctgggccctgatcctgggcatcctgatgaccatcggcttcatcctgctgctggtgttcggcagcgtgaccgtgtaccacatcatgctgcagatcatccaggagaagagaggctactag

SEQ ID NO: 85445 - DNA, 378 bp, Artificial Sequence; identical to SEQ ID NO: 85444
  Description of Artificial Sequence: Synthetic coding sequence

SEQ ID NO: 85446 - DNA, 300 bp, Artificial Sequence
  Description of Artificial Sequence: Synthetic coding sequence
ccccagagccagaagatgcacaaggaggagcacgaggtggccgtgctgggccccccccccagcaccatcctgcccagaagcaccgtgatcaacatccacagcgagaccagcgtgcccgaccacgtggtggtgcccgtgcagcaccccctgctggagtgctgcctgggcttcatcgccttcgcctacagcgtgaagagcagagacagaaagatggtgggcgacgtgaccggcgcccaggccctgcacagacaggtgcccgagcacctgggccccgacagcggccacccccacgaccactag

SEQ ID NO: 85447 - DNA, 378 bp, Artificial Sequence; identical to SEQ ID NO: 85444
  Description of Artificial Sequence: Synthetic coding sequence

SEQ ID NO: 85448 - DNA, 495 bp, Artificial Sequence
  Description of Artificial Sequence: Synthetic coding sequence
atgaaccacatcgtgcagaccttcagccccgtgaacagcggccagccccccaactacgagatgctgaaggaggagcaggaggtggccatgctgggcgtgccccacaaccccgccccccccatgagcaccgtgatccacatcagaagcgagaccagcgtgcccgaccacgtggtggtgcccgtgcagcaccccctgcacgagtgctgcctgggcttcatcgccttcgcctacagcgtgaagagcagagacagaaagatggtgggcgacgtgaccggcgcccaggccctgcacagacaggtgcccgagcacctgggccccgacttcggccacctgcacgaccacagcgcccaccaccaccccagcgtgggcagacccggccccgccatcgaccaggaggccagcctgagacccggcgccctgcccgtgacctgcatccccagaaccctgagcagcatccccagacccgcccccagaggccaggagctgtgcccctag

SEQ ID NO: 85449 - DNA, 399 bp, Artificial Sequence
  Description of Artificial Sequence: Synthetic coding sequence
atgaaccacatcgtgcagaccttcagccccgtgaacagcggccagccccccaactacgagatgctgaaggaggagcaggaggtggccatgctgggcgtgccccacaaccccgccccccccatgagcaccgtgatccacatcagaagcgagaccagcgtgcccgaccacgtggtgtggagcctgttcaacaccctgttcatgaacacctgctgcctgggcttcatcgccttcgcctacagcgtgaagagcagagacagaaagatggtgggcgacgtgaccggcgcccaggcctacgccagcaccgccaagtgcctgaacatctgggccctgatcctgggcatcttcatgaccatcctgctgatcatcatccccgtgctggtggtgcaggcccagagatag

SEQ ID NO: 85450 - DNA, 447 bp, Artificial Sequence
  Description of Artificial Sequence: Synthetic coding sequence
ccccccaactacgagatgctgaaggaggagcacgaggtggccgtgctgggcgccccccacaaccccgccccccccaccagcaccgtgatccacatcagaagcgagaccagcgtgcccgaccacgtggtggtgcccgtgcagcaccccctgcacgagtgctgcctgggcttcatcgccttcgcctacagcgtgaagagcagagacagaaagatggtgggcgacgtgaccggcgcccaggccctgcacagacaggtgcccgagcacctgggccccgacagcggccacccccacgaccacagcgcccacagacaccccagcgccgacctgcccggcctgtggatcgaccaggaggccagcctgagacccggcgccctgcccatgacctgcatccccagaacccccaccagcatccccagacccgcccccggcgccgagagctgcatctag

SEQ ID NO: 85451 - DNA, 402 bp, Artificial Sequence
  Description of Artificial Sequence: Synthetic coding sequence
atgaaccacaccgtgcagaccttcttcagccccgtgaacagcggccagccccccaactacgagatgctgaaggaggagcacgaggtggccgtgctgggcgccccccacaaccccgccccccccaccagcaccgtgatccacatcagaagcgagaccagcgtgcccgaccacgtggtgtggagcctgttcaacaccctgttcatgaacccctgctgcctgggcttcatcgccttcgcctacagcgtgaagagcagagacagaaagatggtgggcgacgtgaccggcgcccaggcctacgccagcaccgccaagtgcctgaacatctgggccctgatcctgggcatcctgatgaccatcctgctgatcgtgatccccgtgctgatcttccaggcctacggctag

SEQ ID NO: 85452 - DNA, 3078 bp, Artificial Sequence
  Description of Artificial Sequence: Synthetic coding sequence
atgagcaacggctacagcaccgacgagaacttcagatacctgatcagctgcttcagagccagagtgaagatgtacatccaggtggagcccgtgctggactacctgaccttcctgcccgccgaggtgaaggagcagatccagagaaccgtggccaccagcggcaacatgcaggccgtggagctgctgctgagcaccctggagaagggcgtgtggcacctgggctggaccagagagttcgtggaggccctgagaagaaccggcagccccctggccgccagatacatgaaccccgagctgaccgacctgcccagccccagcttcgagaacgcccacgacgagtacctgcagctgctgaacctgctgcagcccaccctggtggacaagctgctggtgagagacgtgctggacaagtgcatggaggaggagctgctgaccatcgaggacagaaacagaatcgccgccgccgagaacaacggcaacgagagcggcgtgagagagctgctgaagagaatcgtgcagaaggagaactggttcagcgccttcctgaacgtgctgagacagaccggcaacaacgagctggtgcaggagctgaccggcagcgactgcagcgagagcaacgccgagatcgagaacctgagccaggtggacggcccccaggtggaggagcagctgctgagcaccaccgtgcagcccaacctggagaaggaggtgtggggcatggagaacaacagcagcgagagcagcttcgccgacagcagcgtggtgagcgagagcgacaccagcctggccgagggcagcgtgagctgcctggacgagagcctgggccacaacagcaacatgggcagcgacagcggcaccatgggcagcgacagcgacgaggagaacgtggccgccagagccagccccgagcccgagctgcagctgagaccctaccagatggaggtggcccagcccgccctggagggcaagaacatcatcatctgcctgcccaccggcagcggcaagaccagagtggccgtgtacatcgccaaggaccacctggacaagaagaagaaggccagcgagcccggcaaggtgatcgtgctggtgaacaaggtgctgctggtggagcagctgttcagaaaggagttccagcccttcctgaagaagtggtacagagtgatcggcctgagcggcgacacccagctgaagatcagcttccccgaggtggtgaagagctgcgacatcatcatcagcaccgcccagatcctggagaacagcctgctgaacctggagaacggcgaggacgccggcgtgcagctgagcgacttcagcctgatcatcatcgacgagtgccaccacaccaacaaggaggccgtgtacaacaacatcatgagacactacctgatgcagaagctgaagaacaacagactgaagaaggagaacaagcccgtgatccccctgccccagatcctgggcctgaccgccagccccggcgtgggcggcgccaccaagcaggccaaggccgaggagcacatcctgaagctgtgcgccaacctggacgccttcaccatcaagaccgtgaaggagaacctggaccagctgaagaaccagatccaggagccctgcaagaagttcgccatcgccgacgccaccagagaggaccccttcaaggagaagctgctggagatcatgaccagaatccagacctactgccagatgagccccatgagcgacttcggcacccagccctacgagcagtgggccatccagatggagaagaaggccgccaaggagggcaacagaaaggagagagtgtgcgccgagcacctgagaaagtacaacgaggccctgcagatcaacgacaccatcagaatgatcgacgcctacacccacctggagaccttctacaacgaggagaaggacaagaagttcgccgtgatcgaggacgacagcgacgagggcggcgacgacgagtactgcgacggcgacgaggacgaggacgacctgaagaagcccctgaagctggacgagaccgacagattcctgatgaccctgttcttcgagaacaacaagatgctgaagagactggccgagaaccccgagtacgagaacgagaagctgaccaagctgagaaacaccatcatggagcagtacaccagaaccgaggagagcgccagaggcatcatcttcaccaagaccagacagagcgcctacgccctgagccagtggatcaccgagaacgagaagttcgccgaggtgggcgtgaaggcccaccacctgatcggcgccggccacagcagcgagttcaagcccatgacccagaacgagcagaaggaggtgatcagcaagttcagaaccggcaagatcaacctgctgatcgccaccaccgtggccgaggagggcctggacatcaaggagtgcaacatcgtgatcagatacggcctggtgaccaacgagatcgccatggtgcaggccagaggcagagccagagccgacgagagcacctacgtgctggtggcccacagcggcagcggcgtgatcgagcacgagaccgtgaacgacttcagagagaagatgatgtacaaggccatccactgcgtgcagaacatgaagcccgaggagtacgcccacaagatcctggagctgcagatgcagagcatcatggagaagaagatgaagaccaagagaaacatcgccaagcactacaagaacaaccccagcctgatcaccttcctgtgcaagaactgcagcgtgctggcctgcagcggcgaggacatccacgtgatcgagaagatgcaccacgtgaacatgacccccgagttcaaggagctgtacatcgtgagagagaacaaggccctgcagaagaagtgcgccgactaccagatcaacggcgagatcatctgcaagtgcggccaggcctggggcaccatgatggtgcacaagggcctggacctgccctgcctgaagatcagaaacttcgtggtggtgttcaagaacaacagcaccaagaagcagtacaagaagtgggtggagctgcccatcaccttccccaacctggactacagcgagtgctgcctgttcagcgacgaggactag

SEQ ID NO: 85453 - DNA, 666 bp, Artificial Sequence
  Description of Artificial Sequence: Synthetic coding sequence
atgagcaacggctacagcaccgacgagaacttcagatacctgatcagctgcttcagagccagagtgaagatgtacatccaggtggagcccgtgctggactacctgaccttcctgcccgccgaggtgaaggagcagatccagagaaccgtggccaccagcggcaacatgcaggccgtggagctgctgctgagcaccctggagaagggcgtgtggcacctgggctggaccagagagttcgtggaggccctgagaagaaccggcagccccctggccgccagatacatgaaccccgagctgaccgacctgcccagccccagcttcgagaacgcccacgacgagtacctgcagctgctgaacctgctgcagcccaccctggtggacaagctgctggtgagagacgtgctggacaagtgcatggaggaggagctgctgaccatcgaggacagaaacagaatcgccgccgccgagaacaacggcaacgagagcggcgtgagagagctgctgaagagaatcgtgcagaaggagaactggttcagcgccttcctgaacgtgctgagacagaccggcaacaacgagctggtgcaggagctgaccggcagcgactgcagcgagagcaacgccggcatctgcaacttcaccgaggaggacagcagcaacagcgcctag

SEQ ID NO: 85454 - DNA, 3078 bp, Artificial Sequence; identical to SEQ ID NO: 85452
  Description of Artificial Sequence: Synthetic coding sequence

SEQ ID NO: 85455 - DNA, 1050 bp, Artificial Sequence
  Description of Artificial Sequence: Synthetic coding sequence
atgcccgtggagagaatgagaatgagaccctggctggaggagcagatcaacagcaacaccatccccggcctgaagtggctgaacaaggagaagaagatcttccagatcccctggatgcacgccgccagacacggctgggacgtggagaaggacgcccccctgttcagaaactgggccatccacaccggcaagcaccagcccggcgtggacaagcccgaccccaagacctggaaggccaacttcagatgcgccatgaacagcctgcccgacatcgaggaggtgaaggacaagagcatcaagaagggcaacaacgccttcagagtgtacagaatgctgcccctgagcgagagacccagcaagaagggcaagaagcccaagaccgagaaggaggacaaggtgaagcacatcaagcaggagcccgtggagagcagcctgggcctgagcaacggcgtgagcgacctgagccccgagtacgccgtgctgaccagcaccatcaagaacgaggtggacagcaccgtgaacatcatcgtggtgggccagagccacctggacagcaacatcgagaaccaggagatcgtgaccaacccccccgacatctgccaggtggtggaggtgaccaccgagagcgacgagcagcccgtgagcatgagcgagctgtaccccctgcagatcagccccgtgagcagctacgccgagagcgagaccaccgacagcgtgcccagcgacgaggagagcgccgagggcagaccccactggagaaagagaaacatcgagggcaagcagtacctgagcaacatgggcaccagaggcagctacctgctgcccggcatggccagcttcgtgaccagcaacaagcccgacctgcaggtgaccatcaaggaggagagcaaccccgtgccctacaacagcagctggccccccttccaggacctgcccctgagcagcagcatgacccccgccagcagcagcagcagacccgacagagagaccagagccagcgtgatcaagaagaccagcgacatcacccaggccagagtgaagagctgctag

SEQ ID NO: 85456 - DNA, 414 bp, Artificial Sequence
  Description of Artificial Sequence: Synthetic coding sequence
atgcccgtggagagaatgagaatgagaccctggctggaggagcagatcaacagcaacaccatccccggcctgaagtggctgaacaaggagaagaagatcttccagatcccctggatgcacgccgccagacacggctgggacgtggagaaggacgcccccctgttcagaaactgggccatccacaccggcaagcaccagcccggcgtggacaagcccgaccccaagacctggaaggccaacttcagatgcgccatgaacagcctgcccgacatcgaggaggtgaaggacaagagcatcaagaagggcaacaacgccttcagagtgtacagaatgctgcccctgagcgagagacccagcaagaagggcaagaagcccaagaccgagaaggaggacaaggtgaagcacatcaagtag

SEQ ID NO: 85457 - DNA, 414 bp, Artificial Sequence; identical to SEQ ID NO: 85456
  Description of Artificial Sequence: Synthetic coding sequence

SEQ ID NO: 85458 - DNA, 531 bp, Artificial Sequence
  Description of Artificial Sequence: Synthetic coding sequence
atgcccgtggagagaatgagaatgagaccctggctggaggagcagatcaacagcaacaccatccccggcctgaagtggctgaacaaggagaagaagatcttccagatcccctggatgcacgccgccagacacggctgggacgtggagaaggacgcccccctgttcagaaactgggccatccacaccggcaagcaccagcccggcgtggacaagcccgaccccaagacctggaaggccaacttcagatgcgccatgaacagcctgcccgacatcgaggaggtgaaggacaagagcatcaagaagggcaacaacgccttcagagtgtacagaatgctgcccctgagcgagagacccagcaagaagggcaagaagcccaagaccgagaaggaggacaaggtgaagcacatcaagcaggagcccgtggagagcagcctgggcctgagcaacggcgtgagcgacctgagccccgagtacgccgtgctgaccagcaccatcaagaacgaggtggacagcaccgtgaacatcatctag

SEQ ID NO: 85459 - DNA, 486 bp, Artificial Sequence
  Description of Artificial Sequence: Synthetic coding sequence
atgcccgtggagagaatgagaatgagaccctggctggaggagcagatcaacagcaacaccatccccggcctgaagtggctgaacaaggagaagaagatcttccagatcccctggatgcacgccgccagacacggctgggacgtggagaaggacgcccccctgttcagaaactgggccatccacaccggcaagcaccagcccggcgtggacaagcccgaccccaagacctggaaggccaacttcagatgcgccatgaacagcctgcccgacatcgaggaggtgaaggacaagagcatcaagaagggcaacaacgccttcagagtgtacagaatgctgcccctgagcgagagacccagcaagaagggcaagaagcccaagaccgagaaggaggacaaggtgaagcacatcaagcaggagcccgtggagagcagcctgggcctgagcaacggcgtgagcgacctgagccccgagtacgccgtgctgtag

SEQ ID NO: 85460 - DNA, 1284 bp, Artificial Sequence
  Description of Artificial Sequence: Synthetic coding sequence
atgggcacccccaagcccagaatcctgccctggctggtgagccagctggacctgggccagctggagggcgtggcctgggtgaacaagagcagaaccagattcagaatcccctggaagcacggcctgagacaggacgcccagcaggaggacttcggcatcttccaggcctgggccgaggccaccggcgcctacgtgcccggcagagacaagcccgacctgcccacctggaagagaaacttcagaagcgccctgaacagaaaggagggcctgagactggccgaggacagaagcaaggacccccacgacccccacaagatctacgagttcgtgaacagcggcgtgggcgacttcagccagcccgacaccagccccgacaccaacggcggcggcagcaccagcgacacccaggaggacatcctggacgagctgctgggcaacatggtgctggcccccctgcccgaccccggcccccccagcctggccgtggcccccgagccctgcccccagcccctgagaagccccagcctggacaaccccacccccttccccaacctgggccccagcgagaaccccctgaagagactgctggtgcccggcgaggagtgggagttcgaggtgaccgccttctacagaggcagacaggtgttccagcagaccatcagctgccccgagggcctgagactggtgggcagcgaggtgggcgacagaaccctgcccggctggcccgtgaccctgcccgaccccggcatgagcctgaccgacagaggcgtgatgagctacgtgagacacgtgctgagctgcctgggcggcggcctggccctgtggagagccggccagtggctgtgggcccagagactgggccactgccacacctactgggccgtgagcgaggagctgctgcccaacagcggccacggccccgacggcgaggtgcccaaggacaaggagggcggcgtgttcgacctgggccccttcatcgtggacctgatcaccttcaccgagggcagcggcagaagccccagatacgccctgtggttctgcgtgggcgagagctggccccaggaccagccctggaccaagagactggtgatggtgaaggtggtgcccacctgcctgagagccctggtggagatggccagagtgggcggcgccagcagcctggagaacaccgtggacctgcacatcagcaacagccaccccctgagcctgaccagcgaccagtacaaggcctacctgcaggacctggtggagggcatggacttccagggccccggcgagagctag

SEQ ID NO: 85461 - DNA, 903 bp, Artificial Sequence
  Description of Artificial Sequence: Synthetic coding sequence
atgggcacccccaagcccagaatcctgccctggctggtgagccagctggacctgggccagctggagggcgtggcctgggtgaacaagagcagaaccagattcagaatcccctggaagcacggcctgagacaggacgcccagcaggaggacttcggcatcttccaggcctgggccgaggccaccggcgcctacgtgcccggcagagacaagcccgacctgcccacctggaagagaaacttcagaagcgccctgaacagaaaggagggcctgagactggccgaggacagaagcaaggacccccacgacccccacaagatctacgagttcgtgaacagcggcgtgggcgacttcagccagcccgacaccagccccgacaccaacggcggcggcagcaccagcgacacccaggaggacatcctggacgagctgctgggcaacatggtgctggcccccctgcccgaccccggcccccccagcctggccgtggcccccgagccctgcccccagcccctgagaagccccagcctggacaaccccacccccttccccaacctgggccccagcgagaaccccctgaagagactgctggtgcccggcgaggacctgatcaccttcaccgagggcagcggcagaagccccagatacgccctgtggttctgcgtgggcgagagctggccccaggaccagccctggaccaagagactggtgatggtgaaggtggtgcccacctgcctgagagccctggtggagatggccagagtgggcggcgccagcagcctggagaacaccgtggacctgcacatcagcaacagccaccccctgagcctgaccagcgaccagtacaaggcctacctgcaggacctggtggagggcatggacttccagggccccggcgagagctag

SEQ ID NO: 85462 - DNA, 1284 bp, Artificial Sequence; identical to SEQ ID NO: 85460
  Description of Artificial Sequence: Synthetic coding sequence

SEQ ID NO: 85463 - DNA, 315 bp, Artificial Sequence
  Description of Artificial Sequence: Synthetic coding sequence
atgggcacccccaagcccagaatcctgccctggctggtgagccagctggacctgggccagctggagggcgtggcctgggtgaacaagagcagaaccagattcagaatcccctggaagcacggcctgagacaggacgcccagcaggaggacttcggcatcttccaggagctgggcaccttccccagccagacccccctgagaacccccatggtggaggccgtgctgctgatccccagaaagaccttctggatgagctactgggtgacctggtgctggccccacagccagatcagagacccccaggcctggctgtag

SEQ ID NO: 85464 - DNA, 846 bp, Artificial Sequence
  Description of Artificial Sequence: Synthetic coding sequence
atggtgctggcccccctgcccgaccccggcccccccagcctggccgtggcccccgagccctgcccccagcccctgagaagccccagcctggacaaccccacccccttccccaacctgggccccagcgagaaccccctgaagagactgctggtgcccggcgaggagtgggagttcgaggtgaccgccttctacagaggcagacaggtgttccagcagaccatcagctgccccgagggcctgagactggtgggcagcgaggtgggcgacagaaccctgcccggctggcccgtgaccctgcccgaccccggcatgagcctgaccgacagaggcgtgatgagctacgtgagacacgtgctgagctgcctgggcggcggcctggccctgtggagagccggccagtggctgtgggcccagagactgggccactgccacacctactgggccgtgagcgaggagctgctgcccaacagcggccacggccccgacggcgaggtgcccaaggacaaggagggcggcgtgttcgacctgggccccttcatcgtggacctgatcaccttcaccgagggcagcggcagaagccccagatacgccctgtggttctgcgtgggcgagagctggccccaggaccagccctggaccaagagactggtgatggtgaaggtggtgcccacctgcctgagagccctggtggagatggccagagtgggcggcgccagcagcctggagaacaccgtggacctgcacatcagcaacagccaccccctgagcctgaccagcgaccagtacaaggcctacctgcaggacctggtggagggcatggacttccagggccccggcgagagctag

SEQ ID NO: 85465 - DNA, 465 bp, Artificial Sequence
  Description of Artificial Sequence: Synthetic coding sequence
atggtgctggcccccctgcccgaccccggcccccccagcctggccgtggcccccgagccctgcccccagcccctgagaagccccagcctggacaaccccacccccttccccaacctgggccccagcgagaaccccctgaagagactgctggtgcccggcgaggacctgatcaccttcaccgagggcagcggcagaagccccagatacgccctgtggttctgcgtgggcgagagctggccccaggaccagccctggaccaagagactggtgatggtgaaggtggtgcccacctgcctgagagccctggtggagatggccagagtgggcggcgccagcagcctggagaacaccgtggacctgcacatcagcaacagccaccccctgagcctgaccagcgaccagtacaaggcctacctgcaggacctggtggagggcatggacttccagggccccggcgagagctag

SEQ ID NO: 85466 - DNA, 846 bp, Artificial Sequence; identical to SEQ ID NO: 85464
  Description of Artificial Sequence: Synthetic coding sequence

SEQ ID NO: 85467 - DNA, 903 bp, Artificial Sequence; identical to SEQ ID NO: 85461
  Description of Artificial Sequence: Synthetic coding sequence

SEQ ID NO: 85468 - DNA, 465 bp, Artificial Sequence; identical to SEQ ID NO: 85465
  Description of Artificial Sequence: Synthetic coding sequence

SEQ ID NO: 85469 - DNA, 1404 bp, Artificial Sequence
  Description of Artificial Sequence: Synthetic coding sequence
atggccctgcaccccagaagagtgagactgaagccctggctggtggcccaggtggacagcggcctgtaccccggcctgatctggctgcacagagacagcaagagattccagatcccctggaagcacgccaccagacacagcccccagcaggaggaggagaacaccatcttcaaggcctgggccgtggagaccggcaagtaccaggagggcgtggacgaccccgaccccgccaagtggaaggcccagctgagatgcgccctgaacaagagcagagagttcaacctgatgtacgacggcaccaaggaggtgcccatgaaccccgtgaagatctaccaggtgtgcgacatcccccagccccagggcagcatcatcaaccccggcagcaccggcagcgccccctgggacgagaaggacaacgacgtggacgaggaggacgaggaggacgagctggaccagagccagcaccacgtgcccatccaggacaccttccccttcctgaacatcaacggcagccccatggcccccgccagcgtgggcaactgcagcgtgggcaactgcagccccgaggccgtgtggcccaagaccgagcccctggagatggaggtgccccaggcccccatccagcccttctacagcagccccgagctgtggatcagcagcctgcccatgaccgacctggacatcaagttccagtacagaggcaaggagtacggccagaccatgaccgtgagcaacccccagggctgcagactgttctacggcgacctgggccccatgcccgaccaggaggagctgttcggccccgtgagcctggagcaggtgaagttccccggccccgagcacatcaccaacgagaagcagaagctgttcaccagcaagctgctggacgtgatggacagaggcctgatcctggaggtgagcggccacgccatctacgccatcagactgtgccagtgcaaggtgtactggagcggcccctgcgcccccagcctggtggcccccaacctgatcgagagacagaagaaggtgaagctgttctgcctggagaccttcctgagcgacctgatcgcccaccagaagggccagatcgagaagcagccccccttcgagatctacctgtgcttcggcgaggagtggcccgacggcaagcccctggagagaaagctgatcctggtgcaggtgatccccgtggtggccagaatgatctacgagatgttcagcggcgacttcaccagaagcttcgacagcggcagcgtgagactgcagatcagcacccccgacatcaaggacaacatcgtggcccagctgaagcagctgtacagaatcctgcagacccaggagagctggcagcccatgcagcccacccccagcatgcagctgccccccgccctgcccccccagtag

SEQ ID NO: 85470 - DNA, 831 bp, Artificial Sequence
  Description of Artificial Sequence: Synthetic coding sequence
atggccctgcaccccagaagagtgagactgaagccctggctggtggcccaggtggacagcggcctgtaccccggcctgatctggctgcacagagacagcaagagattccagatcccctggaagcacgccaccagacacagcccccagcaggaggaggagaacaccatcttcaaggcctgggccgtggagaccggcaagtaccaggagggcgtggacgaccccgaccccgccaagtggaaggcccagctgagatgcgccctgaacaagagcagagagttcaacctgatgtacgacggcaccaaggaggtgcccatgaaccccgtgaagatctaccaggtgtgcgacatcccccagccccagggcagcatcatcaaccccggcagcaccggcagcgccccctgggacgagaaggacaacgacgtggacgaggaggacgaggaggacgagctggaccagagccagcaccacgtgcccatccaggacaccttccccttcctgaacatcaacggcagccccatggcccccgccagcgtgggcaactgcagcgtgggcaactgcagccccgaggccgtgtggcccaagaccgagcccctggagatggaggtgccccaggcccccatccagcccttctacagcagccccgagctgtggatcagcagcctgcccatgaccgacctggacatcaagttccagtacagaggcaaggagtacggccagaccatgaccgtgagcaacccccagggctgcagactgttctacggcgacctgggccccatgcccgaccaggaggagctgttcggccccgtgagcctggagcaggtgaagttctag

SEQ ID NO: 85471 - DNA, 1119 bp, Artificial Sequence
  Description of Artificial Sequence: Synthetic coding sequence
atgtacgacggcaccaaggaggtgcccatgaaccccgtgaagatctaccaggtgtgcgacatcccccagccccagggcagcatcatcaaccccggcagcaccggcagcgccccctgggacgagaaggacaacgacgtggacgaggaggacgaggaggacgagctggaccagagccagcaccacgtgcccatccaggacaccttccccttcctgaacatcaacggcagccccatggcccccgccagcgtgggcaactgcagcgtgggcaactgcagccccgaggccgtgtggcccaagaccgagcccctggagatggaggtgccccaggcccccatccagcccttctacagcagccccgagctgtggatcagcagcctgcccatgaccgacctggacatcaagttccagtacagaggcaaggagtacggccagaccatgaccgtgagcaacccccagggctgcagactgttctacggcgacctgggccccatgcccgaccaggaggagctgttcggccccgtgagcctggagcaggtgaagttccccggccccgagcacatcaccaacgagaagcagaagctgttcaccagcaagctgctggacgtgatggacagaggcctgatcctggaggtgagcggccacgccatctacgccatcagactgtgccagtgcaaggtgtactggagcggcccctgcgcccccagcctggtggcccccaacctgatcgagagacagaagaaggtgaagctgttctgcctggagaccttcctgagcgacctgatcgcccaccagaagggccagatcgagaagcagccccccttcgagatctacctgtgcttcggcgaggagtggcccgacggcaagcccctggagagaaagctgatcctggtgcaggtgatccccgtggtggccagaatgatctacgagatgttcagcggcgacttcaccagaagcttcgacagcggcagcgtgagactgcagatcagcacccccgacatcaaggacaacatcgtggcccagctgaagcagctgtacagaatcctgcagacccaggagagctggcagcccatgcagcccacccccagcatgcagctgccccccgccctgcccccccagtag

SEQ ID NO: 85472 - DNA, 1281 bp, Artificial Sequence
  Description of Artificial Sequence: Synthetic coding sequence
atgtgcgacagaaacggcggcagaagactgagacagtggctgatcgagcagatcgacagcagcatgtaccccggcctgatctgggagaacgaggagaagagcatgttcagaatcccctggaagcacgccggcaagcaggactacaaccaggaggtggacgccagcatcttcaaggcctgggccgtgttcaagggcaagttcaaggagggcgacaaggccgagcccgccacctggaagaccagactgagatgcgccctgaacaagagccccgacttcgaggaggtgaccgacagaagccagctggacatcagcgagccctacaaggtgtacagaatcgtgcccgaggaggagcagaagtgcaagctgggcgtggccaccgccggctgcgtgaacgaggtgaccgagatggagtgcggcagaagcgagatcgacgagctgatcaaggagcccagcgtggacgactacatgggcatgatcaagagaagccccagcccccccgaggcctgcagaagccagctgctgcccgactggtgggcccagcagcccagcaccggcgtgcccctggtgaccggctacaccacctacgacgcccaccacagcgccttcagccagatggtgatcagcttctactacggcggcaagctggtgggccaggccaccaccacctgccccgagggctgcagactgagcctgagccagcccggcctgcccggcaccaagctgtacggccccgagggcctggagctggtgagattcccccccgccgacgccatccccagcgagagacagagacaggtgaccagaaagctgttcggccacctggagagaggcgtgctgctgcacagcagcagacagggcgtgttcgtgaagagactgtgccagggcagagtgttctgcagcggcaacgccgtggtgtgcaagggcagacccaacaagctggagagagacgaggtggtgcaggtgttcgacaccagccagttcttcagagagctgcagcagttctacaacagccagggcagactgcccgacggcagagtggtgctgtgcttcggcgaggagttccccgacatggcccccctgagaagcaagctgatcctggtgcagatcgagcagctgtacgtgagacagctggccgaggaggccggcaagagctgcggcgccggcagcgtgatgcaggcccccgaggagcccccccccgaccaggtgttcagaatgttccccgacatctgcgccagccaccagagaagcttcttcagagagaaccagcagatcaccgtgtag

SEQ ID NO: 85473 - DNA, 546 bp, Artificial Sequence
  Description of Artificial Sequence: Synthetic coding sequence
atggccggcagcagagaggtggtggccatggactgcgagatggtgggcctgggcccccacagagagagcggcctggccagatgcagcctggtgaacgtgcacggcgccgtgctgtacgacaagttcatcagacccgagggcgagatcaccgactacagaaccagagtgagcggcgtgaccccccagcacatggtgggcgccacccccttcgccgtggccagactggagatcctgcagctgctgaagggcaagctggtggtgggccacgacctgaagcacgacttccaggccctgaaggaggacatgagcggctacaccatctacgacaccagcaccgacagactgctgtggagagaggccaagctggaccactgcagaagagtgagcctgagagtgctgagcgagagactgctgcacaagagcatccagaacagcctgctgggccacagcagcgtggaggacgccagagccaccatggagctgtaccagatcagccagagaatcagagccagaagaggcctgcccagactggccgtgagcgactag

SEQ ID NO: 85474 - DNA, 546 bp, Artificial Sequence; identical to SEQ ID NO: 85473
  Description of Artificial Sequence: Synthetic coding sequence

SEQ ID NO: 85475 - DNA, 1062 bp, Artificial Sequence
  Description of Artificial Sequence: Synthetic coding sequence
atgagcaccctgctgctgaacctggacttcggcgagcccccccccaagaaggccctggagggcaacgccaagcacagaaacttcgtgaagaagagaagactgctggagagaagaggcttcctgagcaagaagaaccagccccccagcaaggcccccaagctgcacagcgagcccagcaagaagggcgagacccccaccgtggacggcacctggaagacccccagcttccccaagaagaagaccgccgccagcagcaacggcagcggccagcccctggacaagaaggccgccgtgagctggctgacccccgcccccagcaagaaggccgacagcgtggccgccaaggtggacctgctgggcgagttccagagcgccctgcccaagatcaacagccaccccaccagaagccagaagaagagcagccagaagaagagcagcaagaagaaccacccccagaagaacgccccccagaacagcacccaggcccacagcgagaacaagtgcagcggcgccagccagaagctgcccagaaagatggtggccatcgactgcgagatggtgggcaccggccccaagggccacgtgagcagcctggccagatgcagcatcgtgaactacaacggcgacgtgctgtacgacgagtacatcctgcccccctgccacatcgtggactacagaaccagatggagcggcatcagaaagcagcacatggtgaacgccacccccttcaagatcgccagaggccagatcctgaagatcctgaccggcaagatcgtggtgggccacgccatccacaacgacttcaaggccctgcagtacttccaccccaagagcctgaccagagacaccagccacatcccccccctgaacagaaaggccgactgccccgagaacgccaccatgagcctgaagcacctgaccaagaagctgctgaacagagacatccaggtgggcaagagcggccacagcagcgtggaggacgcccaggccaccatggagctgtacaagctggtggaggtggagtgggaggagcacctggccagaaacccccccaccgactag

SEQ ID NO: 85476 - DNA, 1062 bp, Artificial Sequence; identical to SEQ ID NO: 85475
  Description of Artificial Sequence: Synthetic coding sequence

SEQ ID NO: 85477 - DNA, 360 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcgtggtggccgtgcccatggtgctgagcgccatgggcttcaccgccgccggcatcgccagcagcagcatcgccgccaagatgatgagcgccgccgccatcgccaacggcggcggcgtggccagcggcagcctggtggccaccctgcagagcctgggcgccaccggcctgagcggcctgaccaagttcatcctgggcagcatcggcagcgccatcgccgccgtgatcgccagattctactag

SEQ ID NO: 85478 - DNA, 369 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcggcgagagcgtggtggccgtgcccatggtgctgagcgccatgggcttcaccgccgccggcatcgccagcagcagcatcgccgccaagatgatgagcgccgccgccatcgccaacggcggcggcgtggccagcggcagcctggtggccaccctgcagagcctgggcgccaccggcctgagcggcctgaccaagttcatcctgggcagcatcggcagcgccatcgccgccgtgatcgccagattctactag

SEQ ID NO: 85479 - DNA, 369 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcgtggccagcatcgtggccgtgcccatggtgctgagcgccatgggcttcaccgccgccggcatcgccagcagcagcatcgccgccaagatgatgagcgccgccgccatcgccaacggcggcggcgtggccagcggcagcctggtggccaccctgcagagcctgggcgccaccggcctgagcggcctgaccaagttcatcctgggcagcatcggcagcgccatcgccgccgtgatcgccagattctactag

SEQ ID NO: 85480 - DNA, 189 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcgtggtggccgtgcccatggtgctgagcgccatgggcttcaccgccgccggcatcgccagcagcagctag

SEQ ID NO: 85481 - DNA, 174 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcgtggtggccgtgcccatggtgctgagcgccatgggcttcaccgccgccggctag

SEQ ID NO: 85482 - DNA, 360 bp, Artificial Sequence; identical to SEQ ID NO: 85477
  Description of Artificial Sequence: Synthetic coding sequence

SEQ ID NO: 85483 - DNA, 123 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggctag

SEQ ID NO: 85484 - DNA, 282 bp, Artificial Sequence
  Description of Artificial Sequence: Synthetic coding sequence
atggaggccagcgccctgaccagcagcgccgtgaccagcgtggccaaggtggtgagagtggccagcggcagcgccgtggtgctgcccctggccagaatcgccaccgtggtgatcggcggcgtggtggccgtgcccatggtgctgagcgccatgggcttcaccgccgccggcatcgccagcagcagcatcgccgccaagatgatgagcgccgccgccatcgccaacggcggcggcgtggccagcggcagcctggtggccaccctgcagagcctgggcgcctag

SEQ ID NO: 85485 - DNA, 2358 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaagagaaagaagagcaccaaggagaaggccggccccaagggcagcaaggtgagcgaggagcagacccagccccccagccccgccggcgccggcatgagcaccgccatgggcagaagccccagccccaagaccagcctgagcgccccccccaacagcagcagcaccgagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcaacggcaagaagatcatcatcatcagcgactacctggagtacgacagcctgctggaggtgaacgaggagagcaccgtgagcgaggccggccccaaccagaccttcgaggtgcccaacaagatcatcaacagagccaaggagaccctgaagatcgacatcctgcacaagcaggccagcggcaacatcgtgtacggcgtgttcatgctgcacaagaagaccgtgaaccagaagaccaccatctacgagatccaggacgacagaggcaagatggacgtggtgggcaccggccagtgccacaacatcccctgcgaggagggcgacaagctgcagctgttctgcttcagactgagaaagaagaaccagatgagcaagctgatcagcgagatgcacagcttcatccagatcaagaagaagaccaaccccagaaacaacgaccccaagagcatgaagctgccccaggagcagagacagctgccctaccccagcgaggccagcaccaccttccccgagagccacctgagaaccccccagatgccccccaccacccccagcagcagcttcttcaccaagaagagcgaggacaccatcagcaagatgaacgacttcatgagaatgcagatcctgaaggagggcagccacttccccggccccttcatgaccagcatcggccccgccgagagccacccccacaccccccagatgccccccagcacccccagcagcagcttcctgaccaccaagagcgaggacaccatcagcaagatgaacgacttcatgagaatgcagatcctgaaggagggcagccacttccccggccccttcatgaccagcatcggccccgccgagagccacccccacaccccccagatgccccccagcacccccagcagcagcttcctgaccaccctgaagcccagactgaagaccgagcccgaggaggtgagcatcgaggacagcgcccagagcgacctgaaggaggtgatggtgctgaacgccaccgagagcttcgtgtacgagcccaaggagcagaagaagatgttccacgccaccgtggccaccgagaacgaggtgttcagagtgaaggtgttcaacatcgacctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85486 - DNA, 2022 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaagagaaagaagagcaccaaggagaaggccggccccaagggcagcaaggtgagcgaggagcagacccagccccccagccccgccggcgccggcatgagcaccgccatgggcagaagccccagccccaagaccagcctgagcgccccccccaacagcagcagcaccgagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcaacggcaagaagatcatcatcatcagcgactacctggagtacgacagcctgctggaggtgaacgaggagagcaccgtgagcgaggccggccccaaccagaccttcgaggtgcccaacaagatcatcaacagagccaaggagaccctgaagatcgacatcctgcacaagcaggccagcggcaacatcgtgtacggcgtgttcatgctgcacaagaagaccgtgaaccagaagaccaccatctacgagatccaggacgacagaggcaagatggacgtggtgggcaccggccagtgccacaacatcccctgcgaggagggcgacaagctgcagctgttctgcttcagactgagaaagaagaaccagatgagcaagctgatcagcgagatgcacagcttcatccagatcaagaagaagaccaaccccagaaacaacgaccccaagagcatgaagctgccccaggagcagagacagctgccctaccccagcgaggccagcaccaccttccccgagagccacctgagaaccccccagatgccccccaccacccccagcagcagcttcttcaccaagctgaagcccagactgaagaccgagcccgaggaggtgagcatcgaggacagcgcccagagcgacctgaaggaggtgatggtgctgaacgccaccgagagcttcgtgtacgagcccaaggagcagaagaagatgttccacgccaccgtggccaccgagaacgaggtgttcagagtgaaggtgttcaacatcgacctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85487 - DNA, 1245 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaagagaaagaagagcaccaaggagaaggccggccccaagggcagcaaggtgagcgaggagcagacccagccccccagccccgccggcgccggcatgagcaccgccatgggcagaagccccagccccaagaccagcctgagcgccccccccaacagcagcagcaccgagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85488 - DNA, 2190 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaagagaaagaagagcaccaaggagaaggccggccccaagggcagcaaggtgagcgaggagcagacccagccccccagccccgccggcgccggcatgagcaccgccatgggcagaagccccagccccaagaccagcctgagcgccccccccaacagcagcagcaccgagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcaacggcaagaagatcatcatcatcagcgactacctggagtacgacagcctgctggaggtgaacgaggagagcaccgtgagcgaggccggccccaaccagaccttcgaggtgcccaacaagatcatcaacagagccaaggagaccctgaagatcgacatcctgcacaagcaggccagcggcaacatcgtgtacggcgtgttcatgctgcacaagaagaccgtgaaccagaagaccaccatctacgagatccaggacgacagaggcaagatggacgtggtgggcaccggccagtgccacaacatcccctgcgaggagggcgacaagctgcagctgttctgcttcagactgagaaagaagaaccagatgagcaagctgatcagcgagatgcacagcttcatccagatcaagaagaagaccaaccccagaaacaacgaccccaagagcatgaagctgccccaggagcagagacagctgccctaccccagcgaggccagcaccaccttccccgagagccacctgagaaccccccagatgccccccaccacccccagcagcagcttcttcaccaagaagagcgaggacaccatcagcaagatgaacgacttcatgagaatgcagatcctgaaggagggcagccacttccccggccccttcatgaccagcatcggccccgccgagagccacccccacaccccccagatgccccccagcacccccagcagcagcttcctgaccaccctgaagcccagactgaagaccgagcccgaggaggtgagcatcgaggacagcgcccagagcgacctgaaggaggtgatggtgctgaacgccaccgagagcttcgtgtacgagcccaaggagcagaagaagatgttccacgccaccgtggccaccgagaacgaggtgttcagagtgaaggtgttcaacatcgacctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85489 - DNA, 2190 bp, Artificial Sequence; identical to SEQ ID NO: 85488
  Description of Artificial Sequence: Synthetic coding sequence

SEQ ID NO: 85490 - DNA, 384 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagtag

SEQ ID NO: 85491 - DNA, 2202 bp, Artificial Sequence
  Description of Artificial Sequence: Synthetic coding sequence
atgagcgtgaagatgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcaacggcaagaagatcatcatcatcagcgactacctggagtacgacagcctgctggaggtgaacgaggagagcaccgtgagcgaggccggccccaaccagaccttcgaggtgcccaacaagatcatcaacagagccaaggagaccctgaagatcgacatcctgcacaagcaggccagcggcaacatcgtgtacggcgtgttcatgctgcacaagaagaccgtgaaccagaagaccaccatctacgagatccaggacgacagaggcaagatggacgtggtgggcaccggccagtgccacaacatcccctgcgaggagggcgacaagctgcagctgttctgcttcagactgagaaagaagaaccagatgagcaagctgatcagcgagatgcacagcttcatccagatcaagaagaagaccaaccccagaaacaacgaccccaagagcatgaagctgccccaggagcagagacagctgccctaccccagcgaggccagcaccaccttccccgagagccacctgagaaccccccagatgccccccaccacccccagcagcagcttcttcaccaagaagagcgaggacaccatcagcaagatgaacgacttcatgagaatgcagatcctgaaggagggcagccacttccccggccccttcatgaccagcatcggccccgccgagagccacccccacaccccccagatgccccccagcacccccagcagcagcttcctgaccaccaagagcgaggacaccatcagcaagatgaacgacttcatgagaatgcagatcctgaaggagggcagccacttccccggccccttcatgaccagcatcggccccgccgagagccacccccacaccccccagatgccccccagcacccccagcagcagcttcctgaccaccctgaagcccagactgaagaccgagcccgaggaggtgagcatcgaggacagcgcccagagcgacctgaaggaggtgatggtgctgaacgccaccgagagcttcgtgtacgagcccaaggagcagaagaagatgttccacgccaccgtggccaccgagaacgaggtgttcagagtgaaggtgttcaacatcgacctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85492 - DNA, 543 bp, Artificial Sequence
  Description of Artificial Sequence: Synthetic coding sequence
atgggcaagaagtacaagaacatcgtgctgctgaagggcctggaggtgatcaacgactaccacttcagaatggtgaagagcctgctgagcaacgacctgaagctgaacctgaagatgagagaggagtacgacaagatccagatcgccgacctgatggaggagaagttcagaggcgacgccggcctgggcaagctgatcaagatcttcgaggacatccccaccctggaggacctggccgagaccctgaagaaggagaagctgaaggtgaagggccccgccctgagcagaaagagaaagaaggaggtggacgccaccagccccgcccccagcaccagcagcaccgtgaagaccgagggcgccgaggccacccccggcgcccagaagagaaagaagagcaccaaggagaaggccggccccaagggcagcaaggtgagcgaggagcagacccagccccccagccccgccggcgccggcatgagcaccgccatgggcagaagccccagccccaagaccagcctgagcgccccccccaacagcagctag

SEQ ID NO: 85493 - DNA, 1485 bp, Artificial Sequence
  Description of Artificial Sequence: Synthetic coding sequence
tgaagcaccgagaaccccaagaccgtggccaagtgccaggtgacccccagaagaaacgtgctgcagaagagacccgtgatcgtgaaggtgctgagcaccaccaagcccttcgagtacgagacccccgagatggagaagaagatcatgttccacgccaccgtggccacccagacccagttcttccacgtgaaggtgctgaacaccagcctgaaggagaagttcaacggcaagaagatcatcatcatcagcgactacctggagtacgacagcctgctggaggtgaacgaggagagcaccgtgagcgaggccggccccaaccagaccttcgaggtgcccaacaagatcatcaacagagccaaggagaccctgaagatcgacatcctgcacaagcaggccagcggcaacatcgtgtacggcgtgttcatgctgcacaagaagaccgtgaaccagaagaccaccatctacgagatccaggacgacagaggcaagatggacgtggtgggcaccggccagtgccacaacatcccctgcgaggagggcgacaagctgcagctgttctgcttcagactgagaaagaagaaccagatgagcaagctgatcagcgagatgcacagcttcatccagatcaagaagaagaccaaccccagaaacaacgaccccaagagcatgaagctgccccaggagcagagacagctgccctaccccagcgaggccagcaccaccttccccgagagccacctgagaaccccccagatgccccccaccacccccagcagcagcttcttcaccaagctgaagcccagactgaagaccgagcccgaggaggtgagcatcgaggacagcgcccagagcgacctgaaggaggtgatggtgctgaacgccaccgagagcttcgtgtacgagcccaaggagcagaagaagatgttccacgccaccgtggccaccgagaacgaggtgttcagagtgaaggtgttcaacatcgacctgaaggagaagttcacccccaagaagatcatcgccatcgccaactacgtgtgcagaaacggcttcctggaggtgtaccccttcaccctggtggccgacgtgaacgccgacagaaacatggagatccccaagggcctgatcagaagcgccagcgtgacccccaagatcaaccagctgtgcagccagaccaagggcagcttcgtgaacggcgtgttcgaggtgcacaagaagaacgtgagaggcgagttcacctactacgagatccaggacaacaccggcaagatggaggtggtggtgcacggcagactgaccaccatcaactgcgaggagggcgacaagctgaagctgacctgcttcgagctggcccccaagagcggcaacaccggcgagctgagaagcgtgatccacagccacatcaaggtgatcaagaccagaaagaacaagaaggacatcctgaaccccgacagcagcatggagaccagccccgacttcttcttctag

SEQ ID NO: 85494 - DNA, 753 bp, Artificial Sequence
  Description of Artificial Sequence: Synthetic coding sequence
atgaccctgagccccctgctgctgttcctgccccccctgctgctgctgctggacgtgcccaccgccgccgtgcaggccagccccctgcaggccctggacttcttcggcaacggcccccccgtgaactacaagaccggcaacctgtacctgagaggccccctgaagaagagcaacgcccccctggtgaacgtgaccctgtactacgaggccctgtgcggcggctgcagagccttcctgatcagagagctgttccccacctggctgctggtgatggagatcctgaacgtgaccctggtgccctacggcaacgcccaggagcagaacgtgagcggcagatgggagttcaagtgccagcacggcgaggaggagtgcaagttcaacaaggtggaggcctgcgtgctggacgagctggacatggagctggccttcctgaccatcgtgtgcatggaggagttcgaggacatggagagaagcctgcccctgtgcctgcagctgtacgcccccggcctgagccccgacaccatcatggagtgcgccatgggcgacagaggcatgcagctgatgcacgccaacgcccagagaaccgacgccctgcagcccccccacgagtacgtgccctgggtgaccgtgaacggcaagcccctggaggaccagacccagctgctgaccctggtgtgccagctgtaccagggcaagaagcccgacgtgtgccccagcagcaccagcagcctgagaagcgtgtgcttcaagtag

SEQ ID NO: 85495 - DNA, 588 bp, Artificial Sequence
  Description of Artificial Sequence: Synthetic coding sequence
atggccctgctgttccccctgctggccgccctggtgatgaccagctacagccccgtgggcagcctgggctgcgacctgccccagaaccacggcctgctgagcagaaacaccctggtgctgctgcaccagatgagaagaatcagccccttcctgtgcctgaaggacagaagagacttcagattcccccaggagatggtgaagggcagccagctgcagaaggcccacgtgatgagcgtgctgcacgagatgctgcagcagatcttcagcctgttccacaccgagagaagcagcgccgcctggaacatgaccctgctggaccagctgcacaccggcctgcaccagcagctgcagcacctggagacctgcctgctgcaggtggtgggcgagggcgagagcgccggcgccatcagcagccccgccctgaccctgagaagatacttccagggcatcagagtgtacctgaaggagaagaagtacagcgactgcgcctgggaggtggtgagaatggagatcatgaagagcctgttcctgagcaccaacatgcaggagagactgagaagcaaggacagagacctgggcagcagctag

SEQ ID NO: 85496 - DNA, 861 bp, Artificial Sequence
  Description of Artificial Sequence: Synthetic coding sequence
atgagcgcccccctggacgccgccctgcacgccctgcaggaggagcaggccagactgaagatgagactgtgggacctgcagcagctgagaaaggagctgggcgacagccccaaggacaaggtgcccttcagcgtgcccaagatccccctggtgttcagaggccacacccagcaggaccccgaggtgcccaagagcctggtgagcaacctgagaatccactgccccctgctggccggcagcgccctgatcaccttcgacgaccccaaggtggccgagcaggtgctgcagcagaaggagcacaccatcaacatggaggagtgcagactgagagtgcaggtgcagcccctggagctgcccatggtgaccaccatccagatgagcagccagctgagcggcagaagagtgctggtgaccggcttccccgccagcctgagactgagcgaggaggagctgctggacaagctggagatcttcttcggcaagaccagaaacggcggcggcgacgtggacgtgagagagctgctgcccggcagcgtgatgctgggcttcgccagagacggcgtggcccagagactgtgccagatcggccagttcaccgtgcccctgggcggccagcaggtgcccctgagagtgagcccctacgtgaacggcgagatccagaaggccgagatcagaagccagcccgtgcccagaagcgtgctggtgctgaacatccccgacatcctggacggccccgagctgcacgacgtgctggagatccacttccagaagcccaccagaggcggcggcgaggtggaggccctgaccgtggtgccccagggccagcagggcctggccgtgttcaccagcgagagcggctag

SEQ ID NO: 85497 - DNA, 867 bp, Artificial Sequence
  Description of Artificial Sequence: Synthetic coding sequence
atgagcgcccccctggacgccgccctgcacgccctgcaggaggagcaggccagactgaagatgagactgtgggacctgcagcagctgagaaaggagctgggcgacagccccaaggacaaggtgcccttcagcgtgcccaagatccccctggtgttcagaggccacacccagcaggaccccgaggtgcccaagagcctggtgagcaacctgagaatccactgccccctgctggccggcagcgccctgatcaccttcgacgaccccaaggtggccgagcaggtgctgcagcagaaggagcacaccatcaacatggaggagtgcagactgagagtgcaggtgcagcccctggagctgcccatggtgaccaccatccaggtgatgatgagcagccagctgagcggcagaagagtgctggtgaccggcttccccgccagcctgagactgagcgaggaggagctgctggacaagctggagatcttcttcggcaagaccagaaacggcggcggcgacgtggacgtgagagagctgctgcccggcagcgtgatgctgggcttcgccagagacggcgtggcccagagactgtgccagatcggccagttcaccgtgcccctgggcggccagcaggtgcccctgagagtgagcccctacgtgaacggcgagatccagaaggccgagatcagaagccagcccgtgcccagaagcgtgctggtgctgaacatccccgacatcctggacggccccgagctgcacgacgtgctggagatccacttccagaagcccaccagaggcggcggcgaggtggaggccctgaccgtggtgccccagggccagcagggcctggccgtgttcaccagcgagagcggctag

SEQ ID NO: 85498 - DNA, 1335 bp, Artificial Sequence
  Description of Artificial Sequence: Synthetic coding sequence
atggccgtgaccaccagactgacctggctgcacgagaagatcctgcagaaccacttcggcggcaagagactgagcctgctgtacaagggcagcgtgcacggcttcagaaacggcgtgctgctggacagatgctgcaaccagggccccaccctgaccgtgatctacagcgaggaccacatcatcggcgcctacgccgaggagagctaccaggagggcaagtacgccagcatcatcctgttcgccctgcaggacaccaagatcagcgagtggaagctgggcctgtgcacccccgagaccctgttctgctgcgacgtgaccaagtacaacagccccaccaacttccagatcgacggcagaaacagaaaggtgatcatggacctgaagaccatggagaacctgggcctggcccagaactgcaccatcagcatccaggactacgaggtgttcagatgcgaggacagcctggacgagagaaagatcaagggcgtgatcgagctgagaaagagcctgctgagcgccctgagaacctacgagccctacggcagcctggtgcagcagatcagaatcctgctgctgggccccatcggcgccggcaagagcagcttcttcaacagcgtgagaagcgtgttccagggccacgtgacccaccaggccctggtgggcaccaacaccaccggcatcagcgagaagtacagaacctacagcatcagagacggcaaggacggcaagtacctgcccttcatcctgtgcgacagcctgggcctgagcgagaaggagggcggcctgtgcagagacgacatcttctacatcctgaacggcaacatcagagacagataccagttcaaccccatggagagcatcaagctgaaccaccacgactacatcgacagccccagcctgaaggacagaatccactgcgtggccttcgtgttcgacgccagcagcatccagtacttcagcagccagatgatcgtgaagatcaagagaatcagaagagagctggtgaacgccggcgtggtgcacgtggccctgctgacccacgtggacagcatggacctgatcaccaagggcgacctgatcgagatcgagagatgcgagcccgtgagaagcaagctggaggaggtgcagagaaagctgggcttcgccctgagcgacatcagcgtggtgagcaactacagcagcgagtgggagctggaccccgtgaaggacgtgctgatcctgagcgccctgagaagaatgctgtgggccgccgacgacttcctggaggacctgcccttcgagcagatcggcaacctgagagaggagatcatcaactgcgcccagggcaagaagtag

SEQ ID NO: 85499 - DNA, 588 bp, Artificial Sequence
  Description of Artificial Sequence: Synthetic coding sequence
atggacctgaagaccatggagaacctgggcctggcccagaactgcaccatcagcatccaggactacgaggtgttcagatgcgaggacagcctggacgagagaaagatcaagggcgtgatcgagctgagaaagagcctgctgagcgccctgagaacctacgagccctacggcagcctggtgcagcagatcagaatcctgctgctgggccccatcggcgccggcaagagcagcttcttcaacagcgtgagaagcgtgttccagggccacgtgacccaccaggccctggtgggcaccaacaccaccggcatcagcgagaagtacagaacctacagcatcagagacggcaaggacggcaagtacctgcccttcatcctgtgcgacagcctgggcctgagcgagaaggagggcggcctgtgcagagacgacatcttctacatcctgaacggcaacatcagagacagataccagttcaaccccatggagagcatcaagctgaaccaccacgactacatcgacagccccagcctgaaggacagaatccactgcgtggccttcgtgttcgacgccagcagcatccagtacttctag

SEQ ID NO: 85500 - DNA, 231 bp, Artificial Sequence
  Description of Artificial Sequence: Synthetic coding sequence
tgactgagcgacatcagcgtggtgagcaactacagcagcgagtgggagctggaccccgtgaaggacgtgctgatcctgagcgccctgagaagaatgctgtgggccgccgacgacttcctggaggacctgcccttcgagcagatcggcagatggttcggcggcgtggaggcctggaagagaagcggcaacctgagagaggagatcatcaactgcgcccagggcaagaagtag

SEQ ID NO: 85501 - DNA, 390 bp, Artificial Sequence
  Description of Artificial Sequence: Synthetic coding sequence
atggagagcatcaagctgaaccaccacgactacatcgacagccccagcctgaaggacagaatccactgcgtggccttcgtgttcgacgccagcagcatccagtacttcagcagccagatgatcgtgaagatcaagagaatcagaagagagctggtgaacgccggcgtggtgcacgtggccctgctgacccacgtggacagcatggacctgatcaccaagggcgacctgatcgagatcgagagatgcgagcccgtgagaagcaaggtgatgaacgacgccctgagaaagcacatcttctggggcatgctgctgcagagccacaccagcgtgtacaagaacaagaacaagcagctgctgggcctgagaagaatcaccaagctgctgaagtag

SEQ ID NO: 85502 - DNA, 585 bp, Artificial Sequence
  Description of Artificial Sequence: Synthetic coding sequence
atgctgtgcgacaccatgggcctggacggcgccgagggcgccggcctgtgcatggacgacatcccccacatcctgaagggctgcatgcccgacagataccagttcaacagcagaaagcccatcacccccgagcacagcaccttcatcaccagccccagcctgaaggacagaatccactgcgtggcctacgtgctggacatcaacagcatcgacaacctgtacagcaagatgctggccaaggtgaagcaggtgcacaaggaggtgctgaactgcggcatcgcctacgtggccctgctgaccaaggtggacgactgcagcgaggtgctgcaggacaacttcctgaacatgagcagaagcatgaccagccagagcagagtgatgaacgtgcacaagatgctgggcatccccatcagcaacatcctgatggtgggcaactacgccagcgacctggagctggaccccatgaaggacatcctgatcctgagcgccctgagacagatgctgagagccgccgacgacttcctggaggacctgcccctggaggagaccggcgccatcgagagagccctgcagccctgcatctag

SEQ ID NO: 85503 - DNA, 1359 bp, Artificial Sequence
  Description of Artificial Sequence: Synthetic coding sequence
atggaggtgaccaccagactgacctggaacgacgagaaccacctgagaaagctgctgggcaacgtgagcctgagcctgctgtacaagagcagcgtgcacggcggcagcatcgaggacatggtggagagatgcagcagacagggctgcaccatcaccatggcctacatcgactacaacatgatcgtggccttcatgctgggcaactacatcaacctgcacgagagcagcaccgagcccaacgacagcctgtggttcagcctgcagaagaagaacgacaccaccgagatcgagaccctgctgctgaacaccgcccccaagatcatcgacgagcagctggtgtgcagactgagcaagaccgacatcttcatcatctgcagagacaacaagatctacctggacaagatgatcaccagaaacctgaagctgagattctacggccacagacagtacctggagtgcgaggtgttcagagtggagggcatcaaggacaacctggacgacatcaagagaatcatcaaggccagagagcacagaaacagactgctggccgacatcagagactacagaccctacgccgacctggtgagcgagatcagaatcctgctggtgggccccgtgggcagcggcaagagcagcttcttcaacagcgtgaagagcatcttccacggccacgtgaccggccaggccgtggtgggcagcgacatcaccagcatcaccgagagatacagaatctacagcgtgaaggacggcaagaacggcaagagcctgcccttcatgctgtgcgacaccatgggcctggacggcgccgagggcgccggcctgtgcatggacgacatcccccacatcctgaagggctgcatgcccgacagataccagttcaacagcagaaagcccatcacccccgagcacagcaccttcatcaccagccccagcctgaaggacagaatccactgcgtggcctacgtgctggacatcaacagcatcgacaacctgtacagcaagatgctggccaaggtgaagcaggtgcacaaggaggtgctgaactgcggcatcgcctacgtggccctgctgaccaaggtggacgactgcagcgaggtgctgcaggacaacttcctgaacatgagcagaagcatgaccagccagagcagagtgatgaacgtgcacaagatgctgggcatccccatcagcaacatcctgatggtgggcaactacgccagcgacctggagctggaccccatgaaggacatcctgatcctgagcgccctgagacagatgctgagagccgccgacgacttcctggaggacctgcccctggaggagaccggcgccatcgagagagccctgcagccctgcatctag

SEQ ID NO: 85504 - DNA, 294 bp, Artificial Sequence
  Description of Artificial Sequence: Synthetic coding sequence
atggaggtgaccaccagactgacctggaacgacgagaaccacctgagaaagctgctgggcaacgtgagcctgagcctgctgtacaagagcagcgtgcacggcggcagcatcgaggacatggtggagagatgcagcagacagggctgcaccatcaccatggcctacatcgactacaacatgatcgtggccttcatgctgggcaactacatcaacctgcacgagagcagcaccgagcccaacgacagcctgtggttcagcctgcagaagaagaacgacaccaccgagatcgagtag

SEQ ID NO: 85505 - DNA, 1437 bp, Artificial Sequence
  Description of Artificial Sequence: Synthetic coding sequence
atgagcaccaacggcgacgaccaccaggtgaaggacagcctggagcagctgagatgccacttcacctgggagctgagcatcgacgacgacgagatgcccgacctggagaacagagtgctggaccagatcgagttcctggacaccaagtacagcgtgggcatccacaacctgctggcctacgtgaagcacctgaagggccagaacgaggaggccctgaagagcctgaaggaggccgagaacctgatgcaggaggagcacgacaaccaggccaacgtgagaagcctggtgacctggggcaacttcgcctggatgtactaccacatgggcagactggccgaggcccagacctacctggacaaggtggagaacatctgcaagaagctgagcaaccccttcagatacagaatggagtgccccgagatcgactgcgaggagggctgggccctgctgaagtgcggcggcaagaactacgagagagccaaggcctgcttcgagaaggtgctggaggtggaccccgagaaccccgagagcagcgccggctacgccatcagcgcctacagactggacggcttcaagctggccaccaagaaccacaagcccttcagcctgctgcccctgagacaggccgtgagactgaaccccgacaacggctacatcaaggtgctgctggccctgaagctgcaggacgagggccaggaggccgagggcgagaagtacatcgaggaggccctggccaacatgagcagccagacctacgtgttcagatacgccgccaagttctacagaagaaagggcagcgtggacaaggccctggagctgctgaagaaggccctgcaggagacccccaccagcgtgctgctgcaccaccagatcggcctgtgctacaaggcccagatgatccagatcaaggaggccaccaagggccagcccagaggccagaacagagagaagctggacaagatgatcagaagcgccatcttccacttcgagagcgccgtggagaagaagcccaccttcgaggtggcccacctggacctggccagaatgtacatcgaggccggcaaccacagaaaggccgaggagaacttccagaagctgctgtgcatgaagcccgtggtggaggagaccatgcaggacatccacttccactacggcagattccaggagttccagaagaagagcgacgtgaacgccatcatccactacctgaaggccatcaagatcgagcaggccagcctgaccagagacaagagcatcaacagcctgaagaagctggtgctgagaaagctgagaagaaaggccctggacctggagagcctgagcctgctgggcttcgtgtacaagctggagggcaacatgaacgaggccctggagtactacgagagagccctgagactggccgccgacttcgagaacagcgtgagacagggcccctag

SEQ ID NO: 85506 - DNA, 1344 bp, Artificial Sequence
  Description of Artificial Sequence: Synthetic coding sequence
atgcccgacctggagaacagagtgctggaccagatcgagttcctggacaccaagtacagcgtgggcatccacaacctgctggcctacgtgaagcacctgaagggccagaacgaggaggccctgaagagcctgaaggaggccgagaacctgatgcaggaggagcacgacaaccaggccaacgtgagaagcctggtgacctggggcaacttcgcctggatgtactaccacatgggcagactggccgaggcccagacctacctggacaaggtggagaacatctgcaagaagctgagcaaccccttcagatacagaatggagtgccccgagatcgactgcgaggagggctgggccctgctgaagtgcggcggcaagaactacgagagagccaaggcctgcttcgagaaggtgctggaggtggaccccgagaaccccgagagcagcgccggctacgccatcagcgcctacagactggacggcttcaagctggccaccaagaaccacaagcccttcagcctgctgcccctgagacaggccgtgagactgaaccccgacaacggctacatcaaggtgctgctggccctgaagctgcaggacgagggccaggaggccgagggcgagaagtacatcgaggaggccctggccaacatgagcagccagacctacgtgttcagatacgccgccaagttctacagaagaaagggcagcgtggacaaggccctggagctgctgaagaaggccctgcaggagacccccaccagcgtgctgctgcaccaccagatcggcctgtgctacaaggcccagatgatccagatcaaggaggccaccaagggccagcccagaggccagaacagagagaagctggacaagatgatcagaagcgccatcttccacttcgagagcgccgtggagaagaagcccaccttcgaggtggcccacctggacctggccagaatgtacatcgaggccggcaaccacagaaaggccgaggagaacttccagaagctgctgtgcatgaagcccgtggtggaggagaccatgcaggacatccacttccactacggcagattccaggagttccagaagaagagcgacgtgaacgccatcatccactacctgaaggccatcaagatcgagcaggccagcctgaccagagacaagagcatcaacagcctgaagaagctggtgctgagaaagctgagaagaaaggccctggacctggagagcctgagcctgctgggcttcgtgtacaagctggagggcaacatgaacgaggccctggagtactacgagagagccctgagactggccgccgacttcgagaacagcgtgagacagggcccctag

SEQ ID NO: 85507 - DNA, 1419 bp, Artificial Sequence
  Description of Artificial Sequence: Synthetic coding sequence
atgagcgagaacaacaagaacagcctggagagcagcctgagacagctgaagtgccacttcacctggaacctgatggagggcgagaacagcctggacgacttcgaggacaaggtgttctacagaaccgagttccagaacagagagttcaaggccaccatgtgcaacctgctggcctacctgaagcacctgaagggccagaacgaggccgccctggagtgcctgagaaaggccgaggagctgatccagcaggagcacgccgaccaggccgagatcagaagcctggtgacctggggcaactacgcctgggtgtactaccacatgggcagactgagcgacgtgcagatctacgtggacaaggtgaagcacgtgtgcgagaagttcagcagcccctacagaatcgagagccccgagctggactgcgaggagggctggaccagactgaagtgcggcggcaaccagaacgagagagccaaggtgtgcttcgagaaggccctggagaagaagcccaagaaccccgagttcaccagcggcctggccatcgccagctacagactggacaactggccccccagccagaacgccatcgaccccctgagacaggccatcagactgaaccccgacaaccagtacctgaaggtgctgctggccctgaagctgcacaagatgagagaggagggcgaggaggagggcgagggcgagaagctggtggaggaggccctggagaaggcccccggcgtgaccgacgtgctgagaagcgccgccaagttctacagaagaaaggacgagcccgacaaggccatcgagctgctgaagaaggccctggagtacatccccaacaacgcctacctgcactgccagatcggctgctgctacagagccaaggtgttccaggtgatgaacctgagagagaacggcatgtacggcaagagaaagctgctggagctgatcggccacgccgtggcccacctgaagaaggccgacgaggccaacgacaacctgttcagagtgtgcagcatcctggccagcctgcacgccctggccgaccagtacgaggacgccgagtactacttccagaaggagttcagcaaggagctgacccccgtggccaagcagctgctgcacctgagatacggcaacttccagctgtaccagatgaagtgcgaggacaaggccatccaccacttcatcgagggcgtgaagatcaaccagaagagcagagagaaggagaagatgaaggacaagctgcagaagatcgccaagatgagactgagcaagaacggcgccgacagcgaggccctgcacgtgctggccttcctgcaggagctgaacgagaagatgcagcaggccgacgaggacagcgagagaggcctggagagcggcagcctgatccccagcgccagcagctggaacggcgagtag

SEQ ID NO: 85508 - DNA, 1356 bp, Artificial Sequence
  Description of Artificial Sequence: Synthetic coding sequence
atgcccaagaacaagaagagaaacaccccccacagaggcagcagcgccggcggcggcggcagcggcgccgccgccgccaccgccgccaccgccggcggccagcacagaaacgtgcagcccttcagcgacgaggacgccagcatcgagaccatgagccactgcagcggctacagcgaccccagcagcttcgccgaggacggccccgaggtgctggacgaggagggcacccaggaggacctggagtacaagctgaagggcctgatcgacctgaccctggacaagagcgccaagaccagacaggccgccctggagggcatcaagaacgccctggccagcaagatgctgtacgagttcatcctggagagaagaatgaccctgaccgacagcatcgagagatgcctgaagaagggcaagagcgacgagcagagagccgccgccgccctggccagcgtgctgtgcatccagctgggccccggcatcgagagcgaggagatcctgaagaccctgggccccatcctgaagaagatcatctgcgacggcagcgccagcatgcaggccagacagacctgcgccacctgcttcggcgtgtgctgcttcatcgccaccgacgacatcaccgagctgtacagcaccctggagtgcctggagaacatcttcaccaagagctacctgaaggagaaggacaccaccgtgatctgcagcacccccaacaccgtgctgcacatcagcagcctgctggcctggaccctgctgctgaccatctgccccatcaacgaggtgaagaagaagctggagatgcacttccacaagctgcccagcctgctgagctgcgacgacgtgaacatgagaatcgccgccggcgagagcctggccctgctgttcgagctggccagaggcatcgagagcgacttcttctacgaggacatggagagcctgacccagatgctgagagccctggccaccgacggcaacaagcacagagccaaggtggacaagagaaagcagagaagcgtgttcagagacgtgctgagagccgtggaggagagagacttccccaccgagaccatcaagttcggccccgagagaatgtacatcgactgctgggtgaagaagcacacctacgacaccttcaaggaggtgctgggcagcggcatgcagtaccacctgcagagcaacgagttcctgagaaacgtgttcgagctgggcccccccgtgatgctggacgccgccaccctgaagaccatgaagatcagcagattcgagagacacctgtacaacagcgccgccttcaaggccagaaccaaggccagaagcaagtgcagagacaagagagccgacgtgggcgagttcttctag

SEQ ID NO: 85509 - DNA, 1356 bp, Artificial Sequence; identical to SEQ ID NO: 85508
  Description of Artificial Sequence: Synthetic coding sequence

SEQ ID NO: 85510 - DNA, 57 bp, Artificial Sequence
  Description of Artificial Sequence: Synthetic coding sequence
atgcccaagaacaagaagagaaacaccccccacagaggcagcagcgccggcggctag

SEQ ID NO: 85511 - DNA, 96 bp, Artificial Sequence
  Description of Artificial Sequence: Synthetic coding sequence
atgcccaagaacaagaagagaaacaccccccacagaggcagcagcgccggcggcggcggcagcggcgccgccgccgccaccgccgccaccgcctag

SEQ ID NO: 85512 - DNA, 189 bp, Artificial Sequence
  Description of Artificial Sequence: Synthetic coding sequence
atgcccaagaacaagaagagaaacaccccccacagaggcagcagcgccggcggcggcggcagcggcgccgccgccgccaccgccgccaccgccggcggccagcacagaaacgtgcagcccttcagcgacgaggacgccagcatcgagaccatgagccactgcagcggctacagcgaccccagcagctag

SEQ ID NO: 85513 - DNA, 1206 bp, Artificial Sequence
  Description of Artificial Sequence: Synthetic coding sequence
atgagccactgcagcggctacagcgaccccagcagcttcgccgaggacggccccgaggtgctggacgaggagggcacccaggaggacctggagtacaagctgaagggcctgatcgacctgaccctggacaagagcgccaagaccagacaggccgccctggagggcatcaagaacgccctggccagcaagatgctgtacgagttcatcctggagagaagaatgaccctgaccgacagcatcgagagatgcctgaagaagggcaagagcgacgagcagagagccgccgccgccctggccagcgtgctgtgcatccagctgggccccggcatcgagagcgaggagatcctgaagaccctgggccccatcctgaagaagatcatctgcgacggcagcgccagcatgcaggccagacagacctgcgccacctgcttcggcgtgtgctgcttcatcgccaccgacgacatcaccgagctgtacagcaccctggagtgcctggagaacatcttcaccaagagctacctgaaggagaaggacaccaccgtgatctgcagcacccccaacaccgtgctgcacatcagcagcctgctggcctggaccctgctgctgaccatctgccccatcaacgaggtgaagaagaagctggagatgcacttccacaagctgcccagcctgctgagctgcgacgacgtgaacatgagaatcgccgccggcgagagcctggccctgctgttcgagctggccagaggcatcgagagcgacttcttctacgaggacatggagagcctgacccagatgctgagagccctggccaccgacggcaacaagcacagagccaaggtggacaagagaaagcagagaagcgtgttcagagacgtgctgagagccgtggaggagagagacttccccaccgagaccatcaagttcggccccgagagaatgtacatcgactgctgggtgaagaagcacacctacgacaccttcaaggaggtgctgggcagcggcatgcagtaccacctgcagagcaacgagttcctgagaaacgtgttcgagctgggcccccccgtgatgctggacgccgccaccctgaagaccatgaagatcagcagattcgagagacacctgtacaacagcgccgccttcaaggccagaaccaaggccagaagcaagtgcagagacaagagagccgacgtgggcgagttcttctag

SEQ ID NO: 85514 - DNA, 474 bp, Artificial Sequence
  Description of Artificial Sequence: Synthetic coding sequence
atgcacttccacaagctgcccagcctgctgagctgcgacgacgtgaacatgagaatcgccgccggcgagagcctggccctgctgttcgagctggccagaggcatcgagagcgacttcttctacgaggacatggagagcctgacccagatgctgagagccctggccaccgacggcaacaagcacagagccaaggtggacaagagaaagcagagaagcgtgttcagagacgtgctgagagccgtggaggagagagacttccccaccgagaccatcaagttcggccccgagagaatgtacatcgactgctgggtgaagaagcacacctacgacaccttcaaggaggtgctgggcagcggcatgcagtaccacctgcagagcaacgagttcctgagaaacgtgttcgagctgggcccccccgtgatgctggacgccgccaccctgaagaccatgaagatcagcagattcgagagatag

SEQ ID NO: 85515 - DNA, 1827 bp, Artificial Sequence
  Description of Artificial Sequence: Synthetic coding sequence
atgggccccaagaagagctggagaagccacttcttccccctgcccgaggtgtggctgctgctgctgctgagccaggccctgagccccagccacggcccccagacccaggccggcgtgggcctggtgtggagcgtgcccctgcccagcgccctgagaagccagagctgcctgggcgcccccctgagagacgccagcgagctgaccaccgtgcacctgttccccaccagaggctggggcgccagaagagccctgtgggtgcacagcagcgccagcgccagcagcgccgccagcagaagaagactgagagcccaggccagcggcatcagcagcttcagcctggtggacggcggcgcccccagagaggacggcggcgccagaggcgtgtggctgcccagcagcggccaggtgagcgcccagagaaccggcagaagactggtgggcctggagcccacccccaccggcagcctgacccccagaccccccagacccgtgcccggcatgcccagagccagaaagggcaacaccctgagaaagggcggccagagaagaggcggcggcgccagaagcagcgcccaggccgacagcggcagcagcgacgacgaggccgccagcgaggccagaagcaccgccagcgagtgccccagcctgctgagcaccaccgccgaggacagcctgggcggcgacgtggtggacgagcagggccagcaggaggacctggaggagaagctgaaggagtacgtggactgcctgaccgacaagagcgccaagaccagacagggcgccctggagagcctgagactggccctggccagcagactgctgcccgacttcctgctggagagaagactgaccctggccgacgccctggagaagtgcctgaagaagggcaagggcgaggagcaggccctggccgccgccgtgctgggcctgctgtgcgtgcagctgggccccggccccaagggcgaggagctgttccacagcctgcagcccctgctggtgagcgtgctgagcgacagcaccgccagccccgccgccagactgcactgcgccagcgccctgggcctgggctgctacgtggccgccgccgacatccaggacctggtgagctgcctggcctgcctggagagcgtgttcagcagattctacggcctgggcggcagcagcaccagccccgtggtgcccgccagcctgcacggcctgctgagcgccgccctgcaggcctgggccctgctgctgaccatctgccccagcacccagatcagccacatcctggacagacagctgcccagactgccccagctgctgagcagcgagagcgtgaacctgagaatcgccgccggcgagaccatcgccctgctgttcgagctggccagagacctggaggaggagttcgtgtacgaggacatggaggccctgtgcagcgtgctgagaaccctggccaccgacagcaacaagtacagagccaaggccgacagaagaagacagagaagcaccttcagagccgtgctgcacagcgtggagggcggcgagtgcgaggaggagatcgtgagattcggcttcgaggtgctgtacatggacagctgggccagacacagaatctacgccgccttcaaggaggtgctgggcagcggcatgcaccaccacctgcagaacaacgagctgctgagagacatcttcggcctgggccccgtgctgctgctggacgccaccgccctgaaggcctgcaaggtgcccagattcgagaagcacctgtacaacgccgccgccttcaaggccagaaccaaggccagaagcagagtgagagacaagagagccgacatcctgtag

SEQ ID NO: 85516 - DNA, 1329 bp, Artificial Sequence
  Description of Artificial Sequence: Synthetic coding sequence
atgcccagagccagaaagggcaacaccctgagaaagggcggccagagaagaggcggcggcgccagaagcagcgcccaggccgacagcggcagcagcgacgacgaggccgccagcgaggccagaagcaccgccagcgagtgccccagcctgctgagcaccaccgccgaggacagcctgggcggcgacgtggtggacgagcagggccagcaggaggacctggaggagaagctgaaggagtacgtggactgcctgaccgacaagagcgccaagaccagacagggcgccctggagagcctgagactggccctggccagcagactgctgcccgacttcctgctggagagaagactgaccctggccgacgccctggagaagtgcctgaagaagggcaagggcgaggagcaggccctggccgccgccgtgctgggcctgctgtgcgtgcagctgggccccggccccaagggcgaggagctgttccacagcctgcagcccctgctggtgagcgtgctgagcgacagcaccgccagccccgccgccagactgcactgcgccagcgccctgggcctgggctgctacgtggccgccgccgacatccaggacctggtgagctgcctggcctgcctggagagcgtgttcagcagattctacggcctgggcggcagcagcaccagccccgtggtgcccgccagcctgcacggcctgctgagcgccgccctgcaggcctgggccctgctgctgaccatctgccccagcacccagatcagccacatcctggacagacagctgcccagactgccccagctgctgagcagcgagagcgtgaacctgagaatcgccgccggcgagaccatcgccctgctgttcgagctggccagagacctggaggaggagttcgtgtacgaggacatggaggccctgtgcagcgtgctgagaaccctggccaccgacagcaacaagtacagagccaaggccgacagaagaagacagagaagcaccttcagagccgtgctgcacagcgtggagggcggcgagtgcgaggaggagatcgtgagattcggcttcgaggtgctgtacatggacagctgggccagacacagaatctacgccgccttcaaggaggtgctgggcagcggcatgcaccaccacctgcagaacaacgagctgctgagagacatcttcggcctgggccccgtgctgctgctggacgccaccgccctgaaggcctgcaaggtgcccagattcgagaagcacctgtacaacgccgccgccttcaaggccagaaccaaggccagaagcagagtgagagacaagagagccgacatcctgtag

SEQ ID NO: 85517 - DNA, 1521 bp, Artificial Sequence
  Description of Artificial Sequence: Synthetic coding sequence
atggcctggaacagccccagcagaagacccgtgtggcagggcggcgcccccagagaggacggcggcgccagaggcgtgtggctgcccagcagcggccaggtgagcgcccagagaaccggcagaagactggtgggcctggagcccacccccaccggcagcctgacccccagaccccccagacccgtgcccggcatgcccagagccagaaagggcaacaccctgagaaagggcggccagagaagaggcggcggcgccagaagcagcgcccaggccgacagcggcagcagcgacgacgaggccgccagcgaggccagaagcaccgccagcgagtgccccagcctgctgagcaccaccgccgaggacagcctgggcggcgacgtggtggacgagcagggccagcaggaggacctggaggagaagctgaaggagtacgtggactgcctgaccgacaagagcgccaagaccagacagggcgccctggagagcctgagactggccctggccagcagactgctgcccgacttcctgctggagagaagactgaccctggccgacgccctggagaagtgcctgaagaagggcaagggcgaggagcaggccctggccgccgccgtgctgggcctgctgtgcgtgcagctgggccccggccccaagggcgaggagctgttccacagcctgcagcccctgctggtgagcgtgctgagcgacagcaccgccagccccgccgccagactgcactgcgccagcgccctgggcctgggctgctacgtggccgccgccgacatccaggacctggtgagctgcctggcctgcctggagagcgtgttcagcagattctacggcctgggcggcagcagcaccagccccgtggtgcccgccagcctgcacggcctgctgagcgccgccctgcaggcctgggccctgctgctgaccatctgccccagcacccagatcagccacatcctggacagacagctgcccagactgccccagctgctgagcagcgagagcgtgaacctgagaatcgccgccggcgagaccatcgccctgctgttcgagctggccagagacctggaggaggagttcgtgtacgaggacatggaggccctgtgcagcgtgctgagaaccctggccaccgacagcaacaagtacagagccaaggccgacagaagaagacagagaagcaccttcagagccgtgctgcacagcgtggagggcggcgagtgcgaggaggagatcgtgagattcggcttcgaggtgctgtacatggacagctgggccagacacagaatctacgccgccttcaaggaggtgctgggcagcggcatgcaccaccacctgcagaacaacgagctgctgagagacatcttcggcctgggccccgtgctgctgctggacgccaccgccctgaaggcctgcaaggtgcccagattcgagaagcacctgtacaacgccgccgccttcaaggccagaaccaaggccagaagcagagtgagagacaagagagccgacatcctgtag

SEQ ID NO: 85518 - DNA, 1329 bp, Artificial Sequence; identical to SEQ ID NO: 85516
  Description of Artificial Sequence: Synthetic coding sequence

SEQ ID NO: 85519 - DNA, 1713 bp, Artificial Sequence
  Description of Artificial Sequence: Synthetic coding sequence
atgaccctgctgtggtgcgtggtgagcctgtacttctacggcatcctgcagagcgacgccagcgagagatgcgacgactggggcctggacaccatgagacagatccaggtgttcgaggacgagcccgccagaatcaagtgccccctgttcgagcacttcctgaagttcaactacagcaccgcccacagcgccggcctgaccctgatctggtactggaccagacaggacagagacctggaggagcccatcaacttcagactgcccgagaacagaatcagcaaggagaaggacgtgctgtggttcagacccaccctgctgaacgacaccggcaactacacctgcatgctgagaaacaccacctactgcagcaaggtggccttccccctggaggtggtgcagaaggacagctgcttcaacagccccatgaagctgcccgtgcacaagctgtacatcgagtacggcatccagagaatcacctgccccaacgtggacggctacttccccagcagcgtgaagcccaccatcacctggtacatgggctgctacaagatccagaacttcaacaacgtgatccccgagggcatgaacctgagcttcctgatcgccctgatcagcaacaacggcaactacacctgcgtggtgacctaccccgagaacggcagaaccttccacctgaccagaaccctgaccgtgaaggtggtgggcagccccaagaacgccgtgccccccgtgatccacagccccaacgaccacgtggtgtacgagaaggagcccggcgaggagctgctgatcccctgcaccgtgtacttcagcttcctgatggacagcagaaacgaggtgtggtggaccatcgacggcaagaagcccgacgacatcaccatcgacgtgaccatcaacgagagcatcagccacagcagaaccgaggacgagaccagaacccagatcctgagcatcaagaaggtgaccagcgaggacctgaagagaagctacgtgtgccacgccagaagcgccaagggcgaggtggccaaggccgccaaggtgaagcagaaggtgcccgcccccagatacaccgtggagctggcctgcggcttcggcgccaccgtgctgctggtggtgatcctgatcgtggtgtaccacgtgtactggctggagatggtgctgttctacagagcccacttcggcaccgacgagaccatcctggacggcaaggagtacgacatctacgtgagctacgccagaaacgccgaggaggaggagttcgtgctgctgaccctgagaggcgtgctggagaacgagttcggctacaagctgtgcatcttcgacagagacagcctgcccggcggcatcgtgaccgacgagaccctgagcttcatccagaagagcagaagactgctggtggtgctgagccccaactacgtgctgcagggcacccaggccctgctggagctgaaggccggcctggagaacatggccagcagaggcaacatcaacgtgatcctggtgcagtacaaggccgtgaaggagaccaaggtgaaggagctgaagagagccaagaccgtgctgaccgtgatcaagtggaagggcgagaagagcaagtacccccagggcagattctggaagcagctgcaggtggccatgcccgtgaagaagagccccagaagaagcagcagcgacgagcagggcctgagctacagcagcctgaagaacgtgtag

SEQ ID NO: 85520 - DNA, 2064 bp, Artificial Sequence
  Description of Artificial Sequence: Synthetic coding sequence
atgaccctgctgtggtgcgtggtgagcctgtacttctacggcatcctgcagagcgacgccagcgagagatgcgacgactggggcctggacaccatgagacagatccaggtgttcgaggacgagcccgccagaatcaagtgccccctgttcgagcacttcctgaagttcaactacagcaccgcccacagcgccggcctgaccctgatctggtactggaccagacaggacagagacctggaggagcccatcaacttcagactgcccgagaacagaatcagcaaggagaaggacgtgctgtggttcagacccaccctgctgaacgacaccggcaactacacctgcatgctgagaaacaccacctactgcagcaaggtggccttccccctggaggtggtgcagaaggacagctgcttcaacagccccatgaagctgcccgtgcacaagctgtacatcgagtacggcatccagagaatcacctgccccaacgtggacggctacttccccagcagcgtgaagcccaccatcacctggtacatgggctgctacaagatccagaacttcaacaacgtgatccccgagggcatgaacctgagcttcctgatcgccctgatcagcaacaacggcaactacacctgcgtggtgacctaccccgagaacggcagaaccttccacctgaccagaaccctgaccgtgaaggtggtgggcagccccaagaacgccgtgccccccgtgatccacagccccaacgaccacgtggtgtacgagaaggagcccggcgaggagctgctgatcccctgcaccgtgtacttcagcttcctgatggacagcagaaacgaggtgtggtggaccatcgacggcaagaagcccgacgacatcaccatcgacgtgaccatcaacgagagcatcagccacagcagaaccgaggacgagaccagaacccagatcctgagcatcaagaaggtgaccagcgaggacctgaagagaagctacgtgtgccacgccagaagcgccaagggcgaggtggccaaggccgccaaggtgaagcagaaggtgcccgcccccagatacaccgtggagctggcctgcggcttcggcgccaccgtgctgctggtggtgatcctgatcgtggtgtaccacgtgtactggctggagatggtgctgttctacagagcccacttcggcaccgacgagaccatcctggacggcaaggagtacgacatctacgtgagctacgccagaaacgccgaggaggaggagttcgtgctgctgaccctgagaggcgtgctggagaacgagttcggctacaagctgtgcatcttcgacagagacagcctgcccggcggcaacaccgtggaggccgtgttcgacttcatccagagaagcagaagaatgatcgtggtgctgagccccgactacgtgaccgagaagagcatcagcatgctggagttcaagctgggcgtgatgtgccagaacagcatcgccaccaagctgatcgtggtggagtacagacccctggagcacccccaccccggcatcctgcagctgaaggagagcgtgagcttcgtgagctggaagggcgagaagagcaagcacagcggcagcaagttctggaaggccctgagactggccctgcccctgagaagcctgagcgccagcagcggctggaacgagagctgcagcagccagagcgacatcagcctggaccacgtgcagagaagaagaagcagactgaaggagccccccgagctgcagagcagcgagagagccgccggcagcccccccgcccccggcaccatgagcaagcacagaggcaagagcagcgccacctgcagatgctgcgtgacctactgcgagggcgagaaccacctgagaaacaagagcagagccgagatccacaaccagccccagtgggagacccacctgtgcaagcccgtgccccaggagagcgagacccagtggatccagaacggcaccagactggagccccccgccccccagatcagcgccctggccctgcaccacttcaccgacctgagcaacaacaacgacttctacatcctgtag

SEQ ID NO: 85521 - DNA, 1713 bp, Artificial Sequence; identical to SEQ ID NO: 85519
  Description of Artificial Sequence: Synthetic coding sequence

SEQ ID NO: 85522 - DNA, 1071 bp, Artificial Sequence
  Description of Artificial Sequence: Synthetic coding sequence
atgaccctgctgtggtgcgtggtgagcctgtacttctacggcatcctgcagagcgacgccagcgagagatgcgacgactggggcctggacaccatgagacagatccaggtgttcgaggacgagcccgccagaatcaagtgccccctgttcgagcacttcctgaagttcaactacagcaccgcccacagcgccggcctgaccctgatctggtactggaccagacaggacagagacctggaggagcccatcaacttcagactgcccgagaacagaatcagcaaggagaaggacgtgctgtggttcagacccaccctgctgaacgacaccggcaactacacctgcatgctgagaaacaccacctactgcagcaaggtggccttccccctggaggtggtgcagaaggacagctgcttcaacagccccatgaagctgcccgtgcacaagctgtacatcgagtacggcatccagagaatcacctgccccaacgtggacggctacttccccagcagcgtgaagcccaccatcacctggtacatgggctgctacaagatccagaacttcaacaacgtgatccccgagggcatgaacctgagcttcctgatcgccctgatcagcaacaacggcaactacacctgcgtggtgacctaccccgagaacggcagaaccttccacctgaccagaaccctgaccgtgaaggtggtgggcagccccaagaacgccgtgccccccgtgatccacagccccaacgaccacgtggtgtacgagaaggagcccggcgaggagctgctgatcccctgcaccgtgtacttcagcttcctgatggacagcagaaacgaggtgtggtggaccatcgacggcaagaagcccgacgacatcaccatcgacgtgaccatcaacgagagcatcagccacagcagaaccgaggacgagaccagaacccagatcctgagcatcaagaaggtgaccagcgaggacctgaagagaagctacgtgtgccacgccagaagcgccaagggcgaggtggccaaggccgccaaggtgaagcagaagggcaacagatgcggccagtag

SEQ ID NO: 85523 - DNA, 342 bp, Artificial Sequence
  Description of Artificial Sequence: Synthetic coding sequence
atgaccctgctgtggtgcgtggtgagcctgtacttctacggcatcctgcagagcgacgccagcgagagatgcgacgactggggcctggacaccatgagacagatccaggtgttcgaggacgagcccgccagaatcaagtgccccctgttcgagcacttcctgaagttcaactacagcaccgcccacagcgccggcctgaccctgatctggtactggaccagacaggacagagacctggaggagcccatcaacttcagactgcccgagaacagaatcagcaaggagaaggacgtgctgtggttcagacccaccctgctgaacgacaccggcaactacacctag

SEQ ID NO: 85524 - DNA, 1071 bp, Artificial Sequence; identical to SEQ ID NO: 85522
  Description of Artificial Sequence: Synthetic coding sequence

SEQ ID NO: 85525 - DNA, 1713 bp, Artificial Sequence; identical to SEQ ID NO: 85519
  Description of Artificial Sequence: Synthetic coding sequence

SEQ ID NO: 85526 - DNA, 2064 bp, Artificial Sequence; identical to SEQ ID NO: 85520
  Description of Artificial Sequence: Synthetic coding sequence

SEQ ID NO: 85527 - DNA, 1713 bp, Artificial Sequence; identical to SEQ ID NO: 85519
  Description of Artificial Sequence: Synthetic coding sequence

SEQ ID NO: 85528 - DNA, 438 bp, Artificial Sequence
  Description of Artificial Sequence: Synthetic coding sequence
atgaccctgctgtggtgcgtggtgagcctgtacttctacggcatcctgcagagcgacgccagcgagagatgcgacgactggggcctggacaccatgagacagatccaggtgttcgaggacgagcccgccagaatcaagtgccccctgttcgagcacttcctgaagttcaactacagcaccgcccacagcgccggcctgaccctgatctggtactggaccagacaggacagagacctggaggagcccatcaacttcagactgcccgagaacagaatcagcaaggagaaggacgtgctgtggttcagacccaccctgctgaacgacaccggcaactacacctgcatgctgagaaacaccacctactgcagcaaggtggccttccccctggaggtggtgcagaaggacagctgcttcaacagccccatgaagctgccctag

SEQ ID NO: 85529 - DNA, 2091 bp, Artificial Sequence
  Description of Artificial Sequence: Synthetic coding sequence
atgaaggcccccatcccccacctgatcctgctgtacgccaccttcacccagagcctgaaggtggtgaccaagagaggcagcgccgacggctgcaccgactggagcatcgacatcaagaagtaccaggtgctggtgggcgagcccgtgagaatcaagtgcgccctgttctacggctacatcagaaccaactacagcctggcccagagcgccggcctgagcctgatgtggtacaagagcagcggccccggcgacttcgaggagcccatcgccttcgacggcagcagaatgagcaaggaggaggacagcatctggttcagacccaccctgctgcaggacagcggcctgtacgcctgcgtgatcagaaacagcacctactgcatgaaggtgagcatcagcctgaccgtgggcgagaacgacaccggcctgtgctacaacagcaagatgaagtacttcgagaaggccgagctgagcaagagcaaggagatcagctgcagagacatcgaggacttcctgctgcccaccagagagcccgagatcctgtggtacaaggagtgcagaaccaagacctggagacccagcatcgtgttcaagagagacaccctgctgatcagagaggtgagagaggacgacatcggcaactacacctgcgagctgaagtacggcggcttcgtggtgagaagaaccaccgagctgaccgtgaccgcccccctgaccgacaagccccccaagctgctgtaccccatggagagcaagctgaccatccaggagacccagctgggcgacagcgccaacctgacctgcagagccttcttcggctacagcggcgacgtgagccccctgatctactggatgaagggcgagaagttcatcgaggacctggacgagaacagagtgtgggagagcgacatcagaatcctgaaggagcacctgggcgagcaggaggtgagcatcagcctgatcgtggacagcgtggaggagggcgacctgggcaactacagctgctacgtggagaacggcaacggcagaagacacgccagcgtgctgctgcacaagagagagctgatgtacaccgtggagctggccggcggcctgggcgccatcctgctgctgctggtgtgcctggtgaccatctacaagtgctacaagatcgagatcatgctgttctacagaaaccacttcggcgccgaggagctggacggcgacaacaaggactacgacgcctacctgagctacaccaaggtggaccccgaccagtggaaccaggagaccggcgaggaggagagattcgccctggagatcctgcccgacatgctggagaagcactacggctacaagctgttcatccccgacagagacctgatccccaccggcacctacatcgaggacgtggccagatgcgtggaccagagcaagagactgatcatcgtgatgacccccaactacgtggtgagaagaggctggagcatcttcgagctggagaccagactgagaaacatgctggtgaccggcgagatcaaggtgatcctgatcgagtgcagcgagctgagaggcatcatgaactaccaggaggtggaggccctgaagcacaccatcaagctgctgaccgtgatcaagtggcacggccccaagtgcaacaagctgaacagcaagttctggaagagactgcagtacgagatgcccttcaagagaatcgagcccatcacccacgagcaggccctggacgtgagcgagcagggccccttcggcgagctgcagaccgtgagcgccatcagcatggccgccgccaccagcaccgccctggccaccgcccaccccgacctgagaagcaccttccacaacacctaccacagccagatgagacagaagcactactacagaagctacgagtacgacgtgccccccaccggcaccctgcccctgaccagcatcggcaaccagcacacctactgcaacatccccatgaccctgatcaacggccagagaccccagaccaagagcagcagagagcagaaccccgacgaggcccacaccaacagcgccatcctgcccctgctgcccagagagaccagcatcagcagcgtgatctggtag

SEQ ID NO: 85530 - DNA, 2091 bp, Artificial Sequence; identical to SEQ ID NO: 85529
  Description of Artificial Sequence: Synthetic coding sequence

SEQ ID NO: 85531 - DNA, 2061 bp, Artificial Sequence
  Description of Artificial Sequence: Synthetic coding sequence
atgaagccccccttcctgctggccctggtggtgtgcagcgtggtgagcaccaacctgaagatggtgagcaagagaaacagcgtggacggctgcatcgactggagcgtggacctgaagacctacatggccctggccggcgagcccgtgagagtgaagtgcgccctgttctacagctacatcagaaccaactacagcaccgcccagagcaccggcctgagactgatgtggtacaagaacaagggcgacctggaggagcccatcatcttcagcgaggtgagaatgagcaaggaggaggacagcatctggttccacagcgccgaggcccaggacagcggcttctacacctgcgtgctgagaaacagcacctactgcatgaaggtgagcatgagcctgaccgtggccgagaacgagagcggcctgtgctacaacagcagaatcagatacctggagaagagcgaggtgaccaagagaaaggagatcagctgccccgacatggacgacttcaagaagagcgaccaggagcccgacgtggtgtggtacaaggagtgcaagcccaagatgtggagaagcatcatcatccagaagggcaacgccctgctgatccaggaggtgcaggaggaggacggcggcaactacacctgcgagctgaagtacgagggcaagctggtgagaagaaccaccgagctgaaggtgaccgccctgctgaccgacaagccccccaagcccctgttccccatggagaaccagcccagcgtgatcgacgtgcagctgggcaagcccctgaacatcccctgcaaggccttcttcggcttcagcggcgagagcggccccatgatctactggatgaagggcgagaagttcatcgaggagctggccggccacatcagagagggcgagatcagactgctgaaggagcacctgggcgagaaggaggtggagctggccctgatcttcgacagcgtggtggaggccgacctggccaactacacctgccacgtggagaacagaaacggcagaaagcacgccagcgtgctgctgagaaagaaggacctgatctacaagatcgagctggccggcggcctgggcgccatcttcctgctgctggtgctgctggtggtgatctacaagtgctacaacatcgagctgatgctgttctacagacagcacttcggcgccgacgagaccaacgacgacaacaaggagtacgacgcctacctgagctacaccaaggtggaccaggacaccctggactgcgacaaccccgaggaggagcagttcgccctggaggtgctgcccgacgtgctggagaagcactacggctacaagctgttcatccccgagagagacctgatccccagcggcacctacatggaggacctgaccagatacgtggagcagagcagaagactgatcatcgtgctgacccccgactacatcctgagaagaggctggagcatcttcgagctggagagcagactgcacaacatgctggtgagcggcgagatcaaggtgatcctgatcgagtgcaccgagctgaagggcaaggtgaactgccaggaggtggagagcctgaagagaagcatcaagctgctgagcctgatcaagtggaagggcagcaagagcagcaagctgaacagcaagttctggaagcacctggtgtacgagatgcccatcaagaagaaggagatgctgcccagatgccacgtgctggacagcgccgagcagggcctgttcggcgagctgcagcccatccccagcatcgccatgaccagcaccagcgccaccctggtgagcagccaggccgacctgcccgagttccaccccagcgacagcatgcagatcagacactgctgcagaggctacaagcacgagatccccgccaccaccctgcccgtgcccagcctgggcaaccaccacacctactgcaacctgcccctgaccctgctgaacggccagctgcccctgaacaacaccctgaaggacacccaggagttccacagaaacagcagcctgctgcccctgagcagcaaggagctgagcttcaccagcgacatctggtag

SEQ ID NO: 85532 - DNA, 2061 bp, Artificial Sequence; identical to SEQ ID NO: 85531
  Description of Artificial Sequence: Synthetic coding sequence

SEQ ID NO: 85533 - DNA, 876 bp, Artificial Sequence
  Description of Artificial Sequence: Synthetic coding sequence
atgagagacaacaaggagtacgacgcctacctgagctacaccaaggtggaccaggacaccctggactgcgacaaccccgaggaggagcagttcgccctggaggtgctgcccgacgtgctggagaagcactacggctacaagctgttcatccccgagagagacctgatccccagcggcacctacatggaggacctgaccagatacgtggagcagagcagaagactgatcatcgtgctgacccccgactacatcctgagaagaggctggagcatcttcgagctggagagcagactgcacaacatgctggtgagcggcgagatcaaggtgatcctgatcgagtgcaccgagctgaagggcaaggtgaactgccaggaggtggagagcctgaagagaagcatcaagctgctgagcctgatcaagtggaagggcagcaagagcagcaagctgaacagcaagttctggaagcacctggtgtacgagatgcccatcaagaagaaggagatgctgcccagatgccacgtgctggacagcgccgagcagggcctgttcggcgagctgcagcccatccccagcatcgccatgaccagcaccagcgccaccctggtgagcagccaggccgacctgcccgagttccaccccagcgacagcatgcagatcagacactgctgcagaggctacaagcacgagatccccgccaccaccctgcccgtgcccagcctgggcaaccaccacacctactgcaacctgcccctgaccctgctgaacggccagctgcccctgaacaacaccctgaaggacacccaggagttccacagaaacagcagcctgctgcccctgagcagcaaggagctgagcttcaccagcgacatctggtag

SEQ ID NO: 85534 - DNA, 1197 bp, Artificial Sequence
  Description of Artificial Sequence: Synthetic coding sequence
atgctgagactgtacgtgctggtgatgggcgtgagcgccttcaccctgcagcccgccgcccacaccggcgccgccagaagctgcagattcagaggcagacactacaagagagagttcagactggagggcgagcccgtggccctgagatgcccccaggtgccctactggctgtgggccagcgtgagccccagaatcaacctgacctggcacaagaacgacagcgccagaaccgtgcccggcgaggaggagaccagaatgtgggcccaggacggcgccctgtggctgctgcccgccctgcaggaggacagcggcacctacgtgtgcaccaccagaaacgccagctactgcgacaagatgagcatcgagctgagagtgttcgagaacaccgacgccttcctgcccttcatcagctacccccagatcctgaccctgagcaccagcggcgtgctggtgtgccccgacctgagcgagttcaccagagacaagaccgacgtgaagatccagtggtacaaggacagcctgctgctggacaaggacaacgagaagttcctgagcgtgagaggcaccacccacctgctggtgcacgacgtggccctggaggacgccggctactacagatgcgtgctgaccttcgcccacgagggccagcagtacaacatcaccagaagcatcgagctgagaatcaagaagaagaaggaggagaccatccccgtgatcatcagccccctgaagaccatcagcgccagcctgggcagcagactgaccatcccctgcaaggtgttcctgggcaccggcacccccctgaccaccatgctgtggtggaccgccaacgacacccacatcgagagcgcctaccccggcggcagagtgaccgagggccccagacaggagtacagcgagaacaacgagaactacatcgaggtgcccctgatcttcgaccccgtgaccagagaggacctgcacatggacttcaagtgcgtggtgcacaacaccctgagcttccagaccctgagaaccaccgtgaaggaggccagcagcaccttcagctggggcatcgtgctggcccccctgagcctggccttcctggtgctgggcggcatctggatgcacagaagatgcaagcacagaaccggcaaggccgacggcctgaccgtgctgtggccccaccaccaggacttccagagctaccccaagtag

SEQ ID NO: 85535 - DNA, 1197 bp, Artificial Sequence; identical to SEQ ID NO: 85534
  Description of Artificial Sequence: Synthetic coding sequence

SEQ ID NO: 85536 - DNA, 690 bp, Artificial Sequence
  Description of Artificial Sequence: Synthetic coding sequence
atgctgagactgtacgtgctggtgatgggcgtgagcgccttcaccctgcagcccgccgcccacaccggcgccgccagaagctgcagattcagaggcagacactacaagagagagttcagactggagggcgagcccgtggccctgagatgcccccaggtgccctactggctgtgggccagcgtgagccccagaatcaacctgacctggcacaagaacgacagcgccagaaccgtgcccggcgaggaggagaccagaatgtgggcccaggacggcgccctgtggctgctgcccgccctgcaggaggacagcggcacctacgtgtgcaccaccagaaacgccagctactgcgacaagatgagcatcgagctgagagtgttcgagaacaccgacgccttcctgcccttcatcagctacccccagatcctgaccctgagcaccagcggcgtgctggtgtgccccgacctgagcgagttcaccagagacaagaccgacgtgaagatccagtggtacaaggacagcctgctgctggacaaggacaacgagaagttcctgagcgtgagaggcaccacccacctgctggtgcacgacgtggccctggaggacgccggctactacagatgcgtgctgaccttcgcccacgagggccagcagtacaacatcaccagaagcatcgagctgagaatcaagtag

SEQ ID NO: 85537 - DNA, 1098 bp, Artificial Sequence
  Description of Artificial Sequence: Synthetic coding sequence
atgctgccccccctgcccagcagactgggcctgctgctgctgctgctgctgtgccccgcccacgtgggcggcctgtggtgggccgtgggcagccccctggtgatggaccccaccagcatctgcagaaaggccagaagactggccggcagacaggccgagctgtgccaggccgagcccgaggtggtggccgagctggccagaggcgccagactgggcgtgagagagtgccagttccagttcagattcagaagatggaactgcagcagccacagcaaggccttcggcagaatcctgcagcaggacatcagagagaccgccttcgtgttcgccatcaccgccgccggcgccagccacgccgtgacccaggcctgcagcatgggcgagctgctgcagtgcggctgccaggcccccagaggcagagccccccccagacccagcggcctgcccggcacccccggcccccccggccccgccggcagccccgagggcagcgccgcctgggagtggggcggctgcggcgacgacgtggacttcggcgacgagaagagcagactgttcatggacgccagacacaagagaggcagaggcgacatcagagccctggtgcagctgcacaacaacgaggccggcagactggccgtgagaagccacaccagaaccgagtgcaagtgccacggcctgagcggcagctgcgccctgagaacctgctggcagaagctgccccccttcagagaggtgggcgccagactgctggagagattccacggcgccagcagagtgatgggcaccaacgacggcaaggccctgctgcccgccgtgagaaccctgaagccccccggcagagccgacctgctgtacgccgccgacagccccgacttctgcgcccccaacagaagaaccggcagccccggcaccagaggcagagcctgcaacagcagcgcccccgacctgagcggctgcgacctgctgtgctgcggcagaggccacagacaggagagcgtgcagctggaggagaactgcctgtgcagattccactggtgctgcgtggtgcagtgccacagatgcagagtgagaaaggagctgagcctgtgcctgtag

SEQ ID NO: 85538 - DNA, 987 bp, Artificial Sequence
  Description of Artificial Sequence: Synthetic coding sequence
atgggcttctggatcctggccatcctgaccatcctgatgtacagcaccgccgccaagttcagcaagcagagctggggcctggagaacgaggccctgatcgtgagatgccccagacagggcaagcccagctacaccgtggactggtactacagccagaccaacaagagcatccccacccaggagagaaacagagtgttcgccagcggccagctgctgaagttcctgcccgccgccgtggccgacagcggcatctacacctgcatcgtgagaagccccaccttcaacagaaccggctacgccaacgtgaccatctacaagaagcagagcgactgcaacgtgcccgactacctgatgtacagcaccgtgagcggcagcgagaagaacagcaagatctactgccccaccatcgacctgtacaactggaccgcccccctggagtggttcaagaactgccaggccctgcagggcagcagatacagagcccacaagagcttcctggtgatcgacaacgtgatgaccgaggacgccggcgactacacctgcaagttcatccacaacgagaacggcgccaactacagcgtgaccgccaccagaagcttcaccgtgaaggacgagcagggcttcagcctgttccccgtgatcggcgcccccgcccagaacgagatcaaggaggtggagatcggcaagaacgccaacctgacctgcagcgcctgcttcggcaagggcacccagttcctggccgccgtgctgtggcagctgaacggcaccaagatcaccgacttcggcgagcccagaatccagcaggaggagggccagaaccagagcttcagcaacggcctggcctgcctggacatggtgctgagaatcgccgacgtgaaggaggaggacctgctgctgcagtacgactgcctggccctgaacctgcacggcctgagaagacacaccgtgagactgagcagaaagaaccccagcaaggagtgcttctag

SEQ ID NO: 85539 - DNA, 780 bp, Artificial Sequence
  Description of Artificial Sequence: Synthetic coding sequence
atgggcttctggatcctggccatcctgaccatcctgatgtacagcaccgccgccaagttcagcaagcagagctggggcctggagaacgaggccctgatcgtgagatgccccagacagggcaagcccagctacaccgtggactggtactacagccagaccaacaagagcatccccacccaggagagaaacagagtgttcgccagcggccagctgctgaagttcctgcccgccgccgtggccgacagcggcatctacacctgcatcgtgagaagccccaccttcaacagaaccggctacgccaacgtgaccatctacaagaagcagagcgactgcaacgtgcccgactacctgatgtacagcaccgtgagcggcagcgagaagaacagcaagatctactgccccaccatcgacctgtacaactggaccgcccccctggagtggttcaagaactgccaggccctgcagggcagcagatacagagcccacaagagcttcctggtgatcgacaacgtgatgaccgaggacgccggcgactacacctgcaagttcatccacaacgagaacggcgccaactacagcgtgaccgccaccagaagcttcaccgtgaaggtgtggtgccagagcttctgcaagctgaagaagagcctgatcttcagcaacacccactggatccagagcctgatgagaggcttcgtgatggtgtactacggcgtgcacaagtgctgcagagtggtgttcaacctgtgcctgcagtacttccagcaccaccagtggccctag

SEQ ID NO: 85540 - DNA, 636 bp, Artificial Sequence
  Description of Artificial Sequence: Synthetic coding sequence
atgtacagcaccgtgagcggcagcgagaagaacagcaagatctactgccccaccatcgacctgtacaactggaccgcccccctggagtggttcaagaactgccaggccctgcagggcagcagatacagagcccacaagagcttcctggtgatcgacaacgtgatgaccgaggacgccggcgactacacctgcaagttcatccacaacgagaacggcgccaactacagcgtgaccgccaccagaagcttcaccgtgaaggacgagcagggcttcagcctgttccccgtgatcggcgcccccgcccagaacgagatcaaggaggtggagatcggcaagaacgccaacctgacctgcagcgcctgcttcggcaagggcacccagttcctggccgccgtgctgtggcagctgaacggcaccaagatcaccgacttcggcgagcccagaatccagcaggaggagggccagaaccagagcttcagcaacggcctggcctgcctggacatggtgctgagaatcgccgacgtgaaggaggaggacctgctgctgcagtacgactgcctggccctgaacctgcacggcctgagaagacacaccgtgagactgagcagaaagaaccccagcaaggagtgcttctag

SEQ ID NO: 85541 - DNA, 945 bp, Artificial Sequence
  Description of Artificial Sequence: Synthetic coding sequence
atgggcttctggatcctggccatcctgaccatcctgatgtacagcaccgccgccaagttcagcaagcagagctggggcctggagaacgaggccctgatcgtgagatgccccagacagggcaagcccagctacaccgtggactggtactacagccagaccaacaagagcatccccacccaggagagaaacagagtgttcgccagcggccagctgctgaagttcctgcccgccgccgtggccgacagcggcatctacacctgcatcgtgagaagccccaccttcaacagaaccggctacgccaacgtgaccatctacaagaagcagagcgactgcaacgtgcccgactacctgatgtacagcaccgtgagcggcagcgagaagaacagcaagatctactgccccaccatcgacctgtacaactggaccgcccccctggagtggttcaagaactgccaggccctgcagggcagcagatacagagcccacaagagcttcctggtgatcgacaacgtgatgaccgaggacgccggcgactacacctgcaagttcatccacaacgagaacggcgccaactacagcgtgaccgccaccagaagcttcaccgtgaaggacgagcagggcttcagcctgttccccgtgatcggcgcccccgcccagaacgagatcaaggaggtggagatcggcacccagttcctggccgccgtgctgtggcagctgaacggcaccaagatcaccgacttcggcgagcccagaatccagcaggaggagggccagaaccagagcttcagcaacggcctggcctgcctggacatggtgctgagaatcgccgacgtgaaggaggaggacctgctgctgcagtacgactgcctggccctgaacctgcacggcctgagaagacacaccgtgagactgagcagaaagaaccccagcaaggagtgcttctag

SEQ ID NO: 85542 - DNA, 117 bp, Artificial Sequence
  Description of Artificial Sequence: Synthetic coding sequence
atgggcttctggatcctggccatcctgaccatcctgatgtacagcaccgccgccaagttcagcaagcagagctggggcctggagaacgaggccctgatcgtgagatgccccagatag

SEQ ID NO: 85543 - DNA, 1728 bp, Artificial Sequence
  Description of Artificial Sequence: Synthetic coding sequence
atgtggagcctgctgctgtgcggcctgagcatcgccctgcccctgagcgtgaccgccgacggctgcaaggacatcttcatgaagaacgagatcctgagcgccagccagcccttcgccttcaactgcaccttcccccccatcaccagcggcgaggtgagcgtgacctggtacaagaacagcagcaagatccccgtgagcaagatcatccagagcagaatccaccaggacgagacctggatcctgttcctgcccatggagtggggcgacagcggcgtgtaccagtgcgtgatcaagggcagagacagctgccacagaatccacgtgaacctgaccgtgttcgagaagcactggtgcgacaccagcatcggcggcctgcccaacctgagcgacgagtacaagcagatcctgcacctgggcaaggacgacagcctgacctgccacctgcacttccccaagagctgcgtgctgggccccatcaagtggtacaaggactgcaacgagatcaagggcgagagattcaccgtgctggagaccagactgctggtgagcaacgtgagcgccgaggacagaggcaactacgcctgccaggccatcctgacccacagcggcaagcagtacgaggtgctgaacggcatcaccgtgagcatcaccgagagagccggctacggcggcagcgtgcccaagatcatctaccccaagaaccacagcatcgaggtgcagctgggcaccaccctgatcgtggactgcaacgtgaccgacaccaaggacaacaccaacctgagatgctggagagtgaacaacaccctggtggacgactactacgacgagagcaagagaatcagagagggcgtggagacccacgtgagcttcagagagcacaacctgtacaccgtgaacatcaccttcctggaggtgaagatggaggactacggcctgcccttcatgtgccacgccggcgtgagcaccgcctacatcatcctgcagctgcccgcccccgacttcagagcctacctgatcggcggcctgatcgccctggtggccgtggccgtgagcgtggtgtacatctacaacatcttcaagatcgacatcgtgctgtggtacagaagcgccttccacagcaccgagaccatcgtggacggcaagctgtacgacgcctacgtgctgtaccccaagccccacaaggagagccagagacacgccgtggacgccctggtgctgaacatcctgcccgaggtgctggagagacagtgcggctacaagctgttcatcttcggcagagacgagttccccggccaggccgtggccaacgtgatcgacgagaacgtgaagctgtgcagaagactgatcgtgatcgtggtgcccgagagcctgggcttcggcctgctgaagaacctgagcgaggagcagatcgccgtgtacagcgccctgatccaggacggcatgaaggtgatcctgatcgagctggagaagatcgaggactacaccgtgatgcccgagagcatccagtacatcaagcagaagcacggcgccatcagatggcacggcgacttcaccgagcagagccagtgcatgaagaccaagttctggaagaccgtgagataccacatgccccccagaagatgcagacccttcccccccgtgcagctgctgcagcacaccccctgctacagaaccgccggccccgagctgggcagcagaagaaagaagtgcaccctgaccaccggctag

SEQ ID NO: 85544 - DNA, 519 bp, Artificial Sequence
  Description of Artificial Sequence: Synthetic coding sequence
atgtggagcctgctgctgtgcggcctgagcatcgccctgcccctgagcgtgaccgccgacggctgcaaggacatcttcatgaagaacgagatcctgagcgccagccagcccttcgccttcaactgcaccttcccccccatcaccagcggcgaggtgagcgtgacctggtacaagaacagcagcaagatccccgtgagcaagatcatccagagcagaatccaccaggacgagacctggatcctgttcctgcccatggagtggggcgacagcggcgtgtaccagtgcgtgatcaagggcagagacagctgccacagaatccacgtgaacctgaccgtgttcgagaagcactggtgcgacaccagcatcggcggcctgcccaacctgagcgacgagtacaagcagatcctgcacctgggcaaggacgacagcctgacctgccacctgcacttccccaagagctgcgtgctgggccccatcaagtggtacaaggactgcaacgagatcaagggcgagagatag

SEQ ID NO: 85545 - DNA, 1374 bp, Artificial Sequence
  Description of Artificial Sequence: Synthetic coding sequence
atgaccggcctggtgagcctgagctacttccccctgagcaccagaagctgcgccctgcagagctgcagccccgtgtggggctgcggcccctgctgcagcgccggctgccccagccccttccactgcctgagccagcaggactgcaacgagatcaagggcgagagattcaccgtgctggagaccagactgctggtgagcaacgtgagcgccgaggacagaggcaactacgcctgccaggccatcctgacccacagcggcaagcagtacgaggtgctgaacggcatcaccgtgagcatcaagagagccggctacggcggcagcgtgcccaagatcatctaccccaagaaccacagcatcgaggtgcagctgggcaccaccctgatcgtggactgcaacgtgaccgacaccaaggacaacaccaacctgagatgctggagagtgaacaacaccctggtggacgactactacgacgagagcaagagaatcagagagggcgtggagacccacgtgagcttcagagagcacaacctgtacaccgtgaacatcaccttcctggaggtgaagatggaggactacggcctgcccttcatgtgccacgccggcgtgagcaccgcctacatcatcctgcagctgcccgcccccgacttcagagcctacctgatcggcggcctgatcgccctggtggccgtggccgtgagcgtggtgtacatctacaacatcttcaagatcgacatcgtgctgtggtacagaagcgccttccacagcaccgagaccatcgtggacggcaagctgtacgacgcctacgtgctgtaccccaagccccacaaggagagccagagacacgccgtggacgccctggtgctgaacatcctgcccgaggtgctggagagacagtgcggctacaagctgttcatcttcggcagagacgagttccccggccaggccgtggccaacgtgatcgacgagaacgtgaagctgtgcagaagactgatcgtgatcgtggtgcccgagagcctgggcttcggcctgctgaagaacctgagcgaggagcagatcgccgtgtacagcgccctgatccaggacggcatgaaggtgatcctgatcgagctggagaagatcgaggactacaccgtgatgcccgagagcatccagtacatcaagcagaagcacggcgccatcagatggcacggcgacttcaccgagcagagccagtgcatgaagaccaagttctggaagaccgtgagataccacatgccccccagaagatgcagacccttcccccccgtgcagctgctgcagcacaccccctgctacagaaccgccggccccgagctgggcagcagaagaaagaagtgcaccctgaccaccggctag

SEQ ID NO: 85546 - DNA, 1728 bp, Artificial Sequence; identical to SEQ ID NO: 85543
  Description of Artificial Sequence: Synthetic coding sequence

SEQ ID NO: 85547 - DNA, 300 bp, Artificial Sequence
  Description of Artificial Sequence: Synthetic coding sequence
atgcagcccagagtgctgctggtggtggccctgctggccctgctggccagcgccagagccagcgaggccgaggacgccagcctgctgagcttcatgcagggctacatgaagcacgccaccaagaccgccaaggacgccctgagcagcgtgcaggagagccaggtggcccagcaggccagaggctgggtgaccgacggcttcagcagcctgaaggactactggagcaccgtgaaggacaagttcagcgagttctgggacctggaccccgaggtgagacccaccagcgccgtggccgcctag

SEQ ID NO: 85548 - DNA, 1500 bp, Artificial Sequence
  Description of Artificial Sequence: Synthetic coding sequence
atgagcagaaccgagctgcccagcccccccagcgtgtggttcgaggccgagttcttccaccacatcctgcactggacccccatccccaaccagagcgagagcacctgctacgaggtggccctgctgagatacggcatcgagagctggaacagcatcagcaactgcagccagaccctgagctacgacctgaccgccgtgaccctggacctgtaccacagcaacggctacagagccagagtgagagccgtggacggcagcagacacagcaactggaccgtgaccaacaccagattcagcgtggacgaggtgaccctgaccgtgggcagcgtgaacctggagatccacaacggcttcatcctgggcaagatccagctgcccagacccaagatggcccccgccaacgacacctacgagagcatcttcagccacttcagagagtacgagatcgccatcagaaaggtgcccggcaacttcaccttcacccacaagaaggtgaagcacgagaacttcagcctgctgaccagcggcgaggtgggcgagttctgcgtgcaggtgaagcccagcgtggccagcagaagcaacaagggcatgtggagcaaggaggagtgcatcagcctgaccagacagtacttcaccgtgaccaacgtgatcatcttcttcgccttcgtgctgctgctgagcggcgccctggcctactgcctggccctgcagctgtacgtgagaagaagaaagaagctgcccagcgtgctgctgttcaagaagcccagccccttcatcttcatcagccagagacccagccccgagacccaggacaccatccaccccctggacgaggaggccttcctgaaggtgagccccgagctgaagaacctggacctgcacggcagcaccgacagcggcttcggcagcaccaagcccagcctgcagaccgaggagccccagttcctgctgcccgacccccacccccaggccgacagaaccctgggcaacagagagccccccgtgctgggcgacagctgcagcagcggcagcagcaacagcaccgacagcggcatctgcctgcaggagcccagcctgagccccagcaccggccccacctgggagcagcaggtgggcagcaacagcagaggccaggacgacagcggcatcgacctggtgcagaacagcgagggcagagccggcgacacccagggcggcagcgccctgggccaccacagcccccccgagcccgaggtgcccggcgaggaggaccccgccgccgtggccttccagggctacctgagacagaccagatgcgccgaggagaaggccaccaagaccggctgcctggaggaggagagccccctgaccgacggcctgggccccaagttcggcagatgcctggtggacgaggccggcctgcacccccccgccctggccaagggctacctgaagcaggaccccctggagatgaccctggccagcagcggccccaacggcaccgtggagcccgcccactag

SEQ ID NO: 85549 - DNA, 1677 bp, Artificial Sequence
  Description of Artificial Sequence: Synthetic coding sequence
atgagcagaaccgagctgcccagcccccccagcgtgtggttcgaggccgagttcttccaccacatcctgcactggacccccatccccaaccagagcgagagcacctgctacgaggtggccctgctgagatacggcatcgagagctggaacagcatcagcaactgcagccagaccctgagctacgacctgaccgccgtgaccctggacctgtaccacagcaacggctacagagccagagtgagagccgtggacggcagcagacacagcaactggaccgtgaccaacaccagattcagcgtggacgaggtgaccctgaccgtgggcagcgtgaacctggagatccacaacggcttcatcctgggcaagatccagctgcccagacccaagatggcccccgccaacgacacctacgagagcatcttcagccacttcagagagtacgagatcgccatcagaaaggtgcccggcaacttcaccttcacccacaagaaggtgaagcacgagaacttcagcctgctgaccagcggcgaggtgggcgagttctgcgtgcaggtgaagcccagcgtggccagcagaagcaacaagggcatgtggagcaaggaggagtgcatcagcctgaccagacagtacttcaccgtgaccaacgtgatcatcttcttcgccttcgtgctgctgctgagcggcgccctggcctactgcctggccctgcagctgtacgtgagaagaagaaagaagctgcccagcgtgctgctgttcaagaagcccagccccttcatcttcatcagccagagacccagccccgagacccaggacaccatccaccccctggacgaggaggccttcctgaaggtgagccccgagctgaagaacctggacctgcacggcagcaccgacagcggcttcggcagcaccaagcccagcctgcagaccgaggagccccagttcctgctgcccgacccccacccccaggccgacagaaccctgggcaacagagagccccccgtgctgggcgacagctgcagcagcggcagcagcaacagcaccgacagcggcatctgcctgcaggagcccagcctgagccccagcaccggccccacctgggagcagcaggtgggcagcaacagcagaggccaggacgacagcggcatcgacctggtgcagaacagcgagggcagagccggcgacacccagggcggcagcgccctgggccaccacagcccccccgagcccgaggtgcccggcgaggaggaccccgccgccgtggccttccagggctacctgagacagaccagatgcgccgaggagaaggccaccaagaccggctgcctggaggaggagagccccctgaccgacggcctgggccccaagttcggcagatgcctggtggacgaggccggcctgcacccccccgccctggccaagggctacctgaagcaggaccccctggagatgaccctggccagcagcggcgcccccaccggccagtggaaccagcccaccgaggagtggagcctgctggccctgagcagctgcagcgacctgggcatcagcgactggagcttcgcccacgacctggcccccctgggctgcgtggccgcccccggcggcctgctgggcagcttcaacagcgacctggtgaccctgcccctgatcagcagcctgcagagcagcgagtag

SEQ ID NO: 85550 - DNA, 1290 bp, Artificial Sequence
  Description of Artificial Sequence: Synthetic coding sequence
atggcccccgccaacgacacctacgagagcatcttcagccacttcagagagtacgagatcgccatcagaaaggtgcccggcaacttcaccttcacccacaagaaggtgaagcacgagaacttcagcctgctgaccagcggcgaggtgggcgagttctgcgtgcaggtgaagcccagcgtggccagcagaagcaacaagggcatgtggagcaaggaggagtgcatcagcctgaccagacagtacttcaccgtgaccaacgtgatcatcttcttcgccttcgtgctgctgctgagcggcgccctggcctactgcctggccctgcagctgtacgtgagaagaagaaagaagctgcccagcgtgctgctgttcaagaagcccagccccttcatcttcatcagccagagacccagccccgagacccaggacaccatccaccccctggacgaggaggccttcctgaaggtgagccccgagctgaagaacctggacctgcacggcagcaccgacagcggcttcggcagcaccaagcccagcctgcagaccgaggagccccagttcctgctgcccgacccccacccccaggccgacagaaccctgggcaacagagagccccccgtgctgggcgacagctgcagcagcggcagcagcaacagcaccgacagcggcatctgcctgcaggagcccagcctgagccccagcaccggccccacctgggagcagcaggtgggcagcaacagcagaggccaggacgacagcggcatcgacctggtgcagaacagcgagggcagagccggcgacacccagggcggcagcgccctgggccaccacagcccccccgagcccgaggtgcccggcgaggaggaccccgccgccgtggccttccagggctacctgagacagaccagatgcgccgaggagaaggccaccaagaccggctgcctggaggaggagagccccctgaccgacggcctgggccccaagttcggcagatgcctggtggacgaggccggcctgcacccccccgccctggccaagggctacctgaagcaggaccccctggagatgaccctggccagcagcggcgcccccaccggccagtggaaccagcccaccgaggagtggagcctgctggccctgagcagctgcagcgacctgggcatcagcgactggagcttcgcccacgacctggcccccctgggctgcgtggccgcccccggcggcctgctgggcagcttcaacagcgacctggtgaccctgcccctgatcagcagcctgcagagcagcgagtag

SEQ ID NO: 85551 - DNA, 1269 bp, Artificial Sequence
  Description of Artificial Sequence: Synthetic coding sequence
atgagcagcagctgcagcggcctgagcagagtgctggtggccgtggccaccgccctggtgagcgccagcagcccctgcccccaggcctggggcccccccggcgtgcagtacggccagcccggcagaagcgtgaagctgtgctgccccggcgtgaccgccggcgaccccgtgagctggttcagagacggcgagcccaagctgctgcagggccccgacagcggcctgggccacgagctggtgctggcccaggccgacagcaccgacgagggcacctacatctgccagaccctggacggcgccctgggcggcaccgtgaccctgcagctgggctacccccccgccagacccgtggtgagctgccaggccgccgactacgagaacttcagctgcacctggagccccagccagatcagcggcctgcccaccagatacctgaccagctacagaaagaagaccgtgctgggcgccgacagccagagaagaagccccagcaccggcccctggccctgcccccaggaccccctgggcgccgccagatgcgtggtgcacggcgccgagttctggagccagtacagaatcaacgtgaccgaggtgaaccccctgggcgccagcaccagactgctggacgtgagcctgcagagcatcctgagacccgaccccccccagggcctgagagtggagagcgtgcccggctaccccagaagactgagagccagctggacctaccccgccagctggccctgccagccccacttcctgctgaagttcagactgcagtacagacccgcccagcaccccgcctggagcaccgtggagcccgccggcctggaggaggtgatcaccgacgccgtggccggcctgccccacgccgtgagagtgagcgccagagacttcctggacgccggcacctggagcacctggagccccgaggcctggggcacccccagcaccggcaccatccccaaggagatccccgcctggggccagctgcacacccagcccgaggtggagccccaggtggacagccccgccccccccagacccagcctgcagccccaccccagactgctggaccacagagacagcgtggagcaggtggccgtgctggccagcctgggcatcctgagcttcctgggcctggtggccggcgccctggccctgggcctgtggctgagactgagaagaggcggcaaggacggcagccccaagcccggcttcctggccagcgtgatccccgtggacagaagacccggcgcccccaacctgtag

SEQ ID NO: 85552 - DNA, 1173 bp, Artificial Sequence
  Description of Artificial Sequence: Synthetic coding sequence
atgagcagcagctgcagcggcctgagcagagtgctggtggccgtggccaccgccctggtgagcgccagcagcccctgcccccaggcctggggcccccccggcgtgcagtacggccagcccggcagaagcgtgaagctgtgctgccccggcgtgaccgccggcgaccccgtgagctggttcagagacggcgagcccaagctgctgcagggccccgacagcggcctgggccacgagctggtgctggcccaggccgacagcaccgacgagggcacctacatctgccagaccctggacggcgccctgggcggcaccgtgaccctgcagctgggctacccccccgccagacccgtggtgagctgccaggccgccgactacgagaacttcagctgcacctggagccccagccagatcagcggcctgcccaccagatacctgaccagctacagaaagaagaccgtgctgggcgccgacagccagagaagaagccccagcaccggcccctggccctgcccccaggaccccctgggcgccgccagatgcgtggtgcacggcgccgagttctggagccagtacagaatcaacgtgaccgaggtgaaccccctgggcgccagcaccagactgctggacgtgagcctgcagagcatcctgagacccgaccccccccagggcctgagagtggagagcgtgcccggctaccccagaagactgagagccagctggacctaccccgccagctggccctgccagccccacttcctgctgaagttcagactgcagtacagacccgcccagcaccccgcctggagcaccgtggagcccgccggcctggaggaggtgatcaccgacgccgtggccggcctgccccacgccgtgagagtgagcgccagagacttcctggacgccggcacctggagcacctggagccccgaggcctggggcacccccagcaccggcaccatccccaaggagatccccgcctggggccagctgcacacccagcccgaggtggagccccaggtggacagccccgccccccccagacccagcctgcagccccaccccagactgctggaccacagagacagcgtggagcaggtggccgtgctggccagcctgggcatcctgagcttcctgggcctggtggccggcgccctggccctgggcctgtggtag

SEQ ID NO: 85553 - DNA, 1269 bp, Artificial Sequence; identical to SEQ ID NO: 85551
  Description of Artificial Sequence: Synthetic coding sequence

SEQ ID NO: 85554 - DNA, 1269 bp, Artificial Sequence; identical to SEQ ID NO: 85551
  Description of Artificial Sequence: Synthetic coding sequence

SEQ ID NO: 85555 - DNA, 813 bp, Artificial Sequence
  Description of Artificial Sequence: Synthetic coding sequence
atgagcagcagctgcagcggcctgagcagagtgctggtggccgtggccaccgccctggtgagcgccagcagcccctgcccccaggcctggggcccccccggcgtgcagtacggccagcccggcagaagcgtgaagctgtgctgccccggcgtgaccgccggcgaccccgtgagctggttcagagacggcgagcccaagctgctgcagggccccgacagcggcctgggccacgagctggtgctggcccaggccgacagcaccgacgagggcacctacatctgccagaccctggacggcgccctgggcggcaccgtgaccctgcagctgggctacccccccgccagacccgtggtgagctgccaggccgccgactacgagaacttcagctgcacctggagccccagccagatcagcggcctgcccaccagatacctgaccagctacagaaagaagaccgtgctgggcgccgacagccagagaagaagccccagcaccggcccctggccctgcccccaggaccccctgggcgccgccagatgcgtggtgcacggcgccgagttctggagccagtacagaatcaacgtgaccgaggtgaaccccctgggcgccagcaccagactgctggacgtgagcctgcagagcatcctgagacccgaccccccccagggcctgagagtggagagcgtgcccggctaccccagaagactgagagccagctggacctaccccgccagctggccctgccagccccacttcctgctgaagttcagactgcagtacagacccgcccagcaccccgcctggagcacctag

SEQ ID NO: 85556 - DNA, 504 bp, Artificial Sequence
  Description of Artificial Sequence: Synthetic coding sequence
atgagcagcagctgcagcggcctgagcagagtgctggtggccgtggccaccgccctggtgagcgccagcagcccctgcccccaggcctggggcccccccggcgtgcagtacggccagcccggcagaagcgtgaagctgtgctgccccggcgtgaccgccggcgaccccgtgagctggttcagagacggcgagcccaagctgctgcagggccccgacagcggcctgggccacgagctggtgctggcccaggccgacagcaccgacgagggcacctacatctgccagaccctggacggcgccctgggcggcaccgtgaccctgcagctgggctacccccccgccagacccgtggtgagctgccaggccgccgactacgagaacttcagctgcacctggagccccagccagatcagcggcctgcccaccagatacctgaccagctacagaaagaagaccgtgctgggcgccgacagccagagaagaagccccagcaccggcccctag

SEQ ID NO: 85557 - DNA, 420 bp, Artificial Sequence
  Description of Artificial Sequence: Synthetic coding sequence
atgagcagcagctgcagcggcctgagcagagtgctggtggccgtggccaccgccctggtgagcgccagcagcccctgcccccaggcctggggcccccccggcgtgcagtacggccagcccggcagaagcgtgaagctgtgctgccccggcgtgaccgccggcgaccccgtgagctggttcagagacggcgagcccaagctgctgcagggccccgacagcggcctgggccacgagctggtgctggcccaggccgacagcaccgacgagggcacctacatctgccagaccctggacggcgccctgggcggcaccgtgaccctgcagctgggctacccccccgccagacccgtggtgagctgccaggccgccgactacgagaacttcagctgcacctggagccccagccagatcagcggctag

SEQ ID NO: 85558 - DNA, 1989 bp, Artificial Sequence
  Description of Artificial Sequence: Synthetic coding sequence
atggagcccctggtgacctgggtggtgcccctgctgttcctgttcctgctgagcagacagggcgccgcctgcagaaccagcgagtgctgcttccaggaccccccctaccccgacgccgacagcggcagcgccagcggccccagagacctgagatgctacagaatcagcagcgacagatacgagtgcagctggcagtacgagggccccaccgccggcgtgagccacttcctgagatgctgcctgagcagcggcagatgctgctacttcgccgccggcagcgccaccagactgcagttcagcgaccaggccggcgtgagcgtgctgtacaccgtgaccctgtgggtggagagctgggccagaaaccagaccgagaagagccccgaggtgaccctgcagctgtacaacagcgtgaagtacgagccccccctgggcgacatcaaggtgagcaagctggccggccagctgagaatggagtgggagacccccgacaaccaggtgggcgccgaggtgcagttcagacacagaacccccagcagcccctggaagctgggcgactgcggcccccaggacgacgacaccgagagctgcctgtgccccctggagatgaacgtggcccaggagttccagctgagaagaagacagctgggcagccagggcagcagctggagcaagtggagcagccccgtgtgcgtgccccccgagaaccccccccagccccaggtgagattcagcgtggagcagctgggccaggacggcagaagaagactgaccctgaaggagcagcccacccagctggagctgcccgagggctgccagggcctggcccccggcaccgaggtgacctacagactgcagctgcacatgctgagctgcccctgcaaggccaaggccaccagaaccctgcacctgggcaagatgccctacctgagcggcgccgcctacaacgtggccgtgatcagcagcaaccagttcggccccggcctgaaccagacctggcacatccccgccgacacccacaccgagcccgtggccctgaacatcagcgtgggcaccaacggcaccaccatgtactggcccgccagagcccagagcatgacctactgcatcgagtggcagcccgtgggccaggacggcggcctggccacctgcagcctgaccgccccccaggaccccgaccccgccggcatggccacctacagctggagcagagagagcggcgccatgggccaggagaagtgctactacatcaccatcttcgccagcgcccaccccgagaagctgaccctgtggagcaccgtgctgagcacctaccacttcggcggcaacgccagcgccgccggcaccccccaccacgtgagcgtgaagaaccacagcctggacagcgtgagcgtggactgggcccccagcctgctgagcacctgccccggcgtgctgaaggagtacgtggtgagatgcagagacgaggacagcaagcaggtgagcgagcaccccgtgcagcccaccgagacccaggtgaccctgagcggcctgagagccggcgtggcctacaccgtgcaggtgagagccgacaccgcctggctgagaggcgtgtggagccagccccagagattcagcatcgaggtgcaggtgagcgactggctgatcttcttcgccagcctgggcagcttcctgagcatcctgctggtgggcgtgctgggctacctgggcctgaacagagccgccagacacctgtgcccccccctgcccaccccctgcgccagcagcgccatcgagttccccggcggcaaggagacctggcagtggatcaaccccgtggacttccaggaggaggccagcctgcaggaggccctggtggtggagatgagctgggacaagggcgagagaaccgagcccctggagaagaccgagctgcccgagggcgcccccgagctggccctggacaccgagctgagcctggaggacggcgacagatgcaaggccaagatgtag

SEQ ID NO: 85559 - DNA, 1146 bp, Artificial Sequence
  Description of Artificial Sequence: Synthetic coding sequence
atggagcccctggtgacctgggtggtgcccctgctgttcctgttcctgctgagcagacagggcgccgcctgcagaaccagcgagtgctgcttccaggaccccccctaccccgacgccgacagcggcagcgccagcggccccagagacctgagatgctacagaatcagcagcgacagatacgagtgcagctggcagtacgagggccccaccgccggcgtgagccacttcctgagatgctgcctgagcagcggcagatgctgctacttcgccgccggcagcgccaccagactgcagttcagcgaccaggccggcgtgagcgtgctgtacaccgtgaccctgtgggtggagagctgggccagaaaccagaccgagaagagccccgaggtgaccctgcagctgtacaacagcgtgaagtacgagccccccctgggcgacatcaaggtgagcaagctggccggccagctgagaatggagtgggagacccccgacaaccaggtgggcgccgaggtgcagttcagacacagaacccccagcagcccctggaagctgggcgactgcggcccccaggacgacgacaccgagagctgcctgtgccccctggagatgaacgtggcccaggagttccagctgagaagaagacagctgggcagccagggcagcagctggagcaagtggagcagccccgtgtgcgtgccccccgagaaccccccccagccccaggtgagattcagcgtggagcagctgggccaggacggcagaagaagactgaccctgaaggagcagcccacccagctggagctgcccgagggctgccagggcctggcccccggcaccgaggtgacctacagactgcagctgcacatgctgagctgcccctgcaaggccaaggccaccagaaccctgcacctgggcaagatgccctacctgagcggcgccgcctacaacgtggccgtgatcagcagcaaccagttcggccccggcctgaaccagacctggcacatccccgccgacacccacaccgacggcatgatcagcgcccactgcaacctgagactgcccgacagcagagacagccccgccagcgccagcagagtggccggcatcaccggcatctgccaccacaccagactgatcctgtacttctag

SEQ ID NO: 85560 - DNA, 1989 bp, Artificial Sequence; identical to SEQ ID NO: 85558
  Description of Artificial Sequence: Synthetic coding sequence

SEQ ID NO: 85561 - DNA, 2589 bp, Artificial Sequence
  Description of Artificial Sequence: Synthetic coding sequence
atggcccacaccttcagaggctgcagcctggccttcatgttcatcatcacctggctgctgatcaaggccaagatcgacgcctgcaagagaggcgacgtgaccgtgaagcccagccacgtgatcctgctgggcagcaccgtgaacatcacctgcagcctgaagcccagacagggctgcttccactacagcagaagaaacaagctgatcctgtacaagttcgacagaagaatcaacttccaccacggccacagcctgaacagccaggtgaccggcctgcccctgggcaccaccctgttcgtgtgcaagctggcctgcatcaacagcgacgagatccagatctgcggcgccgagatcttcgtgggcgtggcccccgagcagccccagaacctgagctgcatccagaagggcgagcagggcaccgtggcctgcacctgggagagaggcagagacacccacctgtacaccgagtacaccctgcagctgagcggccccaagaacctgacctggcagaagcagtgcaaggacatctactgcgactacctggacttcggcatcaacctgacccccgagagccccgagagcaacttcaccgccaaggtgaccgccgtgaacagcctgggcagcagcagcagcctgcccagcaccttcaccttcctggacatcgtgagacccctgcccccctgggacatcagaatcaagttccagaaggccagcgtgagcagatgcaccctgtactggagagacgagggcctggtgctgctgaacagactgagatacagacccagcaacagcagactgtggaacatggtgaacgtgaccaaggccaagggcagacacgacctgctggacctgaagcccttcaccgagtacgagttccagatcagcagcaagctgcacctgtacaagggcagctggagcgactggagcgagagcctgagagcccagacccccgaggaggagcccaccggcatgctggacgtgtggtacatgaagagacacatcgactacagcagacagcagatcagcctgttctggaagaacctgagcgtgagcgaggccagaggcaagatcctgcactaccaggtgaccctgcaggagctgaccggcggcaaggccatgacccagaacatcaccggccacaccagctggaccaccgtgatccccagaaccggcaactgggccgtggccgtgagcgccgccaacagcaagggcagcagcctgcccaccagaatcaacatcatgaacctgtgcgaggccggcctgctggcccccagacaggtgagcgccaacagcgagggcatggacaacatcctggtgacctggcagccccccagaaaggaccccagcgccgtgcaggagtacgtggtggagtggagagagctgcaccccggcggcgacacccaggtgcccctgaactggctgagaagcagaccctacaacgtgagcgccctgatcagcgagaacatcaagagctacatctgctacgagatcagagtgtacgccctgagcggcgaccagggcggctgcagcagcatcctgggcaacagcaagcacaaggcccccctgagcggcccccacatcaacgccatcaccgaggagaagggcagcatcctgatcagctggaacagcatccccgtgcaggagcagatgggctgcctgctgcactacagaatctactggaaggagagagacagcaacagccagccccagctgtgcgagatcccctacagagtgagccagaacagccaccccatcaacagcctgcagcccagagtgacctacgtgctgtggatgaccgccctgaccgccgccggcgagagcagccacggcaacgagagagagttctgcctgcagggcaaggccaactggatggccttcgtggcccccagcatctgcatcgccatcatcatggtgggcatcttcagcacccactacttccagcagaaggtgttcgtgctgctggccgccctgagaccccagtggtgcagcagagagatccccgaccccgccaacagcacctgcgccaagaagtaccccatcgccgaggagaagacccagctgcccctggacagactgctgatcgactggcccacccccgaggaccccgagcccctggtgatcagcgaggtgctgcaccaggtgacccccgtgttcagacaccccccctgcagcaactggccccagagagagaagggcatccagggccaccaggccagcgagaaggacatgatgcacagcgccagcagcccccccccccccagagccctgcaggccgagagcagacagctggtggacctgtacaaggtgctggagagcagaggcagcgaccccaagcccgagaaccccgcctgcccctggaccgtgctgcccgccggcgacctgcccacccacgacggctacctgcccagcaacatcgacgacctgcccagccacgaggcccccctggccgacagcctggaggagctggagccccagcacatcagcctgagcgtgttccccagcagcagcctgcaccccctgaccttcagctgcggcgacaagctgaccctggaccagctgaagatgagatgcgacagcctgatgctgtag

SEQ ID NO: 85562 - DNA, 1980 bp, Artificial Sequence
  Description of Artificial Sequence: Synthetic coding sequence
atggcccacaccttcagaggctgcagcctggccttcatgttcatcatcacctggctgctgatcaaggccaagatcgacgcctgcaagagaggcgacgtgaccgtgaagcccagccacgtgatcctgctgggcagcaccgtgaacatcacctgcagcctgaagcccagacagggctgcttccactacagcagaagaaacaagctgatcctgtacaagttcgacagaagaatcaacttccaccacggccacagcctgaacagccaggtgaccggcctgcccctgggcaccaccctgttcgtgtgcaagctggcctgcatcaacagcgacgagatccagatctgcggcgccgagatcttcgtgggcgtggcccccgagcagccccagaacctgagctgcatccagaagggcgagcagggcaccgtggcctgcacctgggagagaggcagagacacccacctgtacaccgagtacaccctgcagctgagcggccccaagaacctgacctggcagaagcagtgcaaggacatctactgcgactacctggacttcggcatcaacctgacccccgagagccccgagagcaacttcaccgccaaggtgaccgccgtgaacagcctgggcagcagcagcagcctgcccagcaccttcaccttcctggacatcgtgagacccctgcccccctgggacatcagaatcaagttccagaaggccagcgtgagcagatgcaccctgtactggagagacgagggcctggtgctgctgaacagactgagatacagacccagcaacagcagactgtggaacatggtgaacgtgaccaaggccaagggcagacacgacctgctggacctgaagcccttcaccgagtacgagttccagatcagcagcaagctgcacctgtacaagggcagctggagcgactggagcgagagcctgagagcccagacccccgaggaggagcccaccggcatgctggacgtgtggtacatgaagagacacatcgactacagcagacagcagatcagcctgttctggaagaacctgagcgtgagcgaggccagaggcaagatcctgcactaccaggtgaccctgcaggagctgaccggcggcaaggccatgacccagaacatcaccggccacaccagctggaccaccgtgatccccagaaccggcaactgggccgtggccgtgagcgccgccaacagcaagggcagcagcctgcccaccagaatcaacatcatgaacctgtgcgaggccggcctgctggcccccagacaggtgagcgccaacagcgagggcatggacaacatcctggtgacctggcagccccccagaaaggaccccagcgccgtgcaggagtacgtggtggagtggagagagctgcaccccggcggcgacacccaggtgcccctgaactggctgagaagcagaccctacaacgtgagcgccctgatcagcgagaacatcaagagctacatctgctacgagatcagagtgtacgccctgagcggcgaccagggcggctgcagcagcatcctgggcaacagcaagcacaaggcccccctgagcggcccccacatcaacgccatcaccgaggagaagggcagcatcctgatcagctggaacagcatccccgtgcaggagcagatgggctgcctgctgcactacagaatctactggaaggagagagacagcaacagccagccccagctgtgcgagatcccctacagagtgagccagaacagccaccccatcaacagcctgcagcccagagtgacctacgtgctgtggatgaccgccctgaccgccgccggcgagagcagccacggcaacgagagagagttctgcctgcagggcaaggccaactggatggccttcgtggcccccagcatctgcatcgccatcatcatggtgggcatcttcagcacccactacttccagcagaagagaagacacagctgcccctggaccggcagctag

SEQ ID NO: 85563 - DNA, 693 bp, Artificial Sequence
  Description of Artificial Sequence: Synthetic coding sequence
tgacagaagggcgagcagggcaccgtggcctgcacctgggagagaggcagagacacccacctgtacaccgagtacaccctgcagctgagcggccccaagaacctgacctggcagaagcagtgcaaggacatctactgcgactacctggacttcggcatcaacctgacccccgagagccccgagagcaacttcaccgccaaggtgaccgccgtgaacagcctgggcagcagcagcagcctgcccagcaccttcaccttcctggacatcgtgagacccctgcccccctgggacatcagaatcaagttccagaaggccagcgtgagcagatgcaccctgtactggagagacgagggcctggtgctgctgaacagactgagatacagacccagcaacagcagactgtggaacatggtgaacgtgaccaaggccaagggcagacacgacctgctggacctgaagcccttcaccgagtacgagttccagatcagcagcaagctgcacctgtacaagggcagctggagcgactggagcgagagcctgagagcccagacccccgaggaggagcccaccggcatgctggacgtgtggtacatgaagagacacatcgactacagcagacagcagatcagcctgttctggaaggtgagcttcaagagacagctgaagacccagggcaacaagaccgagggctag

SEQ ID NO: 85564 - DNA, 1980 bp, Artificial Sequence; identical to SEQ ID NO: 85562
  Description of Artificial Sequence: Synthetic coding sequence

SEQ ID NO: 85565 - DNA, 2331 bp, Artificial Sequence
  Description of Artificial Sequence: Synthetic coding sequence
atggcccacaccttcagaggctgcagcctggccttcatgttcatcatcacctggctgctgatcaaggccaagatcgacgcctgcaagagaggcgacgtgaccgtgaagcccagccacgtgatcctgctgggcagcaccgtgaacatcacctgcagcctgaagcccagacagggctgcttccactacagcagaagaaacaagctgatcctgtacaagttcgacagaagaatcaacttccaccacggccacagcctgaacagccaggtgaccggcctgcccctgggcaccaccctgttcgtgtgcaagctggcctgcatcaacagcgacgagatccagatctgcggcgccgagatcttcgtgggcgtggcccccgagcagccccagaacctgagctgcatccagaagggcgagcagggcaccgtggcctgcacctgggagagaggcagagacacccacctgtacaccgagtacaccctgcagctgagcggccccaagaacctgacctggcagaagcagtgcaaggacatctactgcgactacctggacttcggcatcaacctgacccccgagagccccgagagcaacttcaccgccaaggtgaccgccgtgaacagcctgggcagcagcagcagcctgcccagcaccttcaccttcctggacatcgtgagacccctgcccccctgggacatcagaatcaagttccagaaggccagcgtgagcagatgcaccctgtactggagagacgagggcctggtgctgctgaacagactgagatacagacccagcaacagcagactgtggaacatggtgaacgtgaccaaggccaagggcagacacgacctgctggacctgaagcccttcaccgagtacgagttccagatcagcagcaagctgcacctgtacaagggcagctggagcgactggagcgagagcctgagagcccagacccccgaggaggagcccaccggcatgctggacgtgtggtacatgaagagacacatcgactacagcagacagcagatcagcctgttctggaagaacctgagcgtgagcgaggccagaggcaagatcctgcactaccaggtgaccctgcaggagctgaccggcggcaaggccatgacccagaacatcaccggccacaccagctggaccaccgtgatccccagaaccggcaactgggccgtggccgtgagcgccgccaacagcaagggcagcagcctgcccaccagaatcaacatcatgaacctgtgcgaggccggcctgctggcccccagacaggtgagcgccaacagcgagggcatggacaacatcctggtgacctggcagccccccagaaaggaccccagcgccgtgcaggagtacgtggtggagtggagagagctgcaccccggcggcgacacccaggtgcccctgaactggctgagaagcagaccctacaacgtgagcgccctgatcagcgagatcccctacagagtgagccagaacagccaccccatcaacagcctgcagcccagagtgacctacgtgctgtggatgaccgccctgaccgccgccggcgagagcagccacggcaacgagagagagttctgcctgcagggcaaggccaactggatggccttcgtggcccccagcatctgcatcgccatcatcatggtgggcatcttcagcacccactacttccagcagaaggtgttcgtgctgctggccgccctgagaccccagtggtgcagcagagagatccccgaccccgccaacagcacctgcgccaagaagtaccccatcgccgaggagaagacccagctgcccctggacagactgctgatcgactggcccacccccgaggaccccgagcccctggtgatcagcgaggtgctgcaccaggtgacccccgtgttcagacaccccccctgcagcaactggccccagagagagaagggcatccagggccaccaggccagcgagaaggacatgatgcacagcgccagcagcccccccccccccagagccctgcaggccgagagcagacagctggtggacctgtacaaggtgctggagagcagaggcagcgaccccaagcccgagaaccccgcctgcccctggaccgtgctgcccgccggcgacctgcccacccacgacggctacctgcccagcaacatcgacgacctgcccagccacgaggcccccctggccgacagcctggaggagctggagccccagcacatcagcctgagcgtgttccccagcagcagcctgcaccccctgaccttcagctgcggcgacaagctgaccctggaccagctgaagatgagatgcgacagcctgatgctgtag

SEQ ID NO: 85566 - DNA, 681 bp, Artificial Sequence
  Description of Artificial Sequence: Synthetic coding sequence
atgagcagccccaccgccagcagcaccacccccagatgcggcaccagcgccggccccgccagccccacctggagatgcagagccaccgccctgcacctgcaccaccccgtggaccagctgccccaccaggtgctgcagcccaccaccggccagagacagcccggcaccggcctgccctggcacagcacccccgcccagctggccctggccggcctgagacaggcccagccccacccccagcagcagagactgcaccagcccggcctgagaggcgtggacgcccacggcagcgccgcccacgtgccccaggccgtgccccaggccgtgagagcccacccccccggccagctgctgagctgggccgccgccgtgtgcctgctgtgccagcaccacctgcagctgcccggcaagaagagaaacagcaccctgtacatcaccatgctgctgatcgtgcccgtgatcgtggccggcgccatcatcgtgctgctgctgtacctgaagagactgaagatcatcatcttcccccccatccccgaccccggcaagatcttcaaggagatgttcggcgaccagaacgacgacaccctgcactggaagaagtacgacatctacgagaagcagaccaaggaggagaccgacagcgtggtgctgatcgagaacctgaagaaggccagccagtag

SEQ ID NO: 85567 - DNA, 840 bp, Artificial Sequence
  Description of Artificial Sequence: Synthetic coding sequence
atggagtggcccgccagactgtgcggcctgtgggccctgctgctgtgcgccggcggcggcggcggcggcggcggcgccgcccccaccgagacccagccccccgtgaccaacctgagcgtgagcgtggagaacctgtgcaccgtgatctggacctggaacccccccgagggcgccagcagcaactgcagcctgtggtacttcagccacttcggcgacaagcaggacaagaagatcgcccccgagaccagaagaagcatcgaggtgcccctgaacgagagaatctgcctgcaggtgggcagccagtgcagcaccaacgagagcgagaagcccagcatcctggtggagaagtgcatcagcccccccgagggcgaccccgagagcgccgtgaccgagctgcagtgcatctggcacaacctgagctacatgaagtgcagctggctgcccggcagaaacaccagccccgacaccaactacaccctgtactactggcacagaagcctggagaagatccaccagtgcgagaacatcttcagagagggccagtacttcggctgcagcttcgacctgaccaaggtgaaggacagcagcttcgagcagcacagcgtgcagatcatggtgaaggacaacgccggcaagatcaagcccagcttcaacatcgtgcccctgaccagcagagtgaagcccgaccccccccacatcaagaacctgagcttccacaacgacgacctgtacgtgcagtgggagaacccccagaacttcatcagcagatgcctgttctacgaggtggaggtgaacaacagccagaccgagacccacaacgtgttctacgtgagattctag

SEQ ID NO: 85568 - DNA, 1284 bp, Artificial Sequence
  Description of Artificial Sequence: Synthetic coding sequence
atggagtggcccgccagactgtgcggcctgtgggccctgctgctgtgcgccggcggcggcggcggcggcggcggcgccgcccccaccgagacccagccccccgtgaccaacctgagcgtgagcgtggagaacctgtgcaccgtgatctggacctggaacccccccgagggcgccagcagcaactgcagcctgtggtacttcagccacttcggcgacaagcaggacaagaagatcgcccccgagaccagaagaagcatcgaggtgcccctgaacgagagaatctgcctgcaggtgggcagccagtgcagcaccaacgagagcgagaagcccagcatcctggtggagaagtgcatcagcccccccgagggcgaccccgagagcgccgtgaccgagctgcagtgcatctggcacaacctgagctacatgaagtgcagctggctgcccggcagaaacaccagccccgacaccaactacaccctgtactactggcacagaagcctggagaagatccaccagtgcgagaacatcttcagagagggccagtacttcggctgcagcttcgacctgaccaaggtgaaggacagcagcttcgagcagcacagcgtgcagatcatggtgaaggacaacgccggcaagatcaagcccagcttcaacatcgtgcccctgaccagcagagtgaagcccgaccccccccacatcaagaacctgagcttccacaacgacgacctgtacgtgcagtgggagaacccccagaacttcatcagcagatgcctgttctacgaggtggaggtgaacaacagccagaccgagacccacaacgtgttctacgtgcaggaggccaagtgcgagaaccccgagttcgagagaaacgtggagaacaccagctgcttcatggtgcccggcgtgctgcccgacaccctgaacaccgtgagaatcagagtgaagaccaacaagctgtgctacgaggacgacaagctgtggagcaactggagccaggagatgagcatcggcaagaagagaaacagcaccctgtacatcaccatgctgctgatcgtgcccgtgatcgtggccggcgccatcatcgtgctgctgctgtacctgaagagactgaagatcatcatcttcccccccatccccgaccccggcaagatcttcaaggagatgttcggcgaccagaacgacgacaccctgcactggaagaagtacgacatctacgagaagcagaccaaggaggagaccgacagcgtggtgctgatcgagaacctgaagaaggccagccagtag

SEQ ID NO: 85569 - DNA, 1143 bp, Artificial Sequence
  Description of Artificial Sequence: Synthetic coding sequence
atggccttcgtgtgcctggccatcggctgcctgtacaccttcctgatcagcaccaccttcggctgcaccagcagcagcgacaccgagatcaaggtgaaccccccccaggacttcgagatcgtggaccccggctacctgggctacctgtacctgcagtggcagccccccctgagcctggaccacttcaaggagtgcaccgtggagtacgagctgaagtacagaaacatcggcagcgagacctggaagaccatcatcaccaagaacctgcactacaaggacggcttcgacctgaacaagggcatcgaggccaagatccacaccctgctgccctggcagtgcaccaacggcagcgaggtgcagagcagctgggccgagaccacctactggatcagcccccagggcatccccgagaccaaggtgcaggacatggactgcgtgtactacaactggcagtacctgctgtgcagctggaagcccggcatcggcgtgctgctggacaccaactacaacctgttctactggtacgagggcctggaccacgccctgcagtgcgtggactacatcaaggccgacggccagaacatcggctgcagattcccctacctggaggccagcgactacaaggacttctacatctgcgtgaacggcagcagcgagaacaagcccatcagaagcagctacttcaccttccagctgcagaacatcgtgaagcccctgccccccgtgtacctgaccttcaccagagagagcagctgcgagatcaagctgaagtggagcatccccctgggccccatccccgccagatgcttcgactacgagatcgagatcagagaggacgacaccaccctggtgaccgccaccgtggagaacgagacctacaccctgaagaccaccaacgagaccagacagctgtgcttcgtggtgagaagcaaggtgaacatctactgcagcgacgacggcatctggagcgagtggagcgacaagcagtgctgggagggcgaggacctgagcaagaagaccctgctgagattctggctgcccttcggcttcatcctgatcctggtgatcttcgtgaccggcctgctgctgagaaagcccaacacctaccccaagatgatccccgagttcttctgcgacacctag

SEQ ID NO: 85570 - DNA, 1143 bp, Artificial Sequence; identical to SEQ ID NO: 85569
  Description of Artificial Sequence: Synthetic coding sequence

SEQ ID NO: 85571 - DNA, 465 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagagagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagagccagcgtgtgcagctgccaccccagaagcgccggccacacctgcagcgtgggcagcgtgtgctag

SEQ ID NO: 85572 - DNA, 804 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagagaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagacagaccccccccctggccagcgtggagatggaggccatggaggccctgcccgtgacctggggcaccagcagcagagacgaggacctggagaactgcagccaccacctgtag

SEQ ID NO: 85573 - DNA, 612 bp, Artificial Sequence
  Description of Artificial Sequence: Synthetic coding sequence
atgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagagaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagcggcgccgtgctgagctacagcggctag

SEQ ID NO: 85574 - DNA, 696 bp, Artificial Sequence
  Description of Artificial Sequence: Synthetic coding sequence
atgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagagaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagacagaccccccccctggccagcgtggagatggaggccatggaggccctgcccgtgacctggggcaccagcagcagagacgaggacctggagaactgcagccaccacctgtag

SEQ ID NO: 85575 - DNA, 510 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagagagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagacagaccccccccctggccagcgtggagatggaggccatggaggccctgcccgtgacctggggcaccagcagcagagacgaggacctggagaactgcagccaccacctgtag

SEQ ID NO: 85576 - DNA, 609 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcgaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagacagaccccccccctggccagcgtggagatggaggccatggaggccctgcccgtgacctggggcaccagcagcagagacgaggacctggagaactgcagccaccacctgtag

SEQ ID NO: 85577 - DNA, 759 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagagaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagagccagcgtgtgcagctgccaccccagaagcgccggccacacctgcagcgtgggcagcgtgtgctag

SEQ ID NO: 85578 - DNA, 564 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcgaccccgccctggtgcaccagagacccgccccccccagcaccgtgaccaccgccggcgtgaccccccagcccgagagcctgagccccagcggcaaggagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagagccagcgtgtgcagctgccaccccagaagcgccggccacacctgcagcgtgggcagcgtgtgctag

SEQ ID NO: 85579 - DNA, 705 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcaagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagacagaccccccccctggccagcgtggagatggaggccatggaggccctgcccgtgacctggggcaccagcagcagagacgaggacctggagaactgcagccaccacctgtag

SEQ ID NO: 85580 - DNA, 660 bp, Artificial Sequence
  Description of Artificial Sequence: Synthetic coding sequence
atggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcaagcccgccgccagcagccccagcagcaacaacaccgccgccaccaccgccgccatcgtgcccggcagccagctgatgcccagcaagagccccagcaccggcaccaccgagatcagcagccacgagagcagccacggcacccccagccagaccaccgccaagaactgggagctgaccgccagcgccagccaccagccccccggcgtgtacccccagggccacagcgacaccaccgtggccatcagcaccagcaccgtgctgctgtgcggcctgagcgccgtgagcctgctggcctgctacctgaagagcagagccagcgtgtgcagctgccaccccagaagcgccggccacacctgcagcgtgggcagcgtgtgctag

SEQ ID NO: 85581 - DNA, 2601 bp, Artificial Sequence
  Description of Artificial Sequence: Synthetic coding sequence
atgggcgccgccagaagcccccccagcgccgtgcccggccccctgctgggcctgctgctgctgctgctgggcgtgctggcccccggcggcgccagcctgagactgctggaccacagagccctggtgtgcagccagcccggcctgaactgcaccgtgaagaacagcacctgcctggacgacagctggatccaccccagaaacctgacccccagcagccccaaggacctgcagatccagctgcacttcgcccacacccagcagggcgacctgttccccgtggcccacatcgagtggaccctgcagaccgacgccagcatcctgtacctggagggcgccgagctgagcgtgctgcagctgaacaccaacgagagactgtgcgtgagattcgagttcctgagcaagctgagacaccaccacagaagatggagattcaccttcagccacttcgtggtggaccccgaccaggagtacgaggtgaccgtgcaccacctgcccaagcccatccccgacggcgaccccaaccaccagagcaagaacttcctggtgcccgactgcgagcacgccagaatgaaggtgaccaccccctgcatgagcagcggcagcctgtgggaccccaacatcaccgtggagaccctggaggcccaccagctgagagtgagcttcaccctgtggaacgagagcacccactaccagatcctgctgaccagcttcccccacatggagaaccacagctgcttcgagcacatgcaccacatccccgcccccagacccgaggagttccaccagagaagcaacgtgaccctgaccctgagaaacctgaagggctgctgcagacaccaggtgcagatccagcccttcttcagcagctgcctgaacgactgcctgagacacagcgccaccgtgagctgccccgagatgcccgacacccccgagcccatccccgactacatgcccctgtgggtgtactggttcatcaccggcatcagcatcctgctggtgggcagcgtgatcctgctgatcgtgtgcatgacctggagactggccggccccggcagcgagaagtacagcgacgacaccaagtacaccgacggcctgcccgccgccgacctgatccccccccccctgaagcccagaaaggtgtggatcatctacagcgccgaccaccccctgtacgtggacgtggtgctgaagttcgcccagttcctgctgaccgcctgcggcaccgaggtggccctggacctgctggaggagcaggccatcagcgaggccggcgtgatgacctgggtgggcagacagaagcaggagatggtggagagcaacagcaagatcatcgtgctgtgcagcagaggcaccagagccaagtggcaggccctgctgggcagaggcgcccccgtgagactgagatgcgaccacggcaagcccgtgggcgacctgttcaccgccgccatgaacatgatcctgcccgacttcaagagacccgcctgcttcggcacctacgtggtgtgctacttcagcgaggtgagctgcgacggcgacgtgcccgacctgttcggcgccgcccccagataccccctgatggacagattcgaggaggtgtacttcagaatccaggacctggagatgttccagcccggcagaatgcacagagtgggcgagctgagcggcgacaactacctgagaagccccggcggcagacagctgagagccgccctggacagattcagagactggcaggtgagatgccccgactggttcgagtgcgagaacctgtacagcgccgacgaccaggacgcccccagcctggacgaggaggtgttcgaggagcccctgctgccccccggcaccggcatcgtgaagagagcccccctggtgagagagcccggcagccaggcctgcctggccatcgaccccctggtgggcgaggagggcggcgccgccgtggccaagctggagccccacctgcagcccagaggccagcccgccccccagcccctgcacaccctggtgctggccgccgaggagggcgccctggtggccgccgtggagcccggccccctggccgacggcgccgccgtgagactggccctggccggcgagggcgaggcctgccccctgctgggcagccccggcgccggcagaaacagcgtgctgttcctgcccgtggaccccgaggacagccccctgggcagcagcacccccatggccagccccgacctgctgcccgaggacgtgagagagcacctggagggcctgatgctgagcctgttcgagcagagcctgagctgccaggcccagggcggctgcagcagacccgccatggtgctgaccgacccccacaccccctacgaggaggagcagagacagagcgtgcagagcgaccagggctacatcagcagaagcagcccccagccccccgagggcctgaccgagatggaggaggaggaggaggaggagcaggaccccggcaagcccgccctgcccctgagccccgaggacctggagagcctgagaagcctgcagagacagctgctgttcagacagctgcagaagaacagcggctgggacaccatgggcagcgagagcgagggccccagcgcctag

SEQ ID NO: 85582 - DNA, 2445 bp, Artificial Sequence
  Description of Artificial Sequence: Synthetic coding sequence
atgggcgccgccagaagcccccccagcgccgtgcccggccccctgctgggcctgctgctgctgctgctgggcgtgctggcccccggcggcgccagcctgagactgctggaccacagagccctggtgtgcagccagcccggcctgaactgcaccgtgaagaacagcacctgcctggacgacagctggatccaccccagaaacctgacccccagcagccccaaggacctgcagatccagctgcacttcgcccacacccagcagggcgacctgttccccgtggcccacatcgagtggaccctgcagaccgacgccagcatcctgtacctggagggcgccgagctgagcgtgctgcagctgaacaccaacgagagactgtgcgtgagattcgagttcctgagcaagctgagacaccaccacagaagatggagattcaccttcagccacttcgtggtggaccccgaccaggagtacgaggtgaccgtgcaccacctgcccaagcccatccccgacggcgaccccaaccaccagagcaagaacttcctggtgcccgactgcgagcacgccagaatgaaggtgaccaccccctgcatgagcagcggcagcctgtgggaccccaacatcaccgtggagaccctggaggcccaccagctgagagtgagcttcaccctgtggaacgagagcacccactaccagatcctgctgaccagcttcccccacatggagaaccacagctgcttcgagcacatgcaccacatccccgcccccagacccgaggagttccaccagagaagcaacgtgaccctgaccctgagaaacctgaagggctgctgcagacaccaggtgcagatccagcccttcttcagcagctgcctgaacgactgcctgagacacagcgccaccgtgagctgccccgagatgcccgacacccccgacggcctgcccgccgccgacctgatccccccccccctgaagcccagaaaggtgtggatcatctacagcgccgaccaccccctgtacgtggacgtggtgctgaagttcgcccagttcctgctgaccgcctgcggcaccgaggtggccctggacctgctggaggagcaggccatcagcgaggccggcgtgatgacctgggtgggcagacagaagcaggagatggtggagagcaacagcaagatcatcgtgctgtgcagcagaggcaccagagccaagtggcaggccctgctgggcagaggcgcccccgtgagactgagatgcgaccacggcaagcccgtgggcgacctgttcaccgccgccatgaacatgatcctgcccgacttcaagagacccgcctgcttcggcacctacgtggtgtgctacttcagcgaggtgagctgcgacggcgacgtgcccgacctgttcggcgccgcccccagataccccctgatggacagattcgaggaggtgtacttcagaatccaggacctggagatgttccagcccggcagaatgcacagagtgggcgagctgagcggcgacaactacctgagaagccccggcggcagacagctgagagccgccctggacagattcagagactggcaggtgagatgccccgactggttcgagtgcgagaacctgtacagcgccgacgaccaggacgcccccagcctggacgaggaggtgttcgaggagcccctgctgccccccggcaccggcatcgtgaagagagcccccctggtgagagagcccggcagccaggcctgcctggccatcgaccccctggtgggcgaggagggcggcgccgccgtggccaagctggagccccacctgcagcccagaggccagcccgccccccagcccctgcacaccctggtgctggccgccgaggagggcgccctggtggccgccgtggagcccggccccctggccgacggcgccgccgtgagactggccctggccggcgagggcgaggcctgccccctgctgggcagccccggcgccggcagaaacagcgtgctgttcctgcccgtggaccccgaggacagccccctgggcagcagcacccccatggccagccccgacctgctgcccgaggacgtgagagagcacctggagggcctgatgctgagcctgttcgagcagagcctgagctgccaggcccagggcggctgcagcagacccgccatggtgctgaccgacccccacaccccctacgaggaggagcagagacagagcgtgcagagcgaccagggctacatcagcagaagcagcccccagccccccgagggcctgaccgagatggaggaggaggaggaggaggagcaggaccccggcaagcccgccctgcccctgagccccgaggacctggagagcctgagaagcctgcagagacagctgctgttcagacagctgcagaagaacagcggctgggacaccatgggcagcgagagcgagggccccagcgcctag

SEQ ID NO: 85583 - DNA, 1509 bp, Artificial Sequence
  Description of Artificial Sequence: Synthetic coding sequence
atgagcctggtgctgctgagcctggccgccctgtgcagaagcgccgtgcccagagagcccaccgtgcagtgcggcagcgagaccggccccagccccgagtggatgctgcagcacgacctgatccccggcgacctgagagacctgagagtggagcccgtgaccaccagcgtggccaccggcgactacagcatcctgatgaacgtgagctgggtgctgagagccgacgccagcatcagactgctgaaggccaccaagatctgcgtgaccggcaagagcaacttccagagctacagctgcgtgagatgcaactacaccgaggccttccagacccagaccagacccagcggcggcaagtggaccttcagctacatcggcttccccgtggagctgaacaccgtgtacttcatcggcgcccacaacatccccaacgccaacatgaacgaggacggccccagcatgagcgtgaacttcaccagccccggctgcctggaccacatcatgaagtacaagaagaagtgcgtgaaggccggcagcctgtgggaccccaacatcaccgcctgcaagaagaacgaggagaccgtggaggtgaacttcaccaccacccccctgggcaacagatacatggccctgatccagcacagcaccatcatcggcttcagccaggtgttcgagccccaccagaagaagcagaccagagccagcgtggtgatccccgtgaccggcgacagcgagggcgccaccgtgcagctgaccccctacttccccacctgcggcagcgactgcatcagacacaagggcaccgtggtgctgtgcccccagaccggcgtgcccttccccctggacaacaacaagagcaagcccggcggctggctgcccctgctgctgctgagcctgctggtggccacctgggtgctggtggccggcatctacctgatgtggagacacgagagaatcaagaagaccagcttcagcaccaccaccctgctgccccccatcaaggtgctggtggtgtaccccagcgagatctgcttccaccacaccatctgctacttcaccgagttcctgcagaaccactgcagaagcgaggtgatcctggagaagtggcagaagaagaagatcgccgagatgggccccgtgcagtggctggccacccagaagaaggccgccgacaaggtggtgttcctgctgagcaacgacgtgaacagcgtgtgcgacggcacctgcggcaagagcgagggcagccccagcgagaacagccaggacctgttccccctggccttcaacctgttctgcagcgacctgagaagccagatccacctgcacaagtacgtggtggtgtacttcagagagatcgacaccaaggacgactacaacgccctgagcgtgtgccccaagtaccacctgatgaaggacgccaccgccttctgcgccgagctgctgcacgtgaagcagcaggtgagcgccggcaagagaagccaggcctgccacgacggctgctgcagcctgtag

SEQ ID NO: 85584 - DNA, 2376 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccgtgagcctggagccctggggcgacgaggagagactgagagtgcagttcctggcccagcagagcctgagcctggcccccgtgaccgccgccaccgccagaaccgccctgagcggcctgagcggcgccgacggcagaagagaggagagaggcagaggcaagagctgggtgtgcctgagcctgggcggcagcggcaacaccgagccccagaagaagggcctgagctgcagactgtgggacagcgacatcctgtgcctgcccggcgacatcgtgcccgcccccggccccgtgctggcccccacccacctgcagaccgagctggtgctgagatgccagaaggagaccgactgcgacctgtgcctgagagtggccgtgcacctggccgtgcacggccactgggaggagcccgaggacgaggagaagttcggcggcgccgccgacagcggcgtggaggagcccagaaacgccagcctgcaggcccaggtggtgctgagcttccaggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgactgcagaggcctggaggtgtggaacagcatccccagctgctgggccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacaaggtgctggagttccccctgctgaagggccaccccaacctgtgcgtgcaggtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaagggctggctgagactgctgaagcaggacgtgagaagcggcgccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85585 - DNA, 2118 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccggcctgagctgcagactgtgggacagcgacatcctgtgcctgcccggcgacatcgtgcccgcccccggccccgtgctggcccccacccacctgcagaccgagctggtgctgagatgccagaaggagaccgactgcgacctgtgcctgagagtggccgtgcacctggccgtgcacggccactgggaggagcccgaggacgaggagaagttcggcggcgccgccgacagcggcgtggaggagcccagaaacgccagcctgcaggcccaggtggtgctgagcttccaggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacaaggtgctggagttccccctgctgaagggccaccccaacctgtgcgtgcaggtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaagggctggctgagactgctgaagcaggacgtgagaagcggcgccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85586 - DNA, 2163 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccggcctgagctgcagactgtgggacagcgacatcctgtgcctgcccggcgacatcgtgcccgcccccggccccgtgctggcccccacccacctgcagaccgagctggtgctgagatgccagaaggagaccgactgcgacctgtgcctgagagtggccgtgcacctggccgtgcacggccactgggaggagcccgaggacgaggagaagttcggcggcgccgccgacagcggcgtggaggagcccagaaacgccagcctgcaggcccaggtggtgctgagcttccaggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgactgcagaggcctggaggtgtggaacagcatccccagctgctgggccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacaaggtgctggagttccccctgctgaagggccaccccaacctgtgcgtgcaggtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaagggctggctgagactgctgaagcaggacgtgagaagcggcgccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85587 - DNA, 1641 bp, Artificial Sequence
  Description of Artificial Sequence: Synthetic coding sequence
atggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacgtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaaggccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85588 - DNA, 2124 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccggcctgagctgcagactgtgggacagcgacatcctgtgcctgcccggcgacatcgtgcccgcccccggccccgtgctggcccccacccacctgcagaccgagctggtgctgagatgccagaaggagaccgactgcgacctgtgcctgagagtggccgtgcacctggccgtgcacggccactgggaggagcccgaggacgaggagaagttcggcggcgccgccgacagcggcgtggaggagcccagaaacgccagcctgcaggcccaggtggtgctgagcttccaggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgactgcagaggcctggaggtgtggaacagcatccccagctgctgggccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacaaggtgctggagttccccctgctgaagggccaccccaacctgtgcgtgcaggtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaaggccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85589 - DNA, 213 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccggcctgagctgcagactgtgggtgacctacagcgcctgcctgggcaccagctgcctgctgagagccccctgctggagactgagaacctgcagacagagctggtgctag

SEQ ID NO: 85590 - DNA, 2067 bp, Artificial Sequence
  Description of Artificial Sequence: Synthetic coding sequence
atgcccgtgccctggttcctgctgagcctggccctgggcagaagccccgtggtgctgagcctggagagactggtgggcccccaggacgccacccactgcagccccggcctgagctgcagactgtgggacagcgacatcctgtgcctgcccggcgacatcgtgcccgcccccggccccgtgctggcccccacccacctgcagaccgagctggtgctgagatgccagaaggagaccgactgcgacctgtgcctgagagtggccgtgcacctggccgtgcacggccactgggaggagcccgaggacgaggagaagttcggcggcgccgccgacagcggcgtggaggagcccagaaacgccagcctgcaggcccaggtggtgctgagcttccaggcctaccccaccgccagatgcgtgctgctggaggtgcaggtgcccgccgccctggtgcagttcggccagagcgtgggcagcgtggtgtacgactgcttcgaggccgccctgggcagcgaggtgagaatctggagctacacccagcccagatacgagaaggagctgaaccacacccagcagctgcccgccctgccctggctgaacgtgagcgccgacggcgacaacgtgcacctggtgctgaacgtgagcgaggagcagcacttcggcctgagcctgtactggaaccaggtgcagggcccccccaagcccagatggcacaagaacctgaccggcccccagatcatcaccctgaaccacaccgacctggtgccctgcctgtgcatccaggtgtggcccctggagcccgacagcgtgagaaccaacatctgccccttcagagaggaccccagagcccaccagaacctgtggcaggccgccagactgcagctgctgaccctgcagagctggctgctggacgccccctgcagcctgcccgccgaggccgccctgtgctggagagcccccggcggcgacccctgccagcccctggtgccccccctgagctgggagaacgtgaccgtggacgtgaacagcagcgagaagctgcagctgcaggagtgcctgtgggccgacagcctgggccccctgaaggacgacgtgctgctgctggagaccagaggcccccaggacaacagaagcctgtgcgccctggagcccagcggctgcaccagcctgcccagcaaggccagcaccagagccgccagactgggcgagtacctgctgcaggacctgcagagcggccagtgcctgcagctgtgggacgacgacctgggcgccctgtgggcctgccccatggacaagtacatccacaagagatgggccctggtgtggctggcctgcctgctgttcgccgccgccctgagcctgatcctgctgctgaagaaggaccacgccaagggctggctgagactgctgaagcaggacgtgagaagcggcgccgccgccagaggcagagccgccctgctgctgtacagcgccgacgacagcggcttcgagagactggtgggcgccctggccagcgccctgtgccagctgcccctgagagtggccgtggacctgtggagcagaagagagctgagcgcccagggccccgtggcctggttccacgcccagagaagacagaccctgcaggagggcggcgtggtggtgctgctgttcagccccggcgccgtggccctgtgcagcgagtggctgcaggacggcgtgagcggccccggcgcccacggcccccacgacgccttcagagccagcctgagctgcgtgctgcccgacttcctgcagggcagagcccccggcagctacgtgggcgcctgcttcgacagactgctgcaccccgacgccgtgcccgccctgttcagaaccgtgcccgtgttcaccctgcccagccagctgcccgacttcctgggcgccctgcagcagcccagagcccccagaagcggcagactgcaggagagagccgagcaggtgagcagagccctgcagcccgccctggacagctacttccacccccccggcacccccgcccccggcagaggcgtgggccccggcgccggccccggcgccggcgacggcacctag

SEQ ID NO: 85591 - DNA, 2220 bp, Artificial Sequence
  Description of Artificial Sequence: Synthetic coding sequence
atggccccctggctgcagctgtgcagcgtgttcttcaccgtgaacgcctgcctgaacggcagccagctggccgtggccgccggcggcagcggcagagccagaggcgccgacacctgcggctggagaggcgtgggccccgccagcagaaacagcggcctgtacaacatcaccttcaagtacgacaactgcaccacctacctgaaccccgtgggcaagcacgtgatcgccgacgcccagaacatcaccatcagccagtacgcctgccacgaccaggtggccgtgaccatcctgtggagccccggcgccctgggcatcgagttcctgaagggcttcagagtgatcctggaggagctgaagagcgagggcagacagtgccagcagctgatcctgaaggaccccaagcagctgaacagcagcttcaagagaaccggcatggagagccagcccttcctgaacatgaagttcgagaccgactacttcgtgaaggtggtgcccttccccagcatcaagaacgagagcaactaccaccccttcttcttcagaaccagagcctgcgacctgctgctgcagcccgacaacctggcctgcaagcccttctggaagcccagaaacctgaacatcagccagcacggcagcgacatgcaggtgagcttcgaccacgccccccacaacttcggcttcagattcttctacctgcactacaagctgaagcacgagggccccttcaagagaaagacctgcaagcaggagcagaccaccgagaccaccagctgcctgctgcagaacgtgagccccggcgactacatcatcgagctggtggacgacaccaacaccaccagaaaggtgatgcactacgccctgaagcccgtgcacagcccctgggccggccccatcagagccgtggccatcaccgtgcccctggtggtgatcagcgccttcgccaccctgttcaccgtgatgtgcagaaagaagcagcaggagaacatctacagccacctggacgaggagagcagcgagagcagcacctacaccgccgccctgcccagagagagactgagacccagacccaaggtgttcctgtgctacagcagcaaggacggccagaaccacatgaacgtggtgcagtgcttcgcctacttcctgcaggacttctgcggctgcgaggtggccctggacctgtgggaggacttcagcctgtgcagagagggccagagagagtgggtgatccagaagatccacgagagccagttcatcatcgtggtgtgcagcaagggcatgaagtacttcgtggacaagaagaactacaagcacaagggcggcggcagaggcagcggcaagggcgagctgttcctggtggccgtgagcgccatcgccgagaagctgagacaggccaagcagagcagcagcgccgccctgagcaagttcatcgccgtgtacttcgactacagctgcgagggcgacgtgcccggcatcctggacctgagcaccaagtacagactgatggacaacctgccccagctgtgcagccacctgcacagcagagaccacggcctgcaggagcccggccagcacaccagacagggcagcagaagaaactacttcagaagcaagagcggcagaagcctgtacgtggccatctgcaacatgcaccagttcatcgacgaggagcccgactggttcgagaagcagttcgtgcccttccaccccccccccctgagatacagagagcccgtgctggagaagttcgacagcggcctggtgctgaacgacgtgatgtgcaagcccggccccgagagcgacttctgcctgaaggtggaggccgccgtgctgggcgccaccggccccgccgacagccagcacgagagccagcacggcggcctggaccaggacggcgaggccagacccgccctggacggcagcgccgccctgcagcccctgctgcacaccgtgaaggccggcagccccagcgacatgcccagagacagcggcatctacgacagcagcgtgcccagcagcgagctgagcctgcccctgatggagggcctgagcaccgaccagaccgagaccagcagcctgaccgagagcgtgagcagcagcagcggcctgggcgaggaggagccccccgccctgcccagcaagctgctgagcagcggcagctgcaaggccgacctgggctgcagaagctacaccgacgagctgcacgccgtggcccccctgtag

SEQ ID NO: 85592 - DNA, 1788 bp, Artificial Sequence
  Description of Artificial Sequence: Synthetic coding sequence
atggagagccagcccttcctgaacatgaagttcgagaccgactacttcgtgaaggtggtgcccttccccagcatcaagaacgagagcaactaccaccccttcttcttcagaaccagagcctgcgacctgctgctgcagcccgacaacctggcctgcaagcccttctggaagcccagaaacctgaacatcagccagcacggcagcgacatgcaggtgagcttcgaccacgccccccacaacttcggcttcagattcttctacctgcactacaagctgaagcacgagggccccttcaagagaaagacctgcaagcaggagcagaccaccgagaccaccagctgcctgctgcagaacgtgagccccggcgactacatcatcgagctggtggacgacaccaacaccaccagaaaggtgatgcactacgccctgaagcccgtgcacagcccctgggccggccccatcagagccgtggccatcaccgtgcccctggtggtgatcagcgccttcgccaccctgttcaccgtgatgtgcagaaagaagcagcaggagaacatctacagccacctggacgaggagagcagcgagagcagcacctacaccgccgccctgcccagagagagactgagacccagacccaaggtgttcctgtgctacagcagcaaggacggccagaaccacatgaacgtggtgcagtgcttcgcctacttcctgcaggacttctgcggctgcgaggtggccctggacctgtgggaggacttcagcctgtgcagagagggccagagagagtgggtgatccagaagatccacgagagccagttcatcatcgtggtgtgcagcaagggcatgaagtacttcgtggacaagaagaactacaagcacaagggcggcggcagaggcagcggcaagggcgagctgttcctggtggccgtgagcgccatcgccgagaagctgagacaggccaagcagagcagcagcgccgccctgagcaagttcatcgccgtgtacttcgactacagctgcgagggcgacgtgcccggcatcctggacctgagcaccaagtacagactgatggacaacctgccccagctgtgcagccacctgcacagcagagaccacggcctgcaggagcccggccagcacaccagacagggcagcagaagaaactacttcagaagcaagagcggcagaagcctgtacgtggccatctgcaacatgcaccagttcatcgacgaggagcccgactggttcgagaagcagttcgtgcccttccaccccccccccctgagatacagagagcccgtgctggagaagttcgacagcggcctggtgctgaacgacgtgatgtgcaagcccggccccgagagcgacttctgcctgaaggtggaggccgccgtgctgggcgccaccggccccgccgacagccagcacgagagccagcacggcggcctggaccaggacggcgaggccagacccgccctggacggcagcgccgccctgcagcccctgctgcacaccgtgaaggccggcagccccagcgacatgcccagagacagcggcatctacgacagcagcgtgcccagcagcgagctgagcctgcccctgatggagggcctgagcaccgaccagaccgagaccagcagcctgaccgagagcgtgagcagcagcagcggcctgggcgaggaggagccccccgccctgcccagcaagctgctgagcagcggcagctgcaaggccgacctgggctgcagaagctacaccgacgagctgcacgccgtggcccccctgtag

SEQ ID NO: 85593 - DNA, 2148 bp, Artificial Sequence
  Description of Artificial Sequence: Synthetic coding sequence
atgcccagagccagcgccagcggcgtgcccgccctgttcgtgagcggcgagcagggcgtgggccccgccagcagaaacagcggcctgtacaacatcaccttcaagtacgacaactgcaccacctacctgaaccccgtgggcaagcacgtgatcgccgacgcccagaacatcaccatcagccagtacgcctgccacgaccaggtggccgtgaccatcctgtggagccccggcgccctgggcatcgagttcctgaagggcttcagagtgatcctggaggagctgaagagcgagggcagacagtgccagcagctgatcctgaaggaccccaagcagctgaacagcagcttcaagagaaccggcatggagagccagcccttcctgaacatgaagttcgagaccgactacttcgtgaaggtggtgcccttccccagcatcaagaacgagagcaactaccaccccttcttcttcagaaccagagcctgcgacctgctgctgcagcccgacaacctggcctgcaagcccttctggaagcccagaaacctgaacatcagccagcacggcagcgacatgcaggtgagcttcgaccacgccccccacaacttcggcttcagattcttctacctgcactacaagctgaagcacgagggccccttcaagagaaagacctgcaagcaggagcagaccaccgagaccaccagctgcctgctgcagaacgtgagccccggcgactacatcatcgagctggtggacgacaccaacaccaccagaaaggtgatgcactacgccctgaagcccgtgcacagcccctgggccggccccatcagagccgtggccatcaccgtgcccctggtggtgatcagcgccttcgccaccctgttcaccgtgatgtgcagaaagaagcagcaggagaacatctacagccacctggacgaggagagcagcgagagcagcacctacaccgccgccctgcccagagagagactgagacccagacccaaggtgttcctgtgctacagcagcaaggacggccagaaccacatgaacgtggtgcagtgcttcgcctacttcctgcaggacttctgcggctgcgaggtggccctggacctgtgggaggacttcagcctgtgcagagagggccagagagagtgggtgatccagaagatccacgagagccagttcatcatcgtggtgtgcagcaagggcatgaagtacttcgtggacaagaagaactacaagcacaagggcggcggcagaggcagcggcaagggcgagctgttcctggtggccgtgagcgccatcgccgagaagctgagacaggccaagcagagcagcagcgccgccctgagcaagttcatcgccgtgtacttcgactacagctgcgagggcgacgtgcccggcatcctggacctgagcaccaagtacagactgatggacaacctgccccagctgtgcagccacctgcacagcagagaccacggcctgcaggagcccggccagcacaccagacagggcagcagaagaaactacttcagaagcaagagcggcagaagcctgtacgtggccatctgcaacatgcaccagttcatcgacgaggagcccgactggttcgagaagcagttcgtgcccttccaccccccccccctgagatacagagagcccgtgctggagaagttcgacagcggcctggtgctgaacgacgtgatgtgcaagcccggccccgagagcgacttctgcctgaaggtggaggccgccgtgctgggcgccaccggccccgccgacagccagcacgagagccagcacggcggcctggaccaggacggcgaggccagacccgccctggacggcagcgccgccctgcagcccctgctgcacaccgtgaaggccggcagccccagcgacatgcccagagacagcggcatctacgacagcagcgtgcccagcagcgagctgagcctgcccctgatggagggcctgagcaccgaccagaccgagaccagcagcctgaccgagagcgtgagcagcagcagcggcctgggcgaggaggagccccccgccctgcccagcaagctgctgagcagcggcagctgcaaggccgacctgggctgcagaagctacaccgacgagctgcacgccgtggcccccctgtag

SEQ ID NO: 85594 - DNA, 1788 bp, Artificial Sequence; identical to SEQ ID NO: 85592
  Description of Artificial Sequence: Synthetic coding sequence

SEQ ID NO: 85595 - DNA, 222 bp, Artificial Sequence
  Description of Artificial Sequence: Synthetic coding sequence
atggagagccagcccttcctgaacatgaagttcgagaccgactacttcgtgaaggtggtgcccttccccagcatcaagaacgagagcaactaccaccccttcttcttcagaaccagagcctgcgacctgctgctgcagcccgacaacctggcctgcaagcccttctggaagcccagaaacctgaacatcagccagcacggcagcgacatgcaggtgagctag

SEQ ID NO: 85596 - DNA, 1671 bp, Artificial Sequence
  Description of Artificial Sequence: Synthetic coding sequence
atgggcttctggatcctggccatcctgaccatcctgatgtacagcaccgccgccaagttcagcaagcagagctggggcctggagaacgaggccctgatcgtgagatgccccagacagggcaagcccagctacaccgtggactggtactacagccagaccaacaagagcatccccacccaggagagaaacagagtgttcgccagcggccagctgctgaagttcctgcccgccgccgtggccgacagcggcatctacacctgcatcgtgagaagccccaccttcaacagaaccggctacgccaacgtgaccatctacaagaagcagagcgactgcaacgtgcccgactacctgatgtacagcaccgtgagcggcagcgagaagaacagcaagatctactgccccaccatcgacctgtacaactggaccgcccccctggagtggttcaagaactgccaggccctgcagggcagcagatacagagcccacaagagcttcctggtgatcgacaacgtgatgaccgaggacgccggcgactacacctgcaagttcatccacaacgagaacggcgccaactacagcgtgaccgccaccagaagcttcaccgtgaaggacgagcagggcttcagcctgttccccgtgatcggcgcccccgcccagaacgagatcaaggaggtggagatcggcaagaacgccaacctgacctgcagcgcctgcttcggcaagggcacccagttcctggccgccgtgctgtggcagctgaacggcaccaagatcaccgacttcggcgagcccagaatccagcaggaggagggccagaaccagagcttcagcaacggcctggcctgcctggacatggtgctgagaatcgccgacgtgaaggaggaggacctgctgctgcagtacgactgcctggccctgaacctgcacggcctgagaagacacaccgtgagactgagcagaaagaaccccatcgaccaccacagcatctactgcatcatcgccgtgtgcagcgtgttcctgatgctgatcaacgtgctggtgatcatcctgaagatgttctggatcgaggccaccctgctgtggagagacatcgccaagccctacaagaccagaaacgacggcaagctgtacgacgcctacgtggtgtaccccagaaactacaagagcagcaccgacggcgccagcagagtggagcacttcgtgcaccagatcctgcccgacgtgctggagaacaagtgcggctacaccctgtgcatctacggcagagacatgctgcccggcgaggacgtggtgaccgccgtggagaccaacatcagaaagagcagaagacacatcttcatcctgaccccccagatcacccacaacaaggagttcgcctacgagcaggaggtggccctgcactgcgccctgatccagaacgacgccaaggtgatcctgatcgagatggaggccctgagcgagctggacatgctgcaggccgaggccctgcaggacagcctgcagcacctgatgaaggtgcagggcaccatcaagtggagagaggaccacatcgccaacaagagaagcctgaacagcaagttctggaagcacgtgagataccagatgcccgtgcccagcaagatccccagaaaggccagcagcctgacccccctggccgcccagaagcagtag

SEQ ID NO: 85597 - DNA, 513 bp, Artificial Sequence
  Description of Artificial Sequence: Synthetic coding sequence
atgaactgcagagagctgcccctgaccctgtgggtgctgatcagcgtgagcaccgccgagagctgcaccagcagaccccacatcaccgtggtggagggcgagcccttctacctgaagcactgcagctgcagcctggcccacgagatcgagaccaccaccaagagctggtacaagagcagcggcagccaggagcacgtggagctgaaccccagaagcagcagcagaatcgccctgcacgactgcgtgctggagttctggcccgtggagctgaacgacaccggcagctacttcttccagatgaagaactacacccagaagtggaagctgaacgtgatcagaagaaacaagcacagctgcttcaccgagagacaggtgaccagcaagatcgtggaggtgaagaagttcttccagatcacctgcgagaacagctactaccagaccctggtgaacagcaccagcctgtacaagatcggcccccccatctgcagaaagaccagcagcggcctgcactag

SEQ ID NO: 85598 - DNA, 1626 bp, Artificial Sequence
  Description of Artificial Sequence: Synthetic coding sequence
atgaactgcagagagctgcccctgaccctgtgggtgctgatcagcgtgagcaccgccgagagctgcaccagcagaccccacatcaccgtggtggagggcgagcccttctacctgaagcactgcagctgcagcctggcccacgagatcgagaccaccaccaagagctggtacaagagcagcggcagccaggagcacgtggagctgaaccccagaagcagcagcagaatcgccctgcacgactgcgtgctggagttctggcccgtggagctgaacgacaccggcagctacttcttccagatgaagaactacacccagaagtggaagctgaacgtgatcagaagaaacaagcacagctgcttcaccgagagacaggtgaccagcaagatcgtggaggtgaagaagttcttccagatcacctgcgagaacagctactaccagaccctggtgaacagcaccagcctgtacaagaactgcaagaagctgctgctggagaacaacaagaaccccaccatcaagaagaacgccgagttcgaggaccagggctactacagctgcgtgcacttcctgcaccacaacggcaagctgttcaacatcaccaagaccttcaacatcaccatcgtggaggacagaagcaacatcgtgcccgtgctgctgggccccaagctgaaccacgtggccgtggagctgggcaagaacgtgagactgaactgcagcgccctgctgaacgaggaggacgtgatctactggatgttcggcgaggagaacggcagcgaccccaacatccacgaggagaaggagatgagaatcatgacccccgagggcaagtggcacgccagcaaggtgctgagaatcgagaacatcggcgagagcaacctgaacgtgctgtacaactgcaccgtggccagcaccggcggcaccgacaccaagagcttcatcctggtgagaaaggccgacatggccgacatccccggccacgtgttcaccagaggcatgatcatcgccgtgctgatcctggtggccgtggtgtgcctggtgaccgtgtgcgtgatctacagagtggacctggtgctgttctacagacacctgaccagaagagacgagaccctgaccgacggcaagacctacgacgccttcgtgagctacctgaaggagtgcagacccgagaacggcgaggagcacaccttcgccgtggagatcctgcccagagtgctggagaagcacttcggctacaagctgtgcatcttcgagagagacgtggtgcccggcggcgccgtggtggacgagatccacagcctgatcgagaagagcagaagactgatcatcgtgctgagcaagagctacatgagcaacgaggtgagatacgagctggagagcggcctgcacgaggccctggtggagagaaagatcaagatcatcctgatcgagttcacccccgtgaccgacttcaccttcctgccccagagcctgaagctgctgaagagccacagagtgctgaagtggaaggccgacaagagcctgagctacaacagcagattctggaagaacctgctgtacctgatgcccgccaagaccgtgaagcccggcagagacgagcccgaggtgctgcccgtgctgagcgagagctag

SEQ ID NO: 85599 - DNA, 1626 bp, Artificial Sequence; identical to SEQ ID NO: 85598
  Description of Artificial Sequence: Synthetic coding sequence

SEQ ID NO: 85600 - DNA, 1800 bp, Artificial Sequence
  Description of Artificial Sequence: Synthetic coding sequence
atgctgtgcctgggctggatcttcctgtggctggtggccggcgagagaatcaagggcttcaacatcagcggctgcagcaccaagaagctgctgtggacctacagcaccagaagcgaggaggagttcgtgctgttctgcgacctgcccgagccccagaagagccacttctgccacagaaacagactgagccccaagcaggtgcccgagcacctgcccttcatgggcagcaacgacctgagcgacgtgcagtggtaccagcagcccagcaacggcgaccccctggaggacatcagaaagagctacccccacatcatccaggacaagtgcaccctgcacttcctgacccccggcgtgaacaacagcggcagctacatctgcagacccaagatgatcaagagcccctacgacgtggcctgctgcgtgaagatgatcctggaggtgaagccccagaccaacgccagctgcgagtacagcgccagccacaagcaggacctgctgctgggcagcaccggcagcatcagctgccccagcctgagctgccagagcgacgcccagagccccgccgtgacctggtacaagaacggcaagctgctgagcgtggagagaagcaacagaatcgtggtggacgaggtgtacgactaccaccagggcacctacgtgtgcgactacacccagagcgacaccgtgagcagctggaccgtgagagccgtggtgcaggtgagaaccatcgtgggcgacaccaagctgaagcccgacatcctggaccccgtggaggacaccctggaggtggagctgggcaagcccctgaccatcagctgcaaggccagattcggcttcgagagagtgttcaaccccgtgatcaagtggtacatcaaggacagcgacctggagtgggaggtgagcgtgcccgaggccaagagcatcaagagcaccctgaaggacgagatcatcgagagaaacatcatcctggagaaggtgacccagagagacctgagaagaaagttcgtgtgcttcgtgcagaacagcatcggcaacaccacccagagcgtgcagctgaaggagaagagaggcgtggtgctgctgtacatcctgctgggcaccatcggcaccctggtggccgtgctggccgccagcgccctgctgtacagacactggatcgagatcgtgctgctgtacagaacctaccagagcaaggaccagaccctgggcgacaagaaggacttcgacgccttcgtgagctacgccaagtggagcagcttccccagcgaggccaccagcagcctgagcgaggagcacctggccctgagcctgttccccgacgtgctggagaacaagtacggctacagcctgtgcctgctggagagagacgtggcccccggcggcgtgtacgccgaggacatcgtgagcatcatcaagagaagcagaagaggcatcttcatcctgagccccaactacgtgaacggccccagcatcttcgagctgcaggccgccgtgaacctggccctggacgaccagaccctgaagctgatcctgatcaagttctgctacttccaggagcccgagagcctgccccacctggtgaagaaggccctgagagtgctgcccaccgtgacctggagaggcctgaagagcgtgccccccaacagcagattctgggccaagatgagataccacatgcccgtgaagaacagccagggcttcacctggaaccagctgagaatcaccagcagaatcttccagtggaagggcctgagcagaaccgagaccaccggcagaagcagccagcccaaggagtggtag

SEQ ID NO: 85601 - DNA, 1374 bp, Artificial Sequence
  Description of Artificial Sequence: Synthetic coding sequence
atgatcctggaggtgaagccccagaccaacgccagctgcgagtacagcgccagccacaagcaggacctgctgctgggcagcaccggcagcatcagctgccccagcctgagctgccagagcgacgcccagagccccgccgtgacctggtacaagaacggcaagctgctgagcgtggagagaagcaacagaatcgtggtggacgaggtgtacgactaccaccagggcacctacgtgtgcgactacacccagagcgacaccgtgagcagctggaccgtgagagccgtggtgcaggtgagaaccatcgtgggcgacaccaagctgaagcccgacatcctggaccccgtggaggacaccctggaggtggagctgggcaagcccctgaccatcagctgcaaggccagattcggcttcgagagagtgttcaaccccgtgatcaagtggtacatcaaggacagcgacctggagtgggaggtgagcgtgcccgaggccaagagcatcaagagcaccctgaaggacgagatcatcgagagaaacatcatcctggagaaggtgacccagagagacctgagaagaaagttcgtgtgcttcgtgcagaacagcatcggcaacaccacccagagcgtgcagctgaaggagaagagaggcgtggtgctgctgtacatcctgctgggcaccatcggcaccctggtggccgtgctggccgccagcgccctgctgtacagacactggatcgagatcgtgctgctgtacagaacctaccagagcaaggaccagaccctgggcgacaagaaggacttcgacgccttcgtgagctacgccaagtggagcagcttccccagcgaggccaccagcagcctgagcgaggagcacctggccctgagcctgttccccgacgtgctggagaacaagtacggctacagcctgtgcctgctggagagagacgtggcccccggcggcgtgtacgccgaggacatcgtgagcatcatcaagagaagcagaagaggcatcttcatcctgagccccaactacgtgaacggccccagcatcttcgagctgcaggccgccgtgaacctggccctggacgaccagaccctgaagctgatcctgatcaagttctgctacttccaggagcccgagagcctgccccacctggtgaagaaggccctgagagtgctgcccaccgtgacctggagaggcctgaagagcgtgccccccaacagcagattctgggccaagatgagataccacatgcccgtgaagaacagccagggcttcacctggaaccagctgagaatcaccagcagaatcttccagtggaagggcctgagcagaaccgagaccaccggcagaagcagccagcccaaggagtggtag

SEQ ID NO: 85602 - DNA, 135 bp, Artificial Sequence
  Description of Artificial Sequence: Synthetic coding sequence
atgctgtgcctgggctggatcttcctgtggctggtggccggcgagagaatcaagggcttcaacatcagcggctgcagcaccaagaagctgctgtggacctacagcaccagaagcgaggaggagttcgtgctgtag

SEQ ID NO: 85603 - DNA, 534 bp, Artificial Sequence
  Description of Artificial Sequence: Synthetic coding sequence
atgaagctgcagtgcgtgagcctgtggctgctgggcaccatcctgatcctgtgcagcgtggacaaccacggcctgagaagatgcctgatcagcaccgacatgcaccacatcgaggagagcttccaggagatcaagagagccatccaggccaaggacaccttccccaacgtgaccatcctgagcaccctggagaccctgcagatcatcaagcccctggacgtgtgctgcgtgaccaagaacctgctggccttctacgtggacagagtgttcaaggaccaccaggagcccaaccccaagatcctgagaaagatcagcagcatcgccaacagcttcctgtacatgcagaagaccctgagacagtgccaggagcagagacagtgccactgcagacaggaggccaccaacgccaccagagtgatccacgacaactacgaccagctggaggtgcacgccgccgccatcaagagcctgggcgagctggacgtgttcctggcctggatcaacaagaaccacgaggtgatgttcagcgcctag

SEQ ID NO: 85604 - DNA, 648 bp, Artificial Sequence
  Description of Artificial Sequence: Synthetic coding sequence
atgtgcaccgagggcgccttcccccacagaagcgcctgcagcctgcccctgacccacgtgcacacccacatccacgtgtgcgtgcccgtgctgtggggcagcgtgcccagaggcatgaagctgcagtgcgtgagcctgtggctgctgggcaccatcctgatcctgtgcagcgtggacaaccacggcctgagaagatgcctgatcagcaccgacatgcaccacatcgaggagagcttccaggagatcaagagagccatccaggccaaggacaccttccccaacgtgaccatcctgagcaccctggagaccctgcagatcatcaagcccctggacgtgtgctgcgtgaccaagaacctgctggccttctacgtggacagagtgttcaaggaccaccaggagcccaaccccaagatcctgagaaagatcagcagcatcgccaacagcttcctgtacatgcagaagaccctgagacagtgccaggagcagagacagtgccactgcagacaggaggccaccaacgccaccagagtgatccacgacaactacgaccagctggaggtgcacgccgccgccatcaagagcctgggcgagctggacgtgttcctggcctggatcaacaagaaccacgaggtgatgttcagcgcctag

SEQ ID NO: 85605 - DNA, 792 bp, Artificial Sequence
  Description of Artificial Sequence: Synthetic coding sequence
atggacagctacctgctgatgtggggcctgctgaccttcatcatggtgcccggctgccaggccgagctgtgcgacgacgacccccccgagatcccccacgccaccttcaaggccatggcctacaaggagggcaccatgctgaactgcgagtgcaagagaggcttcagaagaatcaagagcggcagcctgtacatgctgtgcaccggcaacagcagccacagcagctgggacaaccagtgccagtgcaccagcagcgccaccagaaacaccaccaagcaggtgaccccccagcccgaggagcagaaggagagaaagaccaccgagatgcagagccccatgcagcccgtggaccaggccagcctgcccggccactgcagagagccccccccctgggagaacgaggccaccgagagaatctaccacttcgtggtgggccagatggtgtactaccagtgcgtgcagggctacagagccctgcacagaggccccgccgagagcgtgtgcaagatgacccacggcaagaccagatggacccagccccagctgatctgcaccggcgaggagaagccccaggccagccccgagggcagacccgagagcgagaccagctgcctggtgaccaccaccgacttccagatccagaccgagatggccgccaccatggagaccagcatcttcaccaccgagtaccaggtggccgtggccggctgcgtgttcctgctgatcagcgtgctgctgctgagcggcctgacctggcagagaagacagagaaagagcagaagaaccatctag

SEQ ID NO: 85606 - DNA, 603 bp, Artificial Sequence
  Description of Artificial Sequence: Synthetic coding sequence
atggacagctacctgctgatgtggggcctgctgaccttcatcatggtgcccggctgccaggccgagctgtgcgacgacgacccccccgagatcccccacgccaccttcaaggccatggcctacaaggagggcaccatgctgaactgcgagtgcaagagaggcttcagaagaatcaagagcggcagcctgtacatgctgtgcaccggcaacagcagccacagcagctgggacaaccagtgccagtgcaccagcagcgccaccagaaacaccaccaagcaggtgaccccccagcccgaggagcagaaggagagaaagaccaccgagatgcagagccccatgcagcccgtggaccaggccagcctgcccggcgaggagaagccccaggccagccccgagggcagacccgagagcgagaccagctgcctggtgaccaccaccgacttccagatccagaccgagatggccgccaccatggagaccagcatcttcaccaccgagtaccaggtggccgtggccggctgcgtgttcctgctgatcagcgtgctgctgctgagcggcctgacctggcagagaagacagagaaagagcagaagaaccatctag

SEQ ID NO: 85607 - DNA, 819 bp, Artificial Sequence
  Description of Artificial Sequence: Synthetic coding sequence
atggacagctacctgctgatgtggggcctgctgaccttcatcatggtgcccggctgccaggccgagctgtgcgacgacgacccccccgagatcccccacgccaccttcaaggccatggcctacaaggagggcaccatgctgaactgcgagtgcaagagaggcttcagaagaatcaagagcggcagcctgtacatgctgtgcaccggcaacagcagccacagcagctgggacaaccagtgccagtgcaccagcagcgccaccagaaacaccaccaagcaggtgaccccccagcccgaggagcagaaggagagaaagaccaccgagatgcagagccccatgcagcccgtggaccaggccagcctgcccggccactgcagagagccccccccctgggagaacgaggccaccgagagaatctaccacttcgtggtgggccagatggtgtactaccagtgcgtgcagggctacagagccctgcacagaggccccgccgagagcgtgtgcaagatgacccacggcaagaccagatggacccagccccagctgatctgcaccggcgagatggagaccagccagttccccggcgaggagaagccccaggccagccccgagggcagacccgagagcgagaccagctgcctggtgaccaccaccgacttccagatccagaccgagatggccgccaccatggagaccagcatcttcaccaccgagtaccaggtggccgtggccggctgcgtgttcctgctgatcagcgtgctgctgctgagcggcctgacctggcagagaagacagagaaagagcagaagaaccatctag

SEQ ID NO: 85608 - DNA, 489 bp, Artificial Sequence
  Description of Artificial Sequence: Synthetic coding sequence
atggtgcccggctgccaggccgagctgtgcgacgacgacccccccgagatcccccacgccaccttcaaggccatggcctacaaggagggcaccatgctgaactgcgagtgcaagagaggcttcagaagaatcaagagcggcagcctgtacatgctgtgcaccggcaacagcagccacagcagctgggacaaccagtgccagtgcaccagcagcgccaccagaaacaccaccaagcaggtgaccccccagcccgaggagcagaaggagagaaagaccaccgagatgcagagccccatgcagcccgtggaccaggccagcctgcccgacttccagatccagaccgagatggccgccaccatggagaccagcatcttcaccaccgagtaccaggtggccgtggccggctgcgtgttcctgctgatcagcgtgctgctgctgagcggcctgacctggcagagaagacagagaaagagcagaagaaccatctag

SEQ ID NO: 85609 - DNA, 330 bp, Artificial Sequence
  Description of Artificial Sequence: Synthetic coding sequence
tgaatcccccacgccaccttcaaggccatggcctacaaggagggcaccatgctgaactgcgagtgcaagagaggcttcagaagaatcaagagcggcagcctgtacatgctgtgcaccggcaacagcagccacagcagctgggacaaccagtgccagtgcaccagcagcgccaccagaaacaccaccaagcaggtgaccccccagcccgaggagcagaaggagagaaagaccaccgagatgcagagccccatgcagcccgtggaccaggccagcctgcccgacttccagatccagaccgagatggccgccaccatggagaccagcatctag

SEQ ID NO: 85610 - DNA, 1110 bp, Artificial Sequence
  Description of Artificial Sequence: Synthetic coding sequence
atggaccccagaaaggtgaacgagctgagagccttcgtgaagatgtgcaagcaggaccccagcgtgctgcacaccgaggagatgagattcctgagagagtgggtggagagcatgggcggcaaggtgccccccgccacccagaaggccaagagcgaggagaacaccaaggaggagaagcccgacagcaagaaggtggaggaggacctgaaggccgacgagcccagcagcgaggagagcgacctggagatcgacaaggagggcgtgatcgagcccgacaccgacgccccccaggagatgggcgacgagaacgccgagatcaccgaggagatgatggaccaggccaacgacaagaaggtggccgccatcgaggccctgaacgacggcgagctgcagaaggccatcgacctgttcaccgacgccatcaagctgaaccccagactggccatcctgtacgccaagagagccagcgtgttcgtgaagctgcagaagcccaacgccgccatcagagactgcgacagagccatcgagatcaaccccgacagcgcccagccctacaagtggagaggcaaggcccacagactgctgggccactgggaggaggccgcccacgacctggccctggcctgcaagctggactacgacgaggacgccagcgccatgctgaaggaggtgcagcccagagcccagaagatcgccgagcacagaagaaagtacgagagaaagagagaggagagagagatcaaggagagaatcgagagagtgaagaaggccagagaggagcacgagagagcccagagagaggaggaggccagaagacagagcggcgcccagtacggcagcttccccggcggcttccccggcggcatgcccggcaacttccccggcggcatgcccggcatgggcggcggcatgcccggcatggccggcatgcccggcctgaacgagatcctgagcgaccccgaggtgctggccgccatgcaggaccccgaggtgatggtggccttccaggacgtggcccagaaccccgccaacatgagcaagtaccagagcaaccccaaggtgatgaacctgatcagcaagctgagcgccaagttcggcggccaggcctag

SEQ ID NO: 85611 - DNA, 441 bp, Artificial Sequence
  Description of Artificial Sequence: Synthetic coding sequence
atggccgcccccgccctgagctggagactgcccctgctgatcctgctgctgcccctggccaccagctgggccagcgccgccgtgaacggcaccagccagttcacctgcttctacaacagcagagccaacatcagctgcgtgtggagccaggacggcgccctgcaggacaccagctgccaggtgcacgcctggcccgacagaagaagatggaaccagacctgcgagctgctgcccgtgagccaggccagctgggcctgcaacctgatcctgggcgcccccgacagccagaagctgaccaccgtggacatcgtgaccctgagagtgctgtgcagagagggcgtgagatggagagtgatggccatccaggacttcaagcccttcgagaacctgagactgatggcccccatcagcctgcaggtggtgcacgtggagacccactag

SEQ ID NO: 85612 - DNA, 267 bp, Artificial Sequence
  Description of Artificial Sequence: Synthetic coding sequence
atggccgcccccgccctgagctggagactgcccctgctgatcctgctgctgcccctggccaccagctgggccagcgccgccgtgaacggcaccagccagttcacctgcttctacaacagcagagccaacatcagctgcgtgtggagccaggacggcgccctgcaggacaccagctgccaggtgcacgcctggcccgacagaagaagatggaaccagacctgcgagctgctgcccgtgagccaggccagctgggcctgcaacctgtag

SEQ ID NO: 85613 - DNA, 567 bp, Artificial Sequence
  Description of Artificial Sequence: Synthetic coding sequence
atggccgcccccgccctgagctggagactgcccctgctgatcctgctgctgcccctggccaccagctgggccagcgccgccgtgaacggcaccagccagttcacctgcttctacaacagcagagccaacatcagctgcgtgtggagccaggacggcgccctgcaggacaccagctgccaggtgcacgcctggcccgacagaagaagatggaaccagacctgcgagctgctgcccgtgagccaggccagctgggcctgcaacctgatcctgggcgcccccgacagccagaagctgaccaccgtggacatcgtgaccctgagagtgctgtgcagagagggcgtgagatggagagtgatggccatccaggacttcaagcccttcgagaacctgagactgatggcccccatcagcctgcaggtggtgcacgtggagacccacagatgcaacatcagctgggagatcagccaggccagccactacttcgagagacacctggagttcgaggccagaaccctgagccccggccacacctgggaggaggcccccctgctgaccctgaagcagtag

SEQ ID NO: 85614 - DNA, 297 bp, Artificial Sequence
  Description of Artificial Sequence: Synthetic coding sequence
atggagccccccaaccccctgggcgagcagtacttcaagagaaccatgcccagaatccccaccctgaagaacctggaggacctggtgaccgagtaccacggcaacttcagcgcctggagcggcgtgagcaagggcctggccgagagcctgcagcccgactacagcgagagactgtgcctggtgagcgagatcccccccaagggcggcgccctgggcgagggccccggcgccagcccctgcaaccagcacagcccctactgggcccccccctgctacaccctgaagcccgagacctag

SEQ ID NO: 85615 - DNA, 474 bp, Artificial Sequence
  Description of Artificial Sequence: Synthetic coding sequence
atgctgaagcccagcctgcccttcaccagcctgctgttcctgcagctgcccctgctgggcgtgggcctgaacaccaccatcctgacccccaacggcaacgaggacaccaccgccgacttcttcctgaccaccatgcccaccgacagcctgagcgtgagcaccctgcccctgcccgaggtgcagtgcttcgtgttcaacgtggagtacatgaactgcacctggaacagcagcagcgagccccagcccaccaacctgaccctgcactactggtacaagaacagcgacaacgacaaggtgcagaagtgcagccactacctgttcagcgaggagatcaccagcggctgccagctgcagaagaaggagatccacctgtaccagaccttcgtggtgcagctgcaggaccccagagagcccagaagacaggccacccagatgctgaagctgcagaacctgggcaccatcagcggcctgtag

SEQ ID NO: 85616 - DNA, 1110 bp, Artificial Sequence
  Description of Artificial Sequence: Synthetic coding sequence
atgctgaagcccagcctgcccttcaccagcctgctgttcctgcagctgcccctgctgggcgtgggcctgaacaccaccatcctgacccccaacggcaacgaggacaccaccgccgacttcttcctgaccaccatgcccaccgacagcctgagcgtgagcaccctgcccctgcccgaggtgcagtgcttcgtgttcaacgtggagtacatgaactgcacctggaacagcagcagcgagccccagcccaccaacctgaccctgcactactggtacaagaacagcgacaacgacaaggtgcagaagtgcagccactacctgttcagcgaggagatcaccagcggctgccagctgcagaagaaggagatccacctgtaccagaccttcgtggtgcagctgcaggaccccagagagcccagaagacaggccacccagatgctgaagctgcagaacctggtgatcccctgggcccccgagaacctgaccctgcacaagctgagcgagagccagctggagctgaactggaacaacagattcctgaaccactgcctggagcacctggtgcagtacagaaccgactgggaccacagctggaccgagcagagcgtggactacagacacaagttcagcctgcccagcgtggacggccagaagagatacaccttcagagtgagaagcagattcaaccccctgtgcggcagcgcccagcactggagcgagtggagccaccccatccactggggcagcaacaccagcaaggagaaccccttcctgttcgccctggaggccgtggtgatcagcgtgggcagcatgggcctgatcatcagcctgctgtgcgtgtacttctggctggagagaaccatgcccagaatccccaccctgaagaacctggaggacctggtgaccgagtaccacggcaacttcagcgcctggagcggcgtgagcaagggcctggccgagagcctgcagcccgactacagcgagagactgtgcctggtgagcgagatcccccccaagggcggcgccctgggcgagggccccggcgccagcccctgcaaccagcacagcccctactgggcccccccctgctacaccctgaagcccgagacctag

SEQ ID NO: 85617 - DNA, 540 bp, Artificial Sequence
  Description of Artificial Sequence: Synthetic coding sequence
atgggcatgaagaccccccagctggagcagagcgtggactacagacacaagttcagcctgcccagcgtggacggccagaagagatacaccttcagagtgagaagcagattcaaccccctgtgcggcagcgcccagcactggagcgagtggagccaccccatccactggggcagcaacaccagcaaggagaaccccttcctgttcgccctggaggccgtggtgatcagcgtgggcagcatgggcctgatcatcagcctgctgtgcgtgtacttctggctggagagaaccatgcccagaatccccaccctgaagaacctggaggacctggtgaccgagtaccacggcaacttcagcgcctggagcggcgtgagcaagggcctggccgagagcctgcagcccgactacagcgagagactgtgcctggtgagcgagatcccccccaagggcggcgccctgggcgagggccccggcgccagcccctgcaaccagcacagcccctactgggcccccccctgctacaccctgaagcccgagacctag

SEQ ID NO: 85618 - DNA, 1662 bp, Artificial Sequence
  Description of Artificial Sequence: Synthetic coding sequence
atgagagcccccggcagacccgccctgagacccctgcccctgccccccctgctgctgctgctgctggccgccccctggggcagagccgtgccctgcgtgagcggcggcctgcccaagcccgccaacatcaccttcctgagcatcaacatgaagaacgtgctgcagtggaccccccccgagggcctgcagggcgtgaaggtgacctacaccgtgcagtacttcatctacggccagaagaagtggctgaacaagagcgagtgcagaaacatcaacagaacctactgcgacctgagcgccgagaccagcgactacgagcaccagtactacgccaaggtgaaggccatctggggcaccaagtgcagcaagtgggccgagagcggcagattctaccccttcctggagacccagatcggcccccccgaggtggccctgaccaccgacgagaagagcatcagcgtggtgctgaccgcccccgagaagtggaagagaaaccccgaggacctgcccgtgagcatgcagcagatctacagcaacctgaagtacaacgtgagcgtgctgaacaccaagagcaacagaacctggagccagtgcgtgaccaaccacaccctggtgctgacctggctggagcccaacaccctgtactgcgtgcacgtggagagcttcgtgcccggcccccccagaagagcccagcccagcgagaagcagtgcgccagaaccctgaaggaccagagcagcgagttcaaggccaagatcatcttctggtacgtgctgcccgtgagcatcaccgtgttcctgttcagcgtgatgggctacagcatctacagatacatccacgtgggcaaggagaagcaccccgccaacctgatcctgatctacggcaacgagttcgacaagagattcttcgtgcccgccgagaagatcgtgatcaacttcatcaccctgaacatcagcgacgacagcaagatcagccaccaggacatgagcctgctgggcaagagcagcgacgtgagcagcctgaacgacccccagcccagcggcaacctgagacccccccaggaggaggaggaggtgaagcacctgggctacgccagccacctgatggagatcttctgcgacagcgaggagaacaccgagggcaccagcctgacccagcaggagagcctgagcagaaccatcccccccgacaagaccgtgatcgagtacgagtacgacgtgagaaccaccgacatctgcgccggccccgaggagcaggagctgagcctgcaggaggaggtgagcacccagggcaccctgctggagagccaggccgccctggccgtgctgggcccccagaccctgcagtacagctacaccccccagctgcaggacctggaccccctggcccaggagcacaccgacagcgaggagggccccgaggaggagcccagcaccaccctggtggactgggacccccagaccggcagactgtgcatccccagcctgagcagcttcgaccaggacagcgagggctgcgagcccagcgagggcgacggcctgggcgaggagggcctgctgagcagactgtacgaggagcccgcccccgacagaccccccggcgagaacgagacctacctgatgcagttcatggaggagtggggcctgtacgtgcagatggagaactag

SEQ ID NO: 85619 - DNA, 630 bp, Artificial Sequence
  Description of Artificial Sequence: Synthetic coding sequence
atgagagcccccggcagacccgccctgagacccctgcccctgccccccctgctgctgctgctgctggccgccccctggggcagagccgtgccctgcgtgagcggcggcctgcccaagcccgccaacatcaccttcctgagcatcaacatgaagaacgtgctgcagtggaccccccccgagggcctgcagggcgtgaaggtgacctacaccgtgcagtacttcatctacggccagaagaagtggctgaacaagagcgagtgcagaaacatcaacagaacctactgcgacctgagcgccgagaccagcgactacgagcaccagtactacgccaaggtgaaggccatctggggcaccaagtgcagcaagtgggccgagagcggcagattctaccccttcctggagacccagatcggcccccccgaggtggccctgaccaccgacgagaagagcatcagcgtggtgctgaccgcccccgagaagtggaagagaaaccccgaggacctgcccgtgagcatgcagcagatctacagcaacctgaagtacaacgtgagcgtgctgaacaccaagagcaacagaaccgtgagcctgaagtggaacggcgcctacatccacgtgcccctgtgcagctag

SEQ ID NO: 85620 - DNA, 1329 bp, Artificial Sequence
  Description of Artificial Sequence: Synthetic coding sequence
atgagctacaacggcctgcaccagagagtgttcaaggagctgaagctgctgaccctgtgcagcatcagcagccagatcggcccccccgaggtggccctgaccaccgacgagaagagcatcagcgtggtgctgaccgcccccgagaagtggaagagaaaccccgaggacctgcccgtgagcatgcagcagatctacagcaacctgaagtacaacgtgagcgtgctgaacaccaagagcaacagaacctggagccagtgcgtgaccaaccacaccctggtgctgacctggctggagcccaacaccctgtactgcgtgcacgtggagagcttcgtgcccggcccccccagaagagcccagcccagcgagaagcagtgcgccagaaccctgaaggaccagagcagcgagttcaaggccaagatcatcttctggtacgtgctgcccgtgagcatcaccgtgttcctgttcagcgtgatgggctacagcatctacagatacatccacgtgggcaaggagaagcaccccgccaacctgatcctgatctacggcaacgagttcgacaagagattcttcgtgcccgccgagaagatcgtgatcaacttcatcaccctgaacatcagcgacgacagcaagatcagccaccaggacatgagcctgctgggcaagagcagcgacgtgagcagcctgaacgacccccagcccagcggcaacctgagacccccccaggaggaggaggaggtgaagcacctgggctacgccagccacctgatggagatcttctgcgacagcgaggagaacaccgagggcaccagcctgacccagcaggagagcctgagcagaaccatcccccccgacaagaccgtgatcgagtacgagtacgacgtgagaaccaccgacatctgcgccggccccgaggagcaggagctgagcctgcaggaggaggtgagcacccagggcaccctgctggagagccaggccgccctggccgtgctgggcccccagaccctgcagtacagctacaccccccagctgcaggacctggaccccctggcccaggagcacaccgacagcgaggagggccccgaggaggagcccagcaccaccctggtggactgggacccccagaccggcagactgtgcatccccagcctgagcagcttcgaccaggacagcgagggctgcgagcccagcgagggcgacggcctgggcgaggagggcctgctgagcagactgtacgaggagcccgcccccgacagaccccccggcgagaacgagacctacctgatgcagttcatggaggagtggggcctgtacgtgcagatggagaactag

SEQ ID NO: 85621 - DNA, 1515 bp, Artificial Sequence
  Description of Artificial Sequence: Synthetic coding sequence
atgaagaacgtgctgcagtggaccccccccgagggcctgcagggcgtgaaggtgacctacaccgtgcagtacttcatctacggccagaagaagtggctgaacaagagcgagtgcagaaacatcaacagaacctactgcgacctgagcgccgagaccagcgactacgagcaccagtactacgccaaggtgaaggccatctggggcaccaagtgcagcaagtgggccgagagcggcagattctaccccttcctggagacccagatcggcccccccgaggtggccctgaccaccgacgagaagagcatcagcgtggtgctgaccgcccccgagaagtggaagagaaaccccgaggacctgcccgtgagcatgcagcagatctacagcaacctgaagtacaacgtgagcgtgctgaacaccaagagcaacagaacctggagccagtgcgtgaccaaccacaccctggtgctgacctggctggagcccaacaccctgtactgcgtgcacgtggagagcttcgtgcccggcccccccagaagagcccagcccagcgagaagcagtgcgccagaaccctgaaggaccagagcagcgagttcaaggccaagatcatcttctggtacgtgctgcccgtgagcatcaccgtgttcctgttcagcgtgatgggctacagcatctacagatacatccacgtgggcaaggagaagcaccccgccaacctgatcctgatctacggcaacgagttcgacaagagattcttcgtgcccgccgagaagatcgtgatcaacttcatcaccctgaacatcagcgacgacagcaagatcagccaccaggacatgagcctgctgggcaagagcagcgacgtgagcagcctgaacgacccccagcccagcggcaacctgagacccccccaggaggaggaggaggtgaagcacctgggctacgccagccacctgatggagatcttctgcgacagcgaggagaacaccgagggcaccagcctgacccagcaggagagcctgagcagaaccatcccccccgacaagaccgtgatcgagtacgagtacgacgtgagaaccaccgacatctgcgccggccccgaggagcaggagctgagcctgcaggaggaggtgagcacccagggcaccctgctggagagccaggccgccctggccgtgctgggcccccagaccctgcagtacagctacaccccccagctgcaggacctggaccccctggcccaggagcacaccgacagcgaggagggccccgaggaggagcccagcaccaccctggtggactgggacccccagaccggcagactgtgcatccccagcctgagcagcttcgaccaggacagcgagggctgcgagcccagcgagggcgacggcctgggcgaggagggcctgctgagcagactgtacgaggagcccgcccccgacagaccccccggcgagaacgagacctacctgatgcagttcatggaggagtggggcctgtacgtgcagatggagaactag

SEQ ID NO: 85622 - DNA, 1617 bp, Artificial Sequence
  Description of Artificial Sequence: Synthetic coding sequence
atgcccagaggctgggccgcccccctgctgctgctgctgctgcagggcggctggggctgccccgacctggtgtgctacaccgactacctgcagaccgtgatctgcatcctggagatgtggaacctgcaccccagcaccctgaccctgacctggcaggaccagtacgaggagctgaaggacgaggccaccagctgcagcctgcacagaagcgcccacaacgccacccacgccacctacacctgccacatggacgtgttccacttcatggccgacgacatcttcagcgtgaacatcaccgaccagagcggcaactacagccaggagtgcggcagcttcctgctggccgagagcatcaagcccgccccccccttcaacgtgaccgtgaccttcagcggccagtacaacatcagctggagaagcgactacgaggaccccgccttctacatgctgaagggcaagctgcagtacgagctgcagtacagaaacagaggcgacccctgggccgtgagccccagaagaaagctgatcagcgtggacagcagaagcgtgagcctgctgcccctggagttcagaaaggacagcagctacgagctgcaggtgagagccggccccatgcccggcagcagctaccagggcacctggagcgagtggagcgaccccgtgatcttccagacccagagcgaggagctgaaggagggctggaacccccacctgctgctgctgctgctgctggtgatcgtgttcatccccgccttctggagcctgaagacccaccccctgtggagactgtggaagaagatctgggccgtgcccagccccgagagattcttcatgcccctgtacaagggctgcagcggcgacttcaagaagtgggtgggcgcccccttcaccggcagcagcctggagctgggcccctggagccccgaggtgcccagcaccctggaggtgtacagctgccacccccccagaagccccgccaagagactgcagctgaccgagctgcaggagcccgccgagctggtggagagcgacggcgtgcccaagcccagcttctggcccaccgcccagaacagcggcggcagcgcctacagcgaggagagagacagaccctacggcctggtgagcatcgacaccgtgaccgtgctggacgccgagggcccctgcacctggccctgcagctgcgaggacgacggctaccccgccctggacctggacgccggcctggagcccagccccggcctggaggaccccctgctggacgccggcaccaccgtgctgagctgcggctgcgtgagcgccggcagccccggcctgggcggccccctgggcagcctgctggacagactgaagccccccctggccgacggcgaggactgggccggcggcctgccctggggcggcagaagccccggcggcgtgagcgagagcgaggccggcagccccctggccggcctggacatggacaccttcgacagcggcttcgtgggcagcgactgcagcagccccgtggagtgcgacttcaccagccccggcgacgagggcccccccagaagctacctgagacagtgggtggtgatccccccccccctgagcagccccggcccccaggccagctag

SEQ ID NO: 85623 - DNA, 1617 bp, Artificial Sequence; identical to SEQ ID NO: 85622
  Description of Artificial Sequence: Synthetic coding sequence

SEQ ID NO: 85624 - DNA, 1617 bp, Artificial Sequence; identical to SEQ ID NO: 85622
  Description of Artificial Sequence: Synthetic coding sequence

SEQ ID NO: 85625 - DNA, 792 bp, Artificial Sequence
  Description of Artificial Sequence: Synthetic coding sequence
atgatgcccaagcactgcttcctgggcttcctgatcagcttcttcctgaccggcgtggccggcacccagagcacccacgagagcctgaagccccagagagtgcagttccagagcagaaacttccacaacatcctgcagtggcagcccggcagagccctgaccggcaacagcagcgtgtacttcgtgcagtacaagatcatgttcagctgcagcatgaagagcagccaccagaagcccagcggctgctggcagcacatcagctgcaacttccccggctgcagaaccctggccaagtacggccagagacagtggaagaacaaggaggactgctggggcacccaggagctgagctgcgacctgaccagcgagaccagcgacatccaggagccctactacggcagagtgagagccgccagcgccggcagctacagcgagtggagcatgacccccagattcaccccctggtgggagaccaagatcgacccccccgtgatgaacatcacccaggtgaacggcagcctgctggtgatcctgcacgcccccaacctgccctacagataccagaaggagaagaacgtgagcatcgaggactactacgagctgctgtacagagtgttcatcatcaacaacagcctggagaaggagcagaaggtgtacgagggcgcccacagagccgtggagatcgaggccctgaccccccacagcagctactgcgtggtggccgagatctaccagcccatgctggacagaagaagccagagaagcgaggagagatgcgtggagatcccctag

SEQ ID NO: 85626 - DNA, 393 bp, Artificial Sequence
  Description of Artificial Sequence: Synthetic coding sequence
atgatgcccaagcactgcttcctgggcttcctgatcagcttcttcctgaccggcgtggccggcacccagagcacccacgagagcctgaagccccagagagtgcagttccagagcagaaacttccacaacatcctgcagtggcagcccggcagagccctgaccggcaacagcagcgtgtacttcgtgcagtacaagatctacggccagagacagtggaagaacaaggaggactgctggggcacccaggagctgagctgcgacctgaccagcgagaccagcgacatccaggagccctactacggcagagtgagagccgccagcgccggcagctacagcgagtggagcatgacccccagattcaccccctggtgggagagagccaagggcctgtag

SEQ ID NO: 85627 - DNA, 696 bp, Artificial Sequence
  Description of Artificial Sequence: Synthetic coding sequence
atgatgcccaagcactgcttcctgggcttcctgatcagcttcttcctgaccggcgtggccggcacccagagcacccacgagagcctgaagccccagagagtgcagttccagagcagaaacttccacaacatcctgcagtggcagcccggcagagccctgaccggcaacagcagcgtgtacttcgtgcagtacaagatctacggccagagacagtggaagaacaaggaggactgctggggcacccaggagctgagctgcgacctgaccagcgagaccagcgacatccaggagccctactacggcagagtgagagccgccagcgccggcagctacagcgagtggagcatgacccccagattcaccccctggtgggagaccaagatcgacccccccgtgatgaacatcacccaggtgaacggcagcctgctggtgatcctgcacgcccccaacctgccctacagataccagaaggagaagaacgtgagcatcgaggactactacgagctgctgtacagagtgttcatcatcaacaacagcctggagaaggagcagaaggtgtacgagggcgcccacagagccgtggagatcgaggccctgaccccccacagcagctactgcgtggtggccgagatctaccagcccatgctggacagaagaagccagagaagcgaggagagatgcgtggagatcccctag

SEQ ID NO: 85628 - DNA, 1563 bp, Artificial Sequence
  Description of Artificial Sequence: Synthetic coding sequence
atggccggccccgagagatggggccccctgctgctgtgcctgctgcaggccgcccccggcagacccagactggcccccccccagaacgtgaccctgctgagccagaacttcagcgtgtacctgacctggctgcccggcctgggcaacccccaggacgtgacctacttcgtggcctaccagagcagccccaccagaagaagatggagagaggtggaggagtgcgccggcaccaaggagctgctgtgcagcatgatgtgcctgaagaagcaggacctgtacaacaagttcaagggcagagtgagaaccgtgagccccagcagcaagagcccctgggtggagagcgagtacctggactacctgttcgaggtggagcccgccccccccgtgctggtgctgacccagaccgaggagatcctgagcgccaacgccacctaccagctgcccccctgcatgccccccctggacctgaagtacgaggtggccttctggaaggagggcgccggcaacaagaccctgttccccgtgaccccccacggccagcccgtgcagatcaccctgcagcccgccgccagcgagcaccactgcctgagcgccagaaccatctacaccttcagcgtgcccaagtacagcaagttcagcaagcccacctgcttcctgctggaggtgcccgaggccaactgggccttcctggtgctgcccagcctgctgatcctgctgctggtgatcgccgccggcggcgtgatctggaagaccctgatgggcaacccctggttccagagagccaagatgcccagagccctggacttcagcggccacacccaccccgtggccaccttccagcccagcagacccgagagcgtgaacgacctgttcctgtgcccccagaaggagctgaccagaggcgtgagacccacccccagagtgagagcccccgccacccagcagaccagatggaagaaggacctggccgaggacgaggaggaggaggacgaggaggacaccgaggacggcgtgagcttccagccctacatcgagccccccagcttcctgggccaggagcaccaggcccccggccacagcgaggccggcggcgtggacagcggcagacccagagcccccctggtgcccagcgagggcagcagcgcctgggacagcagcgacagaagctgggccagcaccgtggacagcagctgggacagagccggcagcagcggctacctggccgagaagggccccggccagggccccggcggcgacggccaccaggagagcctgcccccccccgagttcagcaaggacagcggcttcctggaggagctgcccgaggacaacctgagcagctgggccacctggggcaccctgccccccgagcccaacctggtgcccggcggcccccccgtgagcctgcagaccctgaccttctgctgggagagcagccccgaggaggaggaggaggccagagagagcgagatcgaggacagcgacgccggcagctggggcgccgagagcacccagagaaccgaggacagaggcagaaccctgggccactacatggccagatag

SEQ ID NO: 85629 - DNA, 735 bp, Artificial Sequence
  Description of Artificial Sequence: Synthetic coding sequence
atggccggccccgagagatggggccccctgctgctgtgcctgctgcaggccgcccccggcagacccagactggcccccccccagaacgtgaccctgctgagccagaacttcagcgtgtacctgacctggctgcccggcctgggcaacccccaggacgtgacctacttcgtggcctaccagagcagccccaccagaagaagatggagagaggtggaggagtgcgccggcaccaaggagctgctgtgcagcatgatgtgcctgaagaagcaggacctgtacaacaagttcaagggcagagtgagaaccgtgagccccagcagcaagagcccctgggtggagagcgagtacctggactacctgttcgaggtggagcccgccccccccgtgctggtgctgacccagaccgaggagatcctgagcgccaacgccacctaccagctgcccccctgcatgccccccctggacctgaagtacgaggtggccttctggaaggagggcgccggcaacaagaccctgttccccgtgaccccccacggccagcccgtgcagatcaccctgcagcccgccgccagcgagcaccactgcctgagcgccagaaccatctacaccttcagcgtgcccaagtacagcaagttcagcaagcccacctgcttcctgctggaggtgcccggcctgttctggacccacaccccctgcggcaacctgagcgcccagcagaccagagtgagagagtag

SEQ ID NO: 85630 - DNA, 636 bp, Artificial Sequence
  Description of Artificial Sequence: Synthetic coding sequence
atggccggccccgagagatggggccccctgctgctgtgcctgctgcaggccgcccccggcagacccagactggcccccccccagaacgtgaccctgctgagccagaacttcagcgtgtacctgacctggctgcccggcctgggcaacccccaggacgtgacctacttcgtggcctaccagagcagccccaccagaagaagatggagagaggtggaggagtgcgccggcaccaaggagctgctgtgcagcatgatgtgcctgaagaagcaggacctgtacaacaagttcaagggcagagtgagaaccgtgagccccagcagcaagagcccctgggtggagagcgagtacctggactacctgttcgaggtggagcccgccccccccgtgctggtgctgacccagaccgaggagatcctgagcgccaacgccacctaccagctgcccccctgcatgccccccctggacctgaagtacgaggtggccttctggaaggagggcgccggcaacaaggtgggcagcagcttccccgcccccagactgggccccctgctgcaccccttcctgctgagattcttcagccccagccagcccgcccccgcccccctgctgcaggaggtgttccccgtgcacagctag

SEQ ID NO: 85631 - DNA, 558 bp, Artificial Sequence
  Description of Artificial Sequence: Synthetic coding sequence
atgatgtgcctgaagaagcaggacctgtacaacaagttcaagggcagagtgagaaccgtgagccccagcagcaagagcccctgggtggagagcgagtacctggactacctgttcgaggtggagcccgccccccccgtgctggtgctgacccagaccgaggagatcctgagcgccaacgccacctaccagctgcccccctgcatgccccccctggacctgaagtacgaggtggccttctggaaggagggcgccggcaacaagaccctgttccccgtgaccccccacggccagcccgtgcagatcaccctgcagcccgccgccagcgagcaccactgcctgagcgccagaaccatctacaccttcagcgtgcccaagtacagcaagttcagcaagcccacctgcttcctgctggaggtgcccgaggccaactgggccttcctggtgctgcccagcctgctgatcctgctgctggtgatcgccgccggcggcgtgatctggaagaccctgatgggcaacccctggttccagagagccaagatgcccagagccctggtgtag

SEQ ID NO: 85632 - DNA, 1476 bp, Artificial Sequence
  Description of Artificial Sequence: Synthetic coding sequence
atggccggccccgagagatggggccccctgctgctgtgcctgctgcaggccgcccccggcagacccagactggcccccccccagaacgtgaccctgctgagccagaacttcagcgtgtacctgacctggctgcccggcctgggcaacccccaggacgtgacctacttcgtggcctaccagagcagccccaccagaagaagatggagagaggtggaggagtgcgccggcaccaaggagctgctgtgcagcatgatgtgcctgaagaagcaggacctgtacaacaagttcaagggcagagtgagaaccgtgagccccagcagcaagagcccctgggtggagagcgagtacctggactacctgttcgaggtggagcccgccccccccgtgctggtgctgacccagaccgaggagatcctgagcgccaacgccacctaccagctgcccccctgcatgccccccctggacctgaagtacgaggtggccttctggaaggagggcgccggcaacaagaccctgttccccgtgaccccccacggccagcccgtgcagatcaccctgcagcccgccgccagcgagcaccactgcctgagcgccagaaccatctacaccttcagcgtgcccaagtacagcaagttcagcaagcccacctgcttcctgctggaggtgcccgaggccaactgggccttcctggtgctgcccagcctgctgatcctgctgctggtgatcgccgccggcggcgtgatctggaagaccctgatgggcaacccctggttccagagagccaagatgcccagagccctggagctgaccagaggcgtgagacccacccccagagtgagagcccccgccacccagcagaccagatggaagaaggacctggccgaggacgaggaggaggaggacgaggaggacaccgaggacggcgtgagcttccagccctacatcgagccccccagcttcctgggccaggagcaccaggcccccggccacagcgaggccggcggcgtggacagcggcagacccagagcccccctggtgcccagcgagggcagcagcgcctgggacagcagcgacagaagctgggccagcaccgtggacagcagctgggacagagccggcagcagcggctacctggccgagaagggccccggccagggccccggcggcgacggccaccaggagagcctgcccccccccgagttcagcaaggacagcggcttcctggaggagctgcccgaggacaacctgagcagctgggccacctggggcaccctgccccccgagcccaacctggtgcccggcggcccccccgtgagcctgcagaccctgaccttctgctgggagagcagccccgaggaggaggaggaggccagagagagcgagatcgaggacagcgacgccggcagctggggcgccgagagcacccagagaaccgaggacagaggcagaaccctgggccactacatggccagatag

SEQ ID NO: 85633 - DNA, 459 bp, Artificial Sequence
  Description of Artificial Sequence: Synthetic coding sequence
atgagcagactgcccgtgctgctgctgctgcagctgctggtgagacccggcctgcaggcccccatgacccagaccacccccctgaagaccagctgggtgaactgcagcaacatgatcgacgagatcatcacccacctgaagcagccccccctgcccctgctggacttcaacaacctgaacggcgaggaccaggacatcctgatggagaacaacctgagaagacccaacctggaggccttcaacagagccgtgaagagcctgcagaacgccagcgccatcgagagcatcctgaagaacctgctgccctgcctgcccctggccaccgccgcccccaccagacaccccatccacatcaaggacggcgactggaacgagttcagaagaaagctgaccttctacctgaagaccctggagaacgcccaggcccagcagaccaccctgagcctggccatcttctag

SEQ ID NO: 85634 - DNA, 1137 bp, Artificial Sequence
  Description of Artificial Sequence: Synthetic coding sequence
atggtgctgctgtggctgaccctgctgctgatcgccctgccctgcctgctgcagaccaaggaggaccccaacccccccatcaccaacctgagaatgaaggccaaggcccagcagctgacctgggacctgaacagaaacgtgaccgacatcgagtgcgtgaaggacgccgactacagcatgcccgccgtgaacaacagctactgccagttcggcgccatcagcctgtgcgaggtgaccaactacaccgtgagagtggccaacccccccttcagcacctggatcctgttccccgagaacagcggcaagccctgggccggcgccgagaacctgacctgctggatccacgacgtggacttcctgagctgcagctgggccgtgggccccggcgcccccgccgacgtgcagtacgacctgtacctgaacgtggccaacagaagacagcagtacgagtgcctgcactacaagaccgacgcccagggcaccagaatcggctgcagattcgacgacatcagcagactgagcagcggcagccagagcagccacatcctggtgagaggcagaagcgccgccttcggcatcccctgcaccgacaagttcgtggtgttcagccagatcgagatcctgaccccccccaacatgaccgccaagtgcaacaagacccacagcttcatgcactggaagatgagaagccacttcaacagaaagttcagatacgagctgcagatccagaagagaatgcagcccgtgatcaccgagcaggtgagagacagaaccagcttccagctgctgaaccccggcacctacaccgtgcagatcagagccagagagagagtgtacgagttcctgagcgcctggagcaccccccagagattcgagtgcgaccaggaggagggcgccaacaccagagcctggagaaccagcctgctgatcgccctgggcaccctgctggccctggtgtgcgtgttcgtgatctgcagaagatacctggtgatgcagagactgttccccagaatcccccacatgaaggaccccatcggcgacagcttccagaacgacaagctggtggtgtgggaggccggcaaggccggcctggaggagtgcctggtgaccgaggtgcaggtggtgcagaagacctag

SEQ ID NO: 85635 - DNA, 903 bp, Artificial Sequence
  Description of Artificial Sequence: Synthetic coding sequence
atggtgctgctgtggctgaccctgctgctgatcgccctgccctgcctgctgcagaccaaggagggcggcaagccctgggccggcgccgagaacctgacctgctggatccacgacgtggacttcctgagctgcagctgggccgtgggccccggcgcccccgccgacgtgcagtacgacctgtacctgaacgtggccaacagaagacagcagtacgagtgcctgcactacaagaccgacgcccagggcaccagaatcggctgcagattcgacgacatcagcagactgagcagcggcagccagagcagccacatcctggtgagaggcagaagcgccgccttcggcatcccctgcaccgacaagttcgtggtgttcagccagatcgagatcctgaccccccccaacatgaccgccaagtgcaacaagacccacagcttcatgcactggaagatgagaagccacttcaacagaaagttcagatacgagctgcagatccagaagagaatgcagcccgtgatcaccgagcaggtgagagacagaaccagcttccagctgctgaaccccggcacctacaccgtgcagatcagagccagagagagagtgtacgagttcctgagcgcctggagcaccccccagagattcgagtgcgaccaggaggagggcgccaacaccagagcctggagaaccagcctgctgatcgccctgggcaccctgctggccctggtgtgcgtgttcgtgatctgcagaagatacctggtgatgcagagactgttccccagaatcccccacatgaaggaccccatcggcgacagcttccagaacgacaagctggtggtgtgggaggccggcaaggccggcctggaggagtgcctggtgaccgaggtgcaggtggtgcagaagacctag

SEQ ID NO: 85636 - DNA, 495 bp, Artificial Sequence
  Description of Artificial Sequence: Synthetic coding sequence
atggtgctgctgtggctgaccctgctgctgatcgccctgccctgcctgctgcagaccaaggagggcggcaagccctgggccggcgccgagaacctgacctgctggatccacgacgtggacttcctgagctgcagctgggccgtgggccccggcgcccccgccgacgtgcagtacgacctgtacctgaacgtggccaacagaagacagcagtacgagtgcctgcactacaagaccgacgcccagggcaccagaatcggctgcagattcgacgacatcagcagactgagcagcggcagccagagcagccacatcctggtgagaggcagaagcgccgccttcggcatcccctgcaccgacaagttcgtggtgttcagccagatcgagatcctgaccccccccaacatgaccgccaagtgcaacaagacccacagcttcatgcactggaagatgagaagccacttcaacagaaagttcagatacgagctgcagatctag

SEQ ID NO: 85637 - DNA, 1323 bp, Artificial Sequence
  Description of Artificial Sequence: Synthetic coding sequence
atgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttctgcaagcacgcccacagcgaggtggagaagaaccccaagccccagatcgacgccatggacagacccgtggtgggcatggccccccccagccactgcgacctgcagcccggcatgaaccacctggccagcctgaacctgagcgagaacggcgccaagagcacccacctgctgggcttctggggcctgaacgagagcgaggtgaccgtgcccgagagaagagtgctgagaaagtggaaggagctgctgtag

SEQ ID NO: 85638 - DNA, 1989 bp, Artificial Sequence
  Description of Artificial Sequence: Synthetic coding sequence
atgaagctgagcccccagcccagctgcgtgaacctgggcatgatgtggacctgggccctgtggatgctgcccagcctgtgcaagttcagcctggccgccctgcccgccaagcccgagaacatcagctgcgtgtactactacagaaagaacctgacctgcacctggagccccggcaaggagaccagctacacccagtacaccgtgaagagaacctacgccttcggcgagaagcacgacaactgcaccaccaacagcagcaccagcgagaacagagccagctgcagcttcttcctgcccagaatcaccatccccgacaactacaccatcgaggtggaggccgagaacggcgacggcgtgatcaagagccacatgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttcagcaagaccgtgaacagcagcatcctgcagtacggcctggagagcctgaagagaaagaccagctacatcgtgcaggtgatggccagcaccagcgccggcggcaccaacggcaccagcatcaacttcaagaccctgagcttcagcgtgttcgagatcatcctgatcaccagcctgatcggcggcggcctgctgatcctgatcatcctgaccgtggcctacggcctgaagaagcccaacaagctgacccacctgtgctggcccaccgtgcccaaccccgccgagagcagcatcgccacctggcacggcgacgacttcaaggacaagctgaacctgaaggagagcgacgacagcgtgaacaccgaggacagaatcctgaagccctgcagcacccccagcgacaagctggtgatcgacaagctggtggtgaacttcggcaacgtgctgcaggagatcttcaccgacgaggccagaaccggccaggagaacaacctgggcggcgagaagaacggcaccagaatcctgagcagctgccccaccagcatctag

SEQ ID NO: 85639 - DNA, 2046 bp, Artificial Sequence
  Description of Artificial Sequence: Synthetic coding sequence
atgtgcatcagacagctgaagttcttcaccaccgcctgcgtgtgcgagtgcccccagaacatcctgagcccccagcccagctgcgtgaacctgggcatgatgtggacctgggccctgtggatgctgcccagcctgtgcaagttcagcctggccgccctgcccgccaagcccgagaacatcagctgcgtgtactactacagaaagaacctgacctgcacctggagccccggcaaggagaccagctacacccagtacaccgtgaagagaacctacgccttcggcgagaagcacgacaactgcaccaccaacagcagcaccagcgagaacagagccagctgcagcttcttcctgcccagaatcaccatccccgacaactacaccatcgaggtggaggccgagaacggcgacggcgtgatcaagagccacatgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttcagcaagaccgtgaacagcagcatcctgcagtacggcctggagagcctgaagagaaagaccagctacatcgtgcaggtgatggccagcaccagcgccggcggcaccaacggcaccagcatcaacttcaagaccctgagcttcagcgtgttcgagatcatcctgatcaccagcctgatcggcggcggcctgctgatcctgatcatcctgaccgtggcctacggcctgaagaagcccaacaagctgacccacctgtgctggcccaccgtgcccaaccccgccgagagcagcatcgccacctggcacggcgacgacttcaaggacaagctgaacctgaaggagagcgacgacagcgtgaacaccgaggacagaatcctgaagccctgcagcacccccagcgacaagctggtgatcgacaagctggtggtgaacttcggcaacgtgctgcaggagatcttcaccgacgaggccagaaccggccaggagaacaacctgggcggcgagaagaacggcaccagaatcctgagcagctgccccaccagcatctag

SEQ ID NO: 85640 - DNA, 1989 bp, Artificial Sequence; identical to SEQ ID NO: 85638
  Description of Artificial Sequence: Synthetic coding sequence

SEQ ID NO: 85641 - DNA, 1749 bp, Artificial Sequence
  Description of Artificial Sequence: Synthetic coding sequence
atgtgcatcagacagctgaagttcttcaccaccgcctgcgtgtgcgagtgcccccagaacatcctgagcccccagcccagctgcgtgaacctgggcatgatgtggacctgggccctgtggatgctgcccagcctgtgcaagttcagcctggccgccctgcccgccaagcccgagaacatcagctgcgtgtactactacagaaagaacctgacctgcacctggagccccggcaaggagaccagctacacccagtacaccgtgaagagaacctacgccttcggcgagaagcacgacaactgcaccaccaacagcagcaccagcgagaacagagccagctgcagcttcttcctgcccagaatcaccatccccgacaactacaccatcgaggtggaggccgagaacggcgacggcgtgatcaagagccacatgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttctgcaagcacgcccacagcgaggtggagaagaaccccaagccccagatcgacgccatggacagacccgtggtgggcatggccccccccagccactgcgacctgcagcccggcatgaaccacctggccagcctgaacctgagcgagaacggcgccaagagcacccacctgctgggcttctggggcctgaacgagagcgaggtgaccgtgcccgagagaagagtgctgagaaagtggaaggagctgctgtag

SEQ ID NO: 85642 - DNA, 2295 bp, Artificial Sequence
  Description of Artificial Sequence: Synthetic coding sequence
atgtgcatcagacagctgaagttcttcaccaccgcctgcgtgtgcgagtgcccccagaacatcctgagcccccagcccagctgcgtgaacctgggcatgatgtggacctgggccctgtggatgctgcccagcctgtgcaagttcagcctggccgccctgcccgccaagcccgagaacatcagctgcgtgtactactacagaaagaacctgacctgcacctggagccccggcaaggagaccagctacacccagtacaccgtgaagagaacctacgccttcggcgagaagcacgacaactgcaccaccaacagcagcaccagcgagaacagagccagctgcagcttcttcctgcccagaatcaccatccccgacaactacaccatcgaggtggaggccgagaacggcgacggcgtgatcaagagccacatgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttcagcaagaccgtgaacagcagcatcctgcagtacggcctggagagcctgaagagaaagaccagctacatcgtgcaggtgatggccagcaccagcgccggcggcaccaacggcaccagcatcaacttcaagaccctgagcttcagcgtgttcgagatcatcctgatcaccagcctgatcggcggcggcctgctgatcctgatcatcctgaccgtggcctacggcctgaagaagcccaacaagctgacccacctgtgctggcccaccgtgcccaaccccgccgagagcagcatcgccacctggcacggcgacgacttcaaggacaagctgaacctgaaggagagcgacgacagcgtgaacaccgaggacagaatcctgaagccctgcagcacccccagcgacaagctggtgatcgacaagctggtggtgaacttcggcaacgtgctgcaggagatcttcaccgacgaggccagaaccggccaggagaacaacctgggcggcgagaagaacggctacgtgacctgccccttcagacccgactgccccctgggcaagagcttcgaggagctgcccgtgagccccgagatcccccccagaaagagccagtacctgagaagcagaatgcccgagggcaccagacccgaggccaaggagcagctgctgttcagcggccagagcctggtgcccgaccacctgtgcgaggagggcgcccccaacccctacctgaagaacagcgtgaccgccagagagttcctggtgagcgagaagctgcccgagcacaccaagggcgaggtgtag

SEQ ID NO: 85643 - DNA, 1869 bp, Artificial Sequence
  Description of Artificial Sequence: Synthetic coding sequence
atgacctactggagactggagaacatcgccaagaccgagccccccaagatcttcagagtgaagcccgtgctgggcatcaagagaatgatccagatcgagtggatcaagcccgagctggcccccgtgagcagcgacctgaagtacaccctgagattcagaaccgtgaacagcaccagctggatggaggtgaacttcgccaagaacagaaaggacaagaaccagacctacaacctgaccggcctgcagcccttcaccgagtacgtgatcgccctgagatgcgccgtgaaggagagcaagttctggagcgactggagccaggagaagatgggcatgaccgaggaggaggccccctgcggcctggagctgtggagagtgctgaagcccgccgaggccgacggcagaagacccgtgagactgctgtggaagaaggccagaggcgcccccgtgctggagaagaccctgggctacaacatctggtactaccccgagagcaacaccaacctgaccgagaccatgaacaccaccaaccagcagctggagctgcacctgggcggcgagagcttctgggtgagcatgatcagctacaacagcctgggcaagagccccgtggccaccctgagaatccccgccatccaggagaagagcttccagtgcatcgaggtgatgcaggcctgcgtggccgaggaccagctggtggtgaagtggcagagcagcgccctggacgtgaacacctggatgatcgagtggttccccgacgtggacagcgagcccaccaccctgagctgggagagcgtgagccaggccaccaactggaccatccagcaggacaagctgaagcccttctggtgctacaacatcagcgtgtaccccatgctgcacgacaaggtgggcgagccctacagcatccaggcctacgccaaggagggcgtgcccagcgagggccccgagaccaaggtggagaacatcggcgtgaagaccgtgaccatcacctggaaggagatccccaagagcgagagaaagggcatcatctgcaactacaccatcttctaccaggccgagggcggcaagggcttcagcaagaccgtgaacagcagcatcctgcagtacggcctggagagcctgaagagaaagaccagctacatcgtgcaggtgatggccagcaccagcgccggcggcaccaacggcaccagcatcaacttcaagaccctgagcttcagcgtgttcgagatcatcctgatcaccagcctgatcggcggcggcctgctgatcctgatcatcctgaccgtggcctacggcctgaagaagcccaacaagctgacccacctgtgctggcccaccgtgcccaaccccgccgagagcagcatcgccacctggcacggcgacgacttcaaggacaagctgaacctgaaggagagcgacgacagcgtgaacaccgaggacagaatcctgaagccctgcagcacccccagcgacaagctggtgatcgacaagctggtggtgaacttcggcaacgtgctgcaggagatcttcaccgacgaggccagaaccggccaggagaacaacctgggcggcgagaagaacggctacgtgacctgccccttcagacccgactgccccctgggcaagagcttcgaggagctgcccgtgagccccgagatcccccccagaaagagccagtacctgagaagcagaatgcccgagggcaccagacccgaggccaaggagcagctgctgttcagcggccagagcctggtgcccgaccacctgtgcgaggagggcgcccccaacccctacctgaagaacagcgtgaccgccagagagttcctggtgagcgagaagctgcccgagcacaccaagggcgaggtgtag

SEQ ID NO: 85644 - DNA, 468 bp, Artificial Sequence
  Description of Artificial Sequence: Synthetic coding sequence
atggtgctgagcggcgccctgtgcttcagaatgaaggacagcgccctgaaggtgctgtacctgcacaacaaccagctgctggccggcggcctgcacgccggcaaggtgatcaagggcgaggagatcagcgtggtgcccaacagatggctggacgccagcctgagccccgtgatcctgggcgtgcagggcggcagccagtgcctgagctgcggcgtgggccaggagcccaccctgaccctggagcccgtgaacatcatggagctgtacctgggcgccaaggagagcaagagcttcaccttctacagaagagacatgggcctgaccagcagcttcgagagcgccgcctaccccggctggttcctgtgcaccgtgcccgaggccgaccagcccgtgagactgacccagctgcccgagaacggcggctggaacgcccccatcaccgacttctacttccagcagtgcgactag

SEQ ID NO: 85645 - DNA, 468 bp, Artificial Sequence; identical to SEQ ID NO: 85644
  Description of Artificial Sequence: Synthetic coding sequence

SEQ ID NO: 85646 - DNA, 354 bp, Artificial Sequence
  Description of Artificial Sequence: Synthetic coding sequence
atggtgctgagcggcgccctgtgcttcagaatgaaggacagcgccctgaaggtgctgtacctgcacaacaaccagctgctggccggcggcctgcacgccggcaaggtgatcaagggcgaggagatcagcgtggtgcccaacagatggctggacgccagcctgagccccgtgatcctgggcgtgcagggcggcagccagtgcctgagctgcggcgtgggccaggagcccaccctgaccctggagcccgtgaacatcatggagctgtacctgggcgccaaggagagcaagagcttcaccttctacagaagagacatgggcctgaccagcagcttcgagagcgccgcctacccctag

SEQ ID NO: 85647 - DNA, 2478 bp, Artificial Sequence
  Description of Artificial Sequence: Synthetic coding sequence
atgggctggctgtgcagcggcctgctgttccccgtgagctgcctggtgctgctgcaggtggccagcagcggcaacatgaaggtgctgcaggagcccacctgcgtgagcgactacatgagcatcagcacctgcgagtggaagatgaacggccccaccaactgcagcaccgagctgagactgctgtaccagctggtgttcctgctgagcgaggcccacacctgcatccccgagaacaacggcggcgccggctgcgtgtgccacctgctgatggacgacgtggtgagcgccgacaactacaccctggacctgtgggccggccagcagctgctgtggaagggcagcttcaagcccagcgagcacgtgaagcccagagcccccggcaacctgaccgtgcacaccaacgtgagcgacaccctgctgctgacctggagcaacccctacccccccgacaactacctgtacaaccacctgacctacgccgtgaacatctggagcgagaacgaccccgccgacttcagaatctacaacgtgacctacctggagcccagcctgagaatcgccgccagcaccctgaagagcggcatcagctacagagccagagtgagagcctgggcccagtgctacaacaccacctggagcgagtggagccccagcaccaagtggcacaacagctacagagagcccttcgagcagcacctgctgctgggcgtgagcgtgagctgcatcgtgatcctggccgtgtgcctgctgtgctacgtgagcatcaccaagatcaagaaggagtggtgggaccagatccccaaccccgccagaagcagactggtggccatcatcatccaggacgcccagggcagccagtgggagaagagaagcagaggccaggagcccgccaagtgcccccactggaagaactgcctgaccaagctgctgccctgcttcctggagcacaacatgaagagagacgaggacccccacaaggccgccaaggagatgcccttccagggcagcggcaagagcgcctggtgccccgtggagatcagcaagaccgtgctgtggcccgagagcatcagcgtggtgagatgcgtggagctgttcgaggcccccgtggagtgcgaggaggaggaggaggtggaggaggagaagggcagcttctgcgccagccccgagagcagcagagacgacttccaggagggcagagagggcatcgtggccagactgaccgagagcctgttcctggacctgctgggcgaggagaacggcggcttctgccagcaggacatgggcgagagctgcctgctgccccccagcggcagcaccagcgcccacatgccctgggacgagttccccagcgccggccccaaggaggcccccccctggggcaaggagcagcccctgcacctggagcccagcccccccgccagccccacccagagccccgacaacctgacctgcaccgagacccccctggtgatcgccggcaaccccgcctacagaagcttcagcaacagcctgagccagagcccctgccccagagagctgggccccgaccccctgctggccagacacctggaggaggtggagcccgagatgccctgcgtgccccagctgagcgagcccaccaccgtgccccagcccgagcccgagacctgggagcagatcctgagaagaaacgtgctgcagcacggcgccgccgccgcccccgtgagcgcccccaccagcggctaccaggagttcgtgcacgccgtggagcagggcggcacccaggccagcgccgtggtgggcctgggcccccccggcgaggccggctacaaggccttcagcagcctgctggccagcagcgccgtgagccccgagaagtgcggcttcggcgccagcagcggcgaggagggctacaagcccttccaggacctgatccccggctgccccggcgaccccgcccccgtgcccgtgcccctgttcaccttcggcctggacagagagccccccagaagcccccagagcagccacctgcccagcagcagccccgagcacctgggcctggagcccggcgagaaggtggaggacatgcccaagccccccctgccccaggagcaggccaccgaccccctggtggacagcctgggcagcggcatcgtgtacagcgccctgacctgccacctgtgcggccacctgaagcagtgccacggccaggaggacggcggccagacccccgtgatggccagcccctgctgcggctgctgctgcggcgacagaagcagcccccccaccacccccctgagagcccccgaccccagccccggcggcgtgcccctggaggccagcctgtgccccgccagcctggcccccagcggcatcagcgagaagagcaagagcagcagcagcttccaccccgcccccggcaacgcccagagcagcagccagacccccaagatcgtgaacttcgtgagcgtgggccccacctacatgagagtgagctag

SEQ ID NO: 85648 - DNA, 2433 bp, Artificial Sequence
  Description of Artificial Sequence: Synthetic coding sequence
atgcagaaggacgccagaagagagggcaacatgaaggtgctgcaggagcccacctgcgtgagcgactacatgagcatcagcacctgcgagtggaagatgaacggccccaccaactgcagcaccgagctgagactgctgtaccagctggtgttcctgctgagcgaggcccacacctgcatccccgagaacaacggcggcgccggctgcgtgtgccacctgctgatggacgacgtggtgagcgccgacaactacaccctggacctgtgggccggccagcagctgctgtggaagggcagcttcaagcccagcgagcacgtgaagcccagagcccccggcaacctgaccgtgcacaccaacgtgagcgacaccctgctgctgacctggagcaacccctacccccccgacaactacctgtacaaccacctgacctacgccgtgaacatctggagcgagaacgaccccgccgacttcagaatctacaacgtgacctacctggagcccagcctgagaatcgccgccagcaccctgaagagcggcatcagctacagagccagagtgagagcctgggcccagtgctacaacaccacctggagcgagtggagccccagcaccaagtggcacaacagctacagagagcccttcgagcagcacctgctgctgggcgtgagcgtgagctgcatcgtgatcctggccgtgtgcctgctgtgctacgtgagcatcaccaagatcaagaaggagtggtgggaccagatccccaaccccgccagaagcagactggtggccatcatcatccaggacgcccagggcagccagtgggagaagagaagcagaggccaggagcccgccaagtgcccccactggaagaactgcctgaccaagctgctgccctgcttcctggagcacaacatgaagagagacgaggacccccacaaggccgccaaggagatgcccttccagggcagcggcaagagcgcctggtgccccgtggagatcagcaagaccgtgctgtggcccgagagcatcagcgtggtgagatgcgtggagctgttcgaggcccccgtggagtgcgaggaggaggaggaggtggaggaggagaagggcagcttctgcgccagccccgagagcagcagagacgacttccaggagggcagagagggcatcgtggccagactgaccgagagcctgttcctggacctgctgggcgaggagaacggcggcttctgccagcaggacatgggcgagagctgcctgctgccccccagcggcagcaccagcgcccacatgccctgggacgagttccccagcgccggccccaaggaggcccccccctggggcaaggagcagcccctgcacctggagcccagcccccccgccagccccacccagagccccgacaacctgacctgcaccgagacccccctggtgatcgccggcaaccccgcctacagaagcttcagcaacagcctgagccagagcccctgccccagagagctgggccccgaccccctgctggccagacacctggaggaggtggagcccgagatgccctgcgtgccccagctgagcgagcccaccaccgtgccccagcccgagcccgagacctgggagcagatcctgagaagaaacgtgctgcagcacggcgccgccgccgcccccgtgagcgcccccaccagcggctaccaggagttcgtgcacgccgtggagcagggcggcacccaggccagcgccgtggtgggcctgggcccccccggcgaggccggctacaaggccttcagcagcctgctggccagcagcgccgtgagccccgagaagtgcggcttcggcgccagcagcggcgaggagggctacaagcccttccaggacctgatccccggctgccccggcgaccccgcccccgtgcccgtgcccctgttcaccttcggcctggacagagagccccccagaagcccccagagcagccacctgcccagcagcagccccgagcacctgggcctggagcccggcgagaaggtggaggacatgcccaagccccccctgccccaggagcaggccaccgaccccctggtggacagcctgggcagcggcatcgtgtacagcgccctgacctgccacctgtgcggccacctgaagcagtgccacggccaggaggacggcggccagacccccgtgatggccagcccctgctgcggctgctgctgcggcgacagaagcagcccccccaccacccccctgagagcccccgaccccagccccggcggcgtgcccctggaggccagcctgtgccccgccagcctggcccccagcggcatcagcgagaagagcaagagcagcagcagcttccaccccgcccccggcaacgcccagagcagcagccagacccccaagatcgtgaacttcgtgagcgtgggccccacctacatgagagtgagctag

SEQ ID NO: 85649 - DNA, 684 bp, Artificial Sequence
  Description of Artificial Sequence: Synthetic coding sequence
atgggctggctgtgcagcggcctgctgttccccgtgagctgcctggtgctgctgcaggtggccagcagcggcaacatgaaggtgctgcaggagcccacctgcgtgagcgactacatgagcatcagcacctgcgagtggaagatgaacggccccaccaactgcagcaccgagctgagactgctgtaccagctggtgttcctgctgagcgaggcccacacctgcatccccgagaacaacggcggcgccggctgcgtgtgccacctgctgatggacgacgtggtgagcgccgacaactacaccctggacctgtgggccggccagcagctgctgtggaagggcagcttcaagcccagcgagcacgtgaagcccagagcccccggcaacctgaccgtgcacaccaacgtgagcgacaccctgctgctgacctggagcaacccctacccccccgacaactacctgtacaaccacctgacctacgccgtgaacatctggagcgagaacgaccccgccgacttcagaatctacaacgtgacctacctggagcccagcctgagaatcgccgccagcaccctgaagagcggcatcagctacagagccagagtgagagcctgggcccagtgctacaacaccacctggagcgagtggagccccagcaccaagtggcacaacttcagcgtgtgctag

SEQ ID NO: 85650 - DNA, 2478 bp, Artificial Sequence; identical to SEQ ID NO: 85647
  Description of Artificial Sequence: Synthetic coding sequence

SEQ ID NO: 85651 - DNA, 684 bp, Artificial Sequence
  Description of Artificial Sequence: Synthetic coding sequence
atgggctggctgtgcagcggcctgctgttccccgtgagctgcctggtgctgctgcaggtggccagcagcggcaacatgaaggtgctgcaggagcccacctgcgtgagcgactacatgagcatcagcacctgcgagtggaagatgaacggccccaccaactgcagcaccgagctgagactgctgtaccagctggtgttcctgctgagcgaggcccacacctgcatccccgagaacaacggcggcgccggctgcgtgtgccacctgctgatggacgacgtggtgagcgccgacaactacaccctggacctgtgggccggccagcagctgctgtggaagggcagcttcaagcccagcgagcacgtgaagcccagagcccccggcaacctgaccgtgcacaccaacgtgagcgacaccctgctgctgacctggagcaacccctacccccccgacaactacctgtacaaccacctgacctacgccgtgaacatctggagcgagaacgaccccgccgacttcagaatctacaacgtgacctacctggagcccagcctgagaatcgccgccagcaccctgaagagcggcatcagctacagagccagagtgagagcctgggcccagtgctacaacaccacctggagcgagtggagccccagcaccaagtggcacaacagcaacatctgctag

SEQ ID NO: 85652 - DNA, 2478 bp, Artificial Sequence; identical to SEQ ID NO: 85647
  Description of Artificial Sequence: Synthetic coding sequence

SEQ ID NO: 85653 - DNA, 1263 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctggttccccagaaccttcatcctgagcaagggcagagactggctggccgtgctggtgaacggcagcagcaagcacagcgccatcagacccttcgaccagctgttcgccctgcacgccatcgaccagatcaacccccccctgaacgtgaccgccgagatcgagggcaccagactgagcatccagtgggagaagcccgtgagcgccttccccatccactgcttcgactacgaggtgaagatccacaacaccagaaacggctacctgcagatcgagaagctgatgaccaacgccttcatcagcatcatcgacgacctgagcaagtacgacgtgcaggtgagagccgccgtgagcagcatgtgcagagaggccggcctgtggagcgagtggagccagcccatctacgtgggcaacgacgagcacaagcccctgagagagtggttcgtgatcgtgatcatggccaccatctgcttcatcctgctgatcctgagcctgatctgcaagatctgccacctgtggatcaagctgttcccccccatccccgcccccaagagcaacatcaaggacctgttcgtgaccaccaactacgagaaggccggcagcagcgagaccgagatcgaggtgatctgctacatcgagaagcccggcgtggagaccctggaggacagcgtgttctag

SEQ ID NO: 85654 - DNA, 1008 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctggttccccagaaccttcatcctgagcaagggcagagactggctggccgtgctggtgaacggcagcagcaagcacagcgccatcagacccttcgaccagctgttcgccctgcacgccatcgaccagatcaacccccccctgaacgtgaccgccgagatcgagggcaccagactgagcatccagtgggagaagcccgtgagcgccttccccatccactgcttcgactacgaggtgaagatccacaacaccagaaacggctacctgcagatcgagaagctgatgaccaacgccttcatcagcatcatcgacgacctgagcaagtacgacgtgcaggtgagagccgccgtgagcagcatgtgcagagaggccggcctgtggagcgagtggagccagcccatctacgtgggcttcagcagatag

SEQ ID NO: 85655 - DNA, 453 bp, Artificial Sequence
  Description of Artificial Sequence: Synthetic coding sequence
atgaccaacgccttcatcagcatcatcgacgacctgagcaagtacgacgtgcaggtgagagccgccgtgagcagcatgtgcagagaggccggcctgtggagcgagtggagccagcccatctacgtgggcaacgacgagcacaagcccctgagagagtggttcgtgatcgtgatcatggccaccatctgcttcatcctgctgatcctgagcctgatctgcaagatctgccacctgtggatcaagctgttcccccccatccccgcccccaagagcaacatcaaggacctgttcgtgaccaccaactacgaggtgctgtgcatcttcatctacatcctggacagcgccgacaacttcctgcagaagaagaaggccggcagcagcgagaccgagatcgaggtgatctgctacatcgagaagcccggcgtggagaccctggaggacagcgtgttctag

SEQ ID NO: 85656 - DNA, 1008 bp, Artificial Sequence; identical to SEQ ID NO: 85654
  Description of Artificial Sequence: Synthetic coding sequence

SEQ ID NO: 85657 - DNA, 978 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctggttccccagaaccttcatcctgagcaagggcagagactggctggccgtgctggtgaacggcagcagcaagcacagcgccatcagacccttcgaccagctgttcgccctgcacgccatcggcaacgacgagcacaagcccctgagagagtggttcgtgatcgtgatcatggccaccatctgcttcatcctgctgatcctgagcctgatctgcaagatctgccacctgtggatcaagctgttcccccccatccccgcccccaagagcaacatcaaggacctgttcgtgaccaccaactacgagaaggccggcagcagcgagaccgagatcgaggtgatctgctacatcgagaagcccggcgtggagaccctggaggacagcgtgttctag

SEQ ID NO: 85658 - DNA, 330 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctgtag

SEQ ID NO: 85659 - DNA, 1002 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctggttccccagaaccttcatcctgagcaagggcagagactggctggccgtgctggtgaacggcagcagcaagcacagcgccatcagacccttcgaccagctgttcgccctgcacgccatcgaccagatcaacccccccctgaacgtgaccgccgagatcgagggcaccagactgagcatccagtgggagaagcccgtgagcgccttccccatccactgcttcgactacgaggtgaagatccacaacaccagaaacggctacctgcagatcgagaagctgatgaccaacgccttcatcagcatcatcgacgacctgagcaagtacgacgtgcaggtgagagccgccgtgagcagcatgtgcagagaggccggcctgtggagcgagtggagccagcccatctacgtgggcaagtag

SEQ ID NO: 85660 - DNA, 1137 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctggttccccagaaccttcatcctgagcaagggcagagactggctggccgtgctggtgaacggcagcagcaagcacagcgccatcagacccttcgaccagctgttcgccctgcacgccatcgaccagatcaacccccccctgaacgtgaccgccgagatcgagggcaccagactgagcatccagtgggagaagcccgtgagcgccttccccatccactgcttcgactacgaggtgaagatccacaacaccagaaacggctacctgcagatcgagaagctgatgaccaacgccttcatcagcatcatcgacgacctgagcaagtacgacgtgcaggtgagagccgccgtgagcagcatgtgcagagaggccggcctgtggagcgagtggagccagcccatctacgtgggcaacgacgagcacaagcccctgagagagtggttcgtgatcgtgatcatggccaccatctgcttcatcctgctgatcctgagcctgatctgcaagatcaagctgggccccgtgagaagaaagctgaagagcagcgtgatctag

SEQ ID NO: 85661 - DNA, 591 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcagccccggcaccagcatcgtgaacctgacctgcaccaccaacaccaccgaggacaactacagcagactgagaagctaccaggtgagcctgcactgcacctggctggtgggcaccgacgcccccgaggacacccagtacttcctgtactacagatacggcagctggaccgaggagtgccaggagtacagcaaggacaccctgggcagaaacatcgcctgctag

SEQ ID NO: 85662 - DNA, 636 bp, Artificial Sequence
  Description of Artificial Sequence: Synthetic coding sequence
atgatcatcgtggcccacgtgctgctgatcctgctgggcgccaccgagatcctgcaggccgacctgctgcccgacgagaagatcagcctgctgccccccgtgaacttcaccatcaaggtgaccggcctggcccaggtgctgctgcagtggaagcccaaccccgaccaggagcagagaaacgtgaacctggagtaccaggtgaagatcaacgcccccaaggaggacgactacgagaccagaatcaccgagagcaagtgcgtgaccatcctgcacaagggcttcagcgccagcgtgagaaccatcctgcagaacgaccacagcctgctggccagcagctgggccagcgccgagctgcacgccccccccggcaacgacgagcacaagcccctgagagagtggttcgtgatcgtgatcatggccaccatctgcttcatcctgctgatcctgagcctgatctgcaagatctgccacctgtggatcaagctgttcccccccatccccgcccccaagagcaacatcaaggacctgttcgtgaccaccaactacgagaaggccggcagcagcgagaccgagatcgaggtgatctgctacatcgagaagcccggcgtggagaccctggaggacagcgtgttctag

SEQ ID NO: 85663 - DNA, 1263 bp, Artificial Sequence; identical to SEQ ID NO: 85653
  Description of Artificial Sequence: Synthetic coding sequence

SEQ ID NO: 85664 - DNA, 1002 bp, Artificial Sequence; identical to SEQ ID NO: 85659
  Description of Artificial Sequence: Synthetic coding sequence

SEQ ID NO: 85665 - DNA, 1098 bp, Artificial Sequence
  Description of Artificial Sequence: Synthetic coding sequence
atgctggccgtgggctgcgccctgctggccgccctgctggccgcccccggcgccgccctggcccccagaagatgccccgcccaggaggtggccagaggcgtgctgaccagcctgcccggcgacagcgtgaccctgacctgccccggcgtggagcccgaggacaacgccaccgtgcactgggtgctgagaaagcccgccgccggcagccaccccagcagatgggccggcatgggcagaagactgctgctgagaagcgtgcagctgcacgacagcggcaactacagctgctacagagccggcagacccgccggcaccgtgcacctgctggtggacgtgccccccgaggagccccagctgagctgcttcagaaagagccccctgagcaacgtggtgtgcgagtggggccccagaagcacccccagcctgaccaccaaggccgtgctgctggtgagaaagttccagaacagccccgccgaggacttccaggagccctgccagtacagccaggagagccagaagttcagctgccagctggccgtgcccgagggcgacagcagcttctacatcgtgagcatgtgcgtggccagcagcgtgggcagcaagttcagcaagacccagaccttccagggctgcggcatcctgcagcccgacccccccgccaacatcaccgtgaccgccgtggccagaaaccccagatggctgagcgtgacctggcaggacccccacagctggaacagcagcttctacagactgagattcgagctgagatacagagccgagagaagcaagaccttcaccacctggatggtgaaggacctgcagcaccactgcgtgatccacgacgcctggagcggcctgagacacgtggtgcagctgagagcccaggaggagttcggccagggcgagtggagcgagtggagccccgaggccatgggcaccccctggaccgagagcagaagcccccccgccgagaacgaggtgagcacccccatgcaggccctgaccaccaacaaggacgacgacaacatcctgttcagagacagcgccaacgccaccagcctgcccggcagcagaagaagaggcagctgcggcctgtag

SEQ ID NO: 85666 - DNA, 1407 bp, Artificial Sequence
  Description of Artificial Sequence: Synthetic coding sequence
atgctggccgtgggctgcgccctgctggccgccctgctggccgcccccggcgccgccctggcccccagaagatgccccgcccaggaggtggccagaggcgtgctgaccagcctgcccggcgacagcgtgaccctgacctgccccggcgtggagcccgaggacaacgccaccgtgcactgggtgctgagaaagcccgccgccggcagccaccccagcagatgggccggcatgggcagaagactgctgctgagaagcgtgcagctgcacgacagcggcaactacagctgctacagagccggcagacccgccggcaccgtgcacctgctggtggacgtgccccccgaggagccccagctgagctgcttcagaaagagccccctgagcaacgtggtgtgcgagtggggccccagaagcacccccagcctgaccaccaaggccgtgctgctggtgagaaagttccagaacagccccgccgaggacttccaggagccctgccagtacagccaggagagccagaagttcagctgccagctggccgtgcccgagggcgacagcagcttctacatcgtgagcatgtgcgtggccagcagcgtgggcagcaagttcagcaagacccagaccttccagggctgcggcatcctgcagcccgacccccccgccaacatcaccgtgaccgccgtggccagaaaccccagatggctgagcgtgacctggcaggacccccacagctggaacagcagcttctacagactgagattcgagctgagatacagagccgagagaagcaagaccttcaccacctggatggtgaaggacctgcagcaccactgcgtgatccacgacgcctggagcggcctgagacacgtggtgcagctgagagcccaggaggagttcggccagggcgagtggagcgagtggagccccgaggccatgggcaccccctggaccgagagcagaagcccccccgccgagaacgaggtgagcacccccatgcaggccctgaccaccaacaaggacgacgacaacatcctgttcagagacagcgccaacgccaccagcctgcccgtgcaggacagcagcagcgtgcccctgcccaccttcctggtggccggcggcagcctggccttcggcaccctgctgtgcatcgccatcgtgctgagattcaagaagacctggaagctgagagccctgaaggagggcaagaccagcatgcaccccccctacagcctgggccagctggtgcccgagagacccagacccacccccgtgctggtgcccctgatcagcccccccgtgagccccagcagcctgggcagcgacaacaccagcagccacaacagacccgacgccagagaccccagaagcccctacgacatcagcaacaccgactacttcttccccagatag

SEQ ID NO: 85667 - DNA, 2757 bp, Artificial Sequence
  Description of Artificial Sequence: Synthetic coding sequence
atgctgaccctgcagacctggctggtgcaggccctgttcatcttcctgaccaccgagagcaccggcgagctgctggacccctgcggctacatcagccccgagagccccgtggtgcagctgcacagcaacttcaccgccgtgtgcgtgctgaaggagaagtgcatggactacttccacgtgaacgccaactacatcgtgtggaagaccaaccacttcaccatccccaaggagcagtacaccatcatcaacagaaccgccagcagcgtgaccttcaccgacatcgccagcctgaacatccagctgacctgcaacatcctgaccttcggccagctggagcagaacgtgtacggcatcaccatcatcagcggcctgccccccgagaagcccaagaacctgagctgcatcgtgaacgagggcaagaagatgagatgcgagtgggacggcggcagagagacccacctggagaccaacttcaccctgaagagcgagtgggccacccacaagttcgccgactgcaaggccaagagagacacccccaccagctgcaccgtggactacagcaccgtgtacttcgtgaacatcgaggtgtgggtggaggccgagaacgccctgggcaaggtgaccagcgaccacatcaacttcgaccccgtgtacaaggtgaagcccaaccccccccacaacctgagcgtgatcaacagcgaggagctgagcagcatcctgaagctgacctggaccaaccccagcatcaagagcgtgatcatcctgaagtacaacatccagtacagaaccaaggacgccagcacctggagccagatcccccccgaggacaccgccagcaccagaagcagcttcaccgtgcaggacctgaagcccttcaccgagtacgtgttcagaatcagatgcatgaaggaggacggcaagggctactggagcgactggagcgaggaggccagcggcatcacctacgaggacagacccagcaaggcccccagcttctggtacaagatcgaccccagccacacccagggctacagaaccgtgcagctggtgtggaagaccctgccccccttcgaggccaacggcaagatcctggactacgaggtgaccctgaccagatggaagagccacctgcagaactacaccgtgaacgccaccaagctgaccgtgaacctgaccaacgacagatacctggccaccctgaccgtgagaaacctggtgggcaagagcgacgccgccgtgctgaccatccccgcctgcgacttccaggccacccaccccgtgatggacctgaaggccttccccaaggacaacatgctgtgggtggagtggaccacccccagagagagcgtgaagaagtacatcctggagtggtgcgtgctgagcgacaaggccccctgcatcaccgactggcagcaggaggacggcaccgtgcacagaacctacctgagaggcaacctggccgagagcaagtgctacctgatcaccgtgacccccgtgtacgccgacggccccggcagccccgagagcatcaaggcctacctgaagcaggccccccccagcaagggccccaccgtgagaaccaagaaggtgggcaagaacgaggccgtgctggagtgggaccagctgcccgtggacgtgcagaacggcttcatcagaaactacaccatcttctacagaaccatcatcggcaacgagaccgccgtgaacgtggacagcagccacaccgagtacaccctgagcagcctgaccagcgacaccctgtacatggtgagaatggccgcctacaccgacgagggcggcaaggacggccccgagttcaccttcaccacccccaagttcgcccagggcgagatcgaggccatcgtggtgcccgtgtgcctggccttcctgctgaccaccctgctgggcgtgctgttctgcttcaacaagagagacctgatcaagaagcacatctggcccaacgtgcccgaccccagcaagagccacatcgcccagtggagcccccacaccccccccagacacaacttcaacagcaaggaccagatgtacagcgacggcaacttcaccgacgtgagcgtggtggagatcgaggccaacgacaagaagcccttccccgaggacctgaagagcctggacctgttcaagaaggagaagatcaacaccgagggccacagcagcggcatcggcggcagcagctgcatgagcagcagcagacccagcatcagcagcagcgacgagaacgagagcagccagaacaccagcagcaccgtgcagtacagcaccgtggtgcacagcggctacagacaccaggtgcccagcgtgcaggtgttcagcagaagcgagagcacccagcccctgctggacagcgaggagagacccgaggacctgcagctggtggaccacgtggacggcggcgacggcatcctgcccagacagcagtacttcaagcagaactgcagccagcacgagagcagccccgacatcagccacttcgagagaagcaagcaggtgagcagcgtgaacgaggaggacttcgtgagactgaagcagcagatcagcgaccacatcagccagagctgcggcagcggccagatgaagatgttccaggaggtgagcgccgccgacgccttcggccccggcaccgagggccaggtggagagattcgagaccgtgggcatggaggccgccaccgacgagggcatgcccaagagctacctgccccagaccgtgagacagggcggctacatgccccagtag

SEQ ID NO: 85668 - DNA, 990 bp, Artificial Sequence
  Description of Artificial Sequence: Synthetic coding sequence
atgctgaccctgcagacctggctggtgcaggccctgttcatcttcctgaccaccgagagcaccggcgagctgctggacccctgcggctacatcagccccgagagccccgtggtgcagctgcacagcaacttcaccgccgtgtgcgtgctgaaggagaagtgcatggactacttccacgtgaacgccaactacatcgtgtggaagaccaaccacttcaccatccccaaggagcagtacaccatcatcaacagaaccgccagcagcgtgaccttcaccgacatcgccagcctgaacatccagctgacctgcaacatcctgaccttcggccagctggagcagaacgtgtacggcatcaccatcatcagcggcctgccccccgagaagcccaagaacctgagctgcatcgtgaacgagggcaagaagatgagatgcgagtgggacggcggcagagagacccacctggagaccaacttcaccctgaagagcgagtgggccacccacaagttcgccgactgcaaggccaagagagacacccccaccagctgcaccgtggactacagcaccgtgtacttcgtgaacatcgaggtgtgggtggaggccgagaacgccctgggcaaggtgaccagcgaccacatcaacttcgaccccgtgtacaaggtgaagcccaaccccccccacaacctgagcgtgatcaacagcgaggagctgagcagcatcctgaagctgacctggaccaaccccagcatcaagagcgtgatcatcctgaagtacaacatccagtacagaaccaaggacgccagcacctggagccagatcccccccgaggacaccgccagcaccagaagcagcttcaccgtgcaggacctgaagcccttcaccgagtacgtgttcagaatcagatgcatgaaggaggacggcaagggctactggagcgactggagcgaggaggccagcggcatcacctacgaggacaacatcgccagcttctag

SEQ ID NO: 85669 - DNA, 2574 bp, Artificial Sequence
  Description of Artificial Sequence: Synthetic coding sequence
atgctgaccctgcagacctggctggtgcaggccctgttcatcttcctgaccaccgagagcaccggcgagctgctggacccctgcggctacatcagccccgagagccccgtggtgcagctgcacagcaacttcaccgccgtgtgcgtgctgaaggagaagtgcatggactacttccacgtgaacgccaactacatcgtgtggaagaccaaccacttcaccatccccaaggagcagtacaccatcatcaacagaaccgccagcagcgtgaccttcaccgacatcgccagcctgaacatccagctgacctgcaacatcctgaccttcggccagctggagcagaacgtgtacggcatcaccatcatcagcggcctgccccccgagaagcccaagaacctgagctgcatcgtgaacgagggcaagaagatgagatgcgagtgggacggcggcagagagacccacctggagaccaacttcaccctgaagagcgagtgggccacccacaagttcgccgactgcaaggccaagagagacacccccaccagctgcaccgtggactacagcaccgtgtacttcgtgaacatcgaggtgtgggtggaggccgagaacgccctgggcaaggtgaccagcgaccacatcaacttcgaccccgtgtacaaggtgaagcccaaccccccccacaacctgagcgtgatcaacagcgaggagctgagcagcatcctgaagctgacctggaccaaccccagcatcaagagcgtgatcatcctgaagtacaacatccagtacagaaccaaggacgccagcacctggagccagatcccccccgaggacaccgccagcaccagaagcagcttcaccgtgcaggacctgaagcccttcaccgagtacgtgttcagaatcagatgcatgaaggaggacggcaagggctactggagcgactggagcgaggaggccagcggcatcacctacgaggacagacccagcaaggcccccagcttctggtacaagatcgaccccagccacacccagggctacagaaccgtgcagctggtgtggaagaccctgccccccttcgaggccaacggcaagatcctggactacgaggtgaccctgaccagatggaagagccacctgcagaactacaccgtgaacgccaccaagctgaccgtgaacctgaccaacgacagatacctggccaccctgaccgtgagaaacctggtgggcaagagcgacgccgccgtgctgaccatccccgcctgcgacttccagggcaacctggccgagagcaagtgctacctgatcaccgtgacccccgtgtacgccgacggccccggcagccccgagagcatcaaggcctacctgaagcaggccccccccagcaagggccccaccgtgagaaccaagaaggtgggcaagaacgaggccgtgctggagtgggaccagctgcccgtggacgtgcagaacggcttcatcagaaactacaccatcttctacagaaccatcatcggcaacgagaccgccgtgaacgtggacagcagccacaccgagtacaccctgagcagcctgaccagcgacaccctgtacatggtgagaatggccgcctacaccgacgagggcggcaaggacggccccgagttcaccttcaccacccccaagttcgcccagggcgagatcgaggccatcgtggtgcccgtgtgcctggccttcctgctgaccaccctgctgggcgtgctgttctgcttcaacaagagagacctgatcaagaagcacatctggcccaacgtgcccgaccccagcaagagccacatcgcccagtggagcccccacaccccccccagacacaacttcaacagcaaggaccagatgtacagcgacggcaacttcaccgacgtgagcgtggtggagatcgaggccaacgacaagaagcccttccccgaggacctgaagagcctggacctgttcaagaaggagaagatcaacaccgagggccacagcagcggcatcggcggcagcagctgcatgagcagcagcagacccagcatcagcagcagcgacgagaacgagagcagccagaacaccagcagcaccgtgcagtacagcaccgtggtgcacagcggctacagacaccaggtgcccagcgtgcaggtgttcagcagaagcgagagcacccagcccctgctggacagcgaggagagacccgaggacctgcagctggtggaccacgtggacggcggcgacggcatcctgcccagacagcagtacttcaagcagaactgcagccagcacgagagcagccccgacatcagccacttcgagagaagcaagcaggtgagcagcgtgaacgaggaggacttcgtgagactgaagcagcagatcagcgaccacatcagccagagctgcggcagcggccagatgaagatgttccaggaggtgagcgccgccgacgccttcggccccggcaccgagggccaggtggagagattcgagaccgtgggcatggaggccgccaccgacgagggcatgcccaagagctacctgccccagaccgtgagacagggcggctacatgccccagtag

SEQ ID NO: 85670 - DNA, 2757 bp, Artificial Sequence; identical to SEQ ID NO: 85667
  Description of Artificial Sequence: Synthetic coding sequence

SEQ ID NO: 85671 - DNA, 990 bp, Artificial Sequence; identical to SEQ ID NO: 85668
  Description of Artificial Sequence: Synthetic coding sequence

SEQ ID NO: 85672 - DNA, 990 bp, Artificial Sequence; identical to SEQ ID NO: 85668
  Description of Artificial Sequence: Synthetic coding sequence

SEQ ID NO: 85673 - DNA, 990 bp, Artificial Sequence
  Description of Artificial Sequence: Synthetic coding sequence
atgctgaccctgcagacctggctggtgcaggccctgttcatcttcctgaccaccgagagcaccggcgagctgctggacccctgcggctacatcagccccgagagccccgtggtgcagctgcacagcaacttcaccgccgtgtgcgtgctgaaggagaagtgcatggactacttccacgtgaacgccaactacatcgtgtggaagaccaaccacttcaccatccccaaggagcagtacaccatcatcaacagaaccgccagcagcgtgaccttcaccgacatcgccagcctgaacatccagctgacctgcaacatcctgaccttcggccagctggagcagaacgtgtacggcatcaccatcatcagcggcctgccccccgagaagcccaagaacctgagctgcatcgtgaacgagggcaagaagatgagatgcgagtgggacggcggcagagagacccacctggagaccaacttcaccctgaagagcgagtgggccacccacaagttcgccgactgcaaggccaagagagacacccccaccagctgcaccgtggactacagcaccgtgtacttcgtgaacatcgaggtgtgggtggaggccgagaacgccctgggcaaggtgaccagcgaccacatcaacttcgaccccgtgtacaaggtgaagcccaaccccccccacaacctgagcgtgatcaacagcgaggagctgagcagcatcctgaagctgacctggaccaaccccagcatcaagagcgtgatcatcctgaagtacaacatccagtacagaaccaaggacgccagcacctggagccagatcccccccgaggacaccgccagcaccagaagcagcttcaccgtgcaggacctgaagcccttcaccgagtacgtgttcagaatcagatgcatgaaggaggacggcaagggctactggagcgactggagcgaggaggccagcggcatcacctacgaggacaccatcttcagcttctag

SEQ ID NO: 85674 - DNA, 1380 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttcgaggaccccgacgtgaacatcaccaacctggagttcgagatctgcggcgccctggtggaggtgaagtgcctgaacttcagaaagctgcaggagatctacttcatcgagaccaagaagttcctgctgatcggcaagagcaacatctgcgtgaaggtgggcgagaagagcctgacctgcaagaagatcgacctgaccaccatcgtgaagcccgaggcccccttcgacctgagcgtggtgtacagagagggcgccaacgacttcgtggtgaccttcaacaccagccacctgcagaagaagtacgtgaaggtgctgatgcacgacgtggcctacagacaggagaaggacgagaacaagtggacccacgtgaacctgagcagcaccaagctgaccctgctgcagagaaagctgcagcccgccgccatgtacgagatcaaggtgagaagcatccccgaccactacttcaagggcttctggagcgagtggagccccagctactacttcagaacccccgagatcaacaacagcagcggcgagatggaccccatcctgctgaccatcagcatcctgagcttcttcagcgtggccctgctggtgatcctggcctgcgtgctgtggaagaagagaatcaagcccatcgtgtggcccagcctgcccgaccacaagaagaccctggagcacctgtgcaagaagcccagaaagaacctgaacgtgagcttcaaccccgagagcttcctggactgccagatccacagagtggacgacatccaggccagagacgaggtggagggcttcctgcaggacaccttcccccagcagctggaggagagcgagaagcagagactgggcggcgacgtgcagagccccaactgccccagcgaggacgtggtgatcacccccgagagcttcggcagagacagcagcctgacctgcctggccggcaacgtgagcgcctgcgacgcccccatcctgagcagcagcagaagcctggactgcagagagagcggcaagaacggcccccacgtgtaccaggacctgctgctgagcctgggcaccaccaacagcaccctgcccccccccttcagcctgcagagcggcatcctgaccctgaaccccgtggcccagggccagcccatcctgaccagcctgggcagcaaccaggaggaggcctacgtgaccatgagcagcttctaccagaaccagtag

SEQ ID NO: 85675 - DNA, 789 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttcgaggaccccgacgtgaacatcaccaacctggagttcgagatctgcggcgccctggtggaggtgaagtgcctgaacttcagaaagctgcaggagatctacttcatcgagaccaagaagttcctgctgatcggcaagagcaacatctgcgtgaaggtgggcgagaagagcctgacctgcaagaagatcgacctgaccaccatcgtgaagcccgaggcccccttcgacctgagcgtggtgtacagagagggcgccaacgacttcgtggtgaccttcaacaccagccacctgcagaagaagtacgtgaaggtgctgatgcacgacgtggcctacagacaggagaaggacgagaacaagtggacccacgtgaacctgagcagcaccaagctgaccctgctgcagagaaagctgcagcccgccgccatgtacgagatcaaggtgagaagcatccccgaccactacttcaagggcttctggagcgagtggagccccagctactacttcagaacccccgagatcaacaacagcagcggcctgagcctgagctacggccccgtgagccccatcatcagaagactgtggaacatcttcgtgagaaaccaggagaagatctag

SEQ ID NO: 85676 - DNA, 786 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttcgaggaccccgacgtgaacatcaccaacctggagttcgagatctgcggcgccctggtggaggtgaagtgcctgaacttcagaaagctgcaggagatctacttcatcgagaccaagaagttcctgctgatcggcaagagcaacatctgcgtgaaggtgggcgagaagagcctgacctgcaagaagatcgacctgaccaccatcgtgaagcccgaggcccccttcgacctgagcgtggtgtacagagagggcgccaacgacttcgtggtgaccttcaacaccagccacctgcagaagaagtacgtgaaggtgctgatgcacgacgtggcctacagacaggagaaggacgagaacaagtggacccacgtgaacctgagcagcaccaagctgaccctgctgcagagaaagctgcagcccgccgccatgtacgagatcaaggtgagaagcatccccgaccactacttcaagggcttctggagcgagtggagccccagctactacttcagaacccccgagatcaacaacagcagcggcctgagcctgagctacggccccgtgagccccatcatcagaagactgtggaacatcttcgtgagaaaccaggagaagtag

SEQ ID NO: 85677 - DNA, 180 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagcacagcctgacctgcgccttctag

SEQ ID NO: 85678 - DNA, 159 bp, Artificial Sequence
  Description of Artificial Sequence: Synthetic coding sequence
atgaccatcctgggcaccaccttcggcatggtgttcagcctgctgcaggtggtgagcggcgagagcggctacgcccagaacggcgacctggaggacgccgagctggacgactacagcttcagctgctacagccagctggaggtgaacggcagccagtag

SEQ ID NO: 85679 - DNA, 1566 bp, Artificial Sequence
  Description of Artificial Sequence: Synthetic coding sequence
atgggcctgggcagatgcatctgggagggctggaccctggagagcgaggccctgagaagagacatgggcacctggctgctggcctgcatctgcatctgcacctgcgtgtgcctgggcgtgagcgtgaccggcgagggccagggccccagaagcagaaccttcacctgcctgaccaacaacatcctgagaatcgactgccactggagcgcccccgagctgggccagggcagcagcccctggctgctgttcaccagcaaccaggcccccggcggcacccacaagtgcatcctgagaggcagcgagtgcaccgtggtgctgccccccgaggccgtgctggtgcccagcgacaacttcaccatcaccttccaccactgcatgagcggcagagagcaggtgagcctggtggaccccgagtacctgcccagaagacacgtgaagctggacccccccagcgacctgcagagcaacatcagcagcggccactgcatcctgacctggagcatcagccccgccctggagcccatgaccaccctgctgagctacgagctggccttcaagaagcaggaggaggcctgggagcaggcccagcacagagaccacatcgtgggcgtgacctggctgatcctggaggccttcgagctggaccccggcttcatccacgaggccagactgagagtgcagatggccaccctggaggacgacgtggtggaggaggagagatacaccggccagtggagcgagtggagccagcccgtgtgcttccaggccccccagagacagggccccctgatccccccctggggctggcccggcaacaccctggtggccgtgagcatcttcctgctgctgaccggccccacctacctgctgttcaagctgagccccagagtgaagagaatcttctaccagaacgtgcccagccccgccatgttcttccagcccctgtacagcgtgcacaacggcaacttccagacctggatgggcgcccacggcgccggcgtgctgctgagccaggactgcgccggcaccccccagggcgccctggagccctgcgtgcaggaggccaccgccctgctgacctgcggccccgccagaccctggaagagcgtggccctggaggaggagcaggagggccccggcaccagactgcccggcaacctgagcagcgaggacgtgctgcccgccggctgcaccgagtggagagtgcagaccctggcctacctgccccaggaggactgggcccccaccagcctgaccagacccgccccccccgacagcgagggcagcagaagcagcagcagcagcagcagcagcaacaacaacaactactgcgccctgggctgctacggcggctggcacctgagcgccctgcccggcaacacccagagcagcggccccatccccgccctggcctgcggcctgagctgcgaccaccagggcctggagacccagcagggcgtggcctgggtgctggccggccactgccagagacccggcctgcacgaggacctgcagggcatgctgctgcccagcgtgctgagcaaggccagaagctggaccttctag

SEQ ID NO: 85680 - DNA, 1029 bp, Artificial Sequence
  Description of Artificial Sequence: Synthetic coding sequence
atgccccagacctgcgacggcaccggccagatgcacctgggcagcaactgctgcaagaacggccagaccctgctgcagagaacctgccacggcgtgagctgctgcggctggtggttccaggccgccagaagcatcctgggcaagggccccagcgcccagagcctggccggctggaccctggagagcgaggccctgagaagagacatgggcacctggctgctggcctgcatctgcatctgcacctgcgtgtgcctgggcgtgagcgtgaccggcgagggccagggccccagaagcagaaccttcacctgcctgaccaacaacatcctgagaatcgactgccactggagcgcccccgagctgggccagggcagcagcccctggctgctgttcaccagactgctggccgcccacatcagcgccagctgcggcgccgtgagcgcccccagctgctgccacctgagacagtgcagctgccacctgaccatcagccccagcctgagcaccaccgcctgcctgggcggcagcagaagcgcctggtggaccagaagcacctgccccggcgacaccagcaacatcagcagcggccactgcatcctgacctggagcatcagccccgccctggagcccatgaccaccctgctgagctacgagctggccttcaagaagcaggaggaggcctgggagcaggcccagcacagagaccacatcgtgggcgtgacctggctgatcctggaggccttcgagctggaccccggcttcatccacgaggccagactgagagtgcagatggccaccctggaggacgacgtggtggaggaggagagatacaccggccagtggagcgagtggagccagcccgtgtgcttccaggccccccagagacagggccccctgatccccccctggggctggcccggcaacaccctggtggccgtgagcatcttcctgctgctgaccggccccacctacctgctgttcaagctgagccccagactgggctggggccccaccggccccgtgtgctgctag

SEQ ID NO: 85681 - DNA, 1503 bp, Artificial Sequence
  Description of Artificial Sequence: Synthetic coding sequence
atgggcacctggctgctggcctgcatctgcatctgcacctgcgtgtgcctgggcgtgagcgtgaccggcgagggccagggccccagaagcagaaccttcacctgcctgaccaacaacatcctgagaatcgactgccactggagcgcccccgagctgggccagggcagcagcccctggctgctgttcaccagcaaccaggcccccggcggcacccacaagtgcatcctgagaggcagcgagtgcaccgtggtgctgccccccgaggccgtgctggtgcccagcgacaacttcaccatcaccttccaccactgcatgagcggcagagagcaggtgagcctggtggaccccgagtacctgcccagaagacacgtgaagctggacccccccagcgacctgcagagcaacatcagcagcggccactgcatcctgacctggagcatcagccccgccctggagcccatgaccaccctgctgagctacgagctggccttcaagaagcaggaggaggcctgggagcaggcccagcacagagaccacatcgtgggcgtgacctggctgatcctggaggccttcgagctggaccccggcttcatccacgaggccagactgagagtgcagatggccaccctggaggacgacgtggtggaggaggagagatacaccggccagtggagcgagtggagccagcccgtgtgcttccaggccccccagagacagggccccctgatccccccctggggctggcccggcaacaccctggtggccgtgagcatcttcctgctgctgaccggccccacctacctgctgttcaagctgagccccagagtgaagagaatcttctaccagaacgtgcccagccccgccatgttcttccagcccctgtacagcgtgcacaacggcaacttccagacctggatgggcgcccacggcgccggcgtgctgctgagccaggactgcgccggcaccccccagggcgccctggagccctgcgtgcaggaggccaccgccctgctgacctgcggccccgccagaccctggaagagcgtggccctggaggaggagcaggagggccccggcaccagactgcccggcaacctgagcagcgaggacgtgctgcccgccggctgcaccgagtggagagtgcagaccctggcctacctgccccaggaggactgggcccccaccagcctgaccagacccgccccccccgacagcgagggcagcagaagcagcagcagcagcagcagcagcaacaacaacaactactgcgccctgggctgctacggcggctggcacctgagcgccctgcccggcaacacccagagcagcggccccatccccgccctggcctgcggcctgagctgcgaccaccagggcctggagacccagcagggcgtggcctgggtgctggccggccactgccagagacccggcctgcacgaggacctgcagggcatgctgctgcccagcgtgctgagcaaggccagaagctggaccttctag

SEQ ID NO: 85682 - DNA, 990 bp, Artificial Sequence
  Description of Artificial Sequence: Synthetic coding sequence
atgggcacctggctgctggcctgcatctgcatctgcacctgcgtgtgcctgggcgtgagcgtgaccggcgagggccagggccccagaagcagaaccttcacctgcctgaccaacaacatcctgagaatcgactgccactggagcgcccccgagctgggccagggcagcagcccctggctgctgttcaccagcaaccaggcccccggcggcacccacaagtgcatcctgagaggcagcgagtgcaccgtggtgctgccccccgaggccgtgctggtgcccagcgacaacttcaccatcaccttccaccactgcatgagcggcagagagcaggtgagcctggtggaccccgagtacctgcccagaagacacgtgaagctggacccccccagcgacctgcagagcaacatcagcagcggccactgcatcctgacctggagcatcagccccgccctggagcccatgaccaccctgctgagctacgagctggccttcaagaagcaggaggaggcctgggagcaggcccagcacagagaccacatcgtgggcgtgacctggctgatcctggaggccttcgagctggaccccggcttcatccacgaggccagactgagagtgcagatggccaccctggaggacgacgtggtggaggaggagagatacaccggccagtggagcgagtggagccagcccgtgtgcttccaggccccccagagacagggccccctgatccccccctggggctggcccggcaacaccctggtggccgtgagcatcttcctgctgctgaccggccccacctacctgctgttcaagctgagccccagagtgaagagaatcttctaccagaacgtgcccagccccgccatgttcttccagcccctgtacagcgtgcacaacggcaacttccaggtgtgcgccgagaccaccgagggccacggcggccagggcctgcccagagccctggcctgccccagatgctggctgagctag

SEQ ID NO: 85683 - DNA, 999 bp, Artificial Sequence
  Description of Artificial Sequence: Synthetic coding sequence
atgcacctgggcagcaactgctgcaagaacggccagaccctgctgcagagaacctgccacggcgtgagctgctgcggctggtggttccaggccgccagaagcatcctgggcaagggccccagcgcccagagcctggccggctggaccctggagagcgaggccctgagaagagacatgggcacctggctgctggcctgcatctgcatctgcacctgcgtgtgcctgggcgtgagcgtgaccggcgagggccagggccccagaagcagaaccttcacctgcctgaccaacaacatcctgagaatcgactgccactggagcgcccccgagctgggccagggcagcagcccctggctgctgttcaccagactgctggccgcccacatcagcgccagctgcggcgccgtgagcgcccccagctgctgccacctgagacagtgcagctgccacctgaccatcagccccagcctgagcaccaccgcctgcctgggcggcagcagaagcgcctggtggaccagaagcacctgccccggcgacaccagcaacatcagcagcggccactgcatcctgacctggagcatcagccccgccctggagcccatgaccaccctgctgagctacgagctggccttcaagaagcaggaggaggcctgggagcaggcccagcacagagaccacatcgtgggcgtgacctggctgatcctggaggccttcgagctggaccccggcttcatccacgaggccagactgagagtgcagatggccaccctggaggacgacgtggtggaggaggagagatacaccggccagtggagcgagtggagccagcccgtgtgcttccaggccccccagagacagggccccctgatccccccctggggctggcccggcaacaccctggtggccgtgagcatcttcctgctgctgaccggccccacctacctgctgttcaagctgagccccagactgggctggggccccaccggccccgtgtgctgctag

SEQ ID NO: 85684 - DNA, 1878 bp, Artificial Sequence
  Description of Artificial Sequence: Synthetic coding sequence
atggcctgctacatctaccagctgcccagctgggtgctggacgacctgtgcagaaacatggacgccctgagcgagtgggactggatggagttcgccagctacgtgatcaccgacctgacccagctgagaaagatcaagagcatggagagagtgcagggcgtgagcatcaccagagagctgctgtggtggtggggcatgagacaggccaccgtgcagcagctggtggacctgctgtgcagactggagctgtacagagccgcccagatcatcctgaactggaagcccgcccccgagatcagatgccccatccccgccttccccgacagcgtgaagcccgagaagcccctggccgccagcgtgagaaaggccgaggacgagcaggaggagggccagcccgtgagaatggccaccttccccggccccggcagcagccccgccagagcccaccagcccgccttcctgcagccccccgaggaggacgccccccacagcctgagaagcgacctgcccaccagcagcgacagcaaggacttcagcaccagcatccccaagcaggagaagctgctgagcctggccggcgacagcctgttctggagcgaggccgacgtggtgcaggccaccgacgacttcaaccagaacagaaagatcagccagggcaccttcgccgacgtgtacagaggccacagacacggcaagcccttcgtgttcaagaagctgagagagaccgcctgcagcagccccggcagcatcgagagattcttccaggccgagctgcagatctgcctgagatgctgccaccccaacgtgctgcccgtgctgggcttctgcgccgccagacagttccacagcttcatctacccctacatggccaacggcagcctgcaggacagactgcagggccagggcggcagcgaccccctgccctggccccagagagtgagcatctgcagcggcctgctgtgcgccgtggagtacctgcacggcctggagatcatccacagcaacgtgaagagcagcaacgtgctgctggaccagaacctgacccccaagctggcccaccccatggcccacctgtgccccgtgaacaagagaagcaagtacaccatgatgaagacccacctgctgagaaccagcgccgcctacctgcccgaggacttcatcagagtgggccagctgaccaagagagtggacatcttcagctgcggcatcgtgctggccgaggtgctgaccggcatccccgccatggacaacaacagaagccccgtgtacctgaaggacctgctgctgagcgacatccccagcagcaccgccagcctgtgcagcagaaagaccggcgtggagaacgtgatggccaaggagatctgccagaagtacctggagaagggcgccggcagactgcccgaggactgcgccgaggccctggccaccgccgcctgcctgtgcctgagaagaagaaacaccagcctgcaggaggtgtgcggcagcgtggccgccgtggaggagagactgagaggcagagagaccctgctgccctggagcggcctgagcgagggcaccggcagcagcagcaacacccccgaggagaccgacgacgtggacaacagcagcctggacgccagcagcagcatgagcgtggccccctgggccggcgccgccacccccctgctgcccaccgagaacggcgagggcagactgagagtgatcgtgggcagagaggccgacagcagcagcgaggcctgcgtgggcctggagcccccccaggacgtgaccgagaccagctggcagatcgagatcaacgaggccaagagaaagctgatggagaacatcctgctgtacaaggaggagaaggtggacagcatcgagctgttcggcccctag

SEQ ID NO: 85685 - DNA, 1791 bp, Artificial Sequence
  Description of Artificial Sequence: Synthetic coding sequence
atggccggcaactgcggcgccagaggcgccctgagcgcccacaccctgctgttcgacctgccccccgccctgctgggcgagctgtgcgccgtgctggacagctgcgacggcgccctgggctggagaggcctggccgagagactgagcagcagctggctggacgtgagacacatcgagaagtacgtggaccagggcaagagcggcaccagagagctgctgtggagctgggcccagaagaacaagaccatcggcgacctgctgcaggtgctgcaggagatgggccacagaagagccatccacctgatcaccaactacggcgccgtgctgagccccagcgagaagagctaccaggagggcggcttccccaacatcctgttcaaggagaccgccaacgtgaccgtggacaacgtgctgatccccgagcacaacgagaagggcatcctgctgaagagcagcatcagcttccagaacatcatcgagggcaccagaaacttccacaaggacttcctgatcggcgagggcgagatcttcgaggtgtacagagtggagatccagaacctgacctacgccgtgaagctgttcaagcaggagaagaagatgcagtgcaagaagcactggaagagattcctgagcgagctggaggtgctgctgctgttccaccaccccaacatcctggagctggccgcctacttcaccgagaccgagaagttctgcctgatctacccctacatgagaaacggcaccctgttcgacagactgcagtgcgtgggcgacaccgcccccctgccctggcacatcagaatcggcatcctgatcggcatcagcaaggccatccactacctgcacaacgtgcagccctgcagcgtgatctgcggcagcatcagcagcgccaacatcctgctggacgaccagttccagcccaagctgaccgacttcgccatggcccacttcagaagccacctggagcaccagagctgcaccatcaacatgaccagcagcagcagcaagcacctgtggtacatgcccgaggagtacatcagacagggcaagctgagcatcaagaccgacgtgtacagcttcggcatcgtgatcatggaggtgctgaccggctgcagagtggtgctggacgaccccaagcacatccagctgagagacctgctgagagagctgatggagaagagaggcctggacagctgcctgagcttcctggacaagaaggtgcccccctgccccagaaacttcagcgccaagctgttctgcctggccggcagatgcgccgccaccagagccaagctgagacccagcatggacgaggtgctgaacaccctggagagcacccaggccagcctgtacttcgccgaggacccccccaccagcctgaagagcttcagatgccccagccccctgttcctggagaacgtgcccagcatccccgtggaggacgacgagagccagaacaacaacctgctgcccagcgacgagggcctgagaatcgacagaatgacccagaagacccccttcgagtgcagccagagcgaggtgatgttcctgagcctggacaagaagcccgagagcaagagaaacgaggaggcctgcaacatgcccagcagcagctgcgaggagagctggttccccaagtacatcgtgcccagccaggacctgagaccctacaaggtgaacatcgaccccagcagcgaggcccccggccacagctgcagaagcagacccgtggagagcagctgcagcagcaagttcagctgggacgagtacgagcagtacaagaaggagtag

SEQ ID NO: 85686 - DNA, 1608 bp, Artificial Sequence
  Description of Artificial Sequence: Synthetic coding sequence
atggccggcaactgcggcgccagaggcgccctgagcgcccacaccctgctgttcgacctgccccccgccctgctgggcgagctgtgcgccgtgctggacagctgcgacggcgccctgggctggagaggcctgggcgccgtgctgagccccagcgagaagagctaccaggagggcggcttccccaacatcctgttcaaggagaccgccaacgtgaccgtggacaacgtgctgatccccgagcacaacgagaagggcatcctgctgaagagcagcatcagcttccagaacatcatcgagggcaccagaaacttccacaaggacttcctgatcggcgagggcgagatcttcgaggtgtacagagtggagatccagaacctgacctacgccgtgaagctgttcaagcaggagaagaagatgcagtgcaagaagcactggaagagattcctgagcgagctggaggtgctgctgctgttccaccaccccaacatcctggagctggccgcctacttcaccgagaccgagaagttctgcctgatctacccctacatgagaaacggcaccctgttcgacagactgcagtgcgtgggcgacaccgcccccctgccctggcacatcagaatcggcatcctgatcggcatcagcaaggccatccactacctgcacaacgtgcagccctgcagcgtgatctgcggcagcatcagcagcgccaacatcctgctggacgaccagttccagcccaagctgaccgacttcgccatggcccacttcagaagccacctggagcaccagagctgcaccatcaacatgaccagcagcagcagcaagcacctgtggtacatgcccgaggagtacatcagacagggcaagctgagcatcaagaccgacgtgtacagcttcggcatcgtgatcatggaggtgctgaccggctgcagagtggtgctggacgaccccaagcacatccagctgagagacctgctgagagagctgatggagaagagaggcctggacagctgcctgagcttcctggacaagaaggtgcccccctgccccagaaacttcagcgccaagctgttctgcctggccggcagatgcgccgccaccagagccaagctgagacccagcatggacgaggtgctgaacaccctggagagcacccaggccagcctgtacttcgccgaggacccccccaccagcctgaagagcttcagatgccccagccccctgttcctggagaacgtgcccagcatccccgtggaggacgacgagagccagaacaacaacctgctgcccagcgacgagggcctgagaatcgacagaatgacccagaagacccccttcgagtgcagccagagcgaggtgatgttcctgagcctggacaagaagcccgagagcaagagaaacgaggaggcctgcaacatgcccagcagcagctgcgaggagagctggttccccaagtacatcgtgcccagccaggacctgagaccctacaaggtgaacatcgaccccagcagcgaggcccccggccacagctgcagaagcagacccgtggagagcagctgcagcagcaagttcagctgggacgagtacgagcagtacaagaaggagtag

SEQ ID NO: 85687 - DNA, 657 bp, Artificial Sequence
  Description of Artificial Sequence: Synthetic coding sequence
atgaacaagcccatcacccccagcacctacgtgagatgcctgaacgtgggcctgatcagaaagctgagcgacttcatcgacccccaggagggctggaagaagctggccgtggccatcaagaagcccagcggcgacgacagatacaaccagttccacatcagaagattcgaggccctgctgcagaccggcaagagccccaccagcgagctgctgttcgactggggcaccaccaactgcaccgtgggcgacctggtggacctgctgatccagaacgagttcttcgcccccgccagcctgctgctgcccgacgccgtgcccaagaccgccaacaccctgcccagcaaggaggccatcaccgtgcagcagaagcagatgcccttctgcgacaaggacagaaccctgatgacccccgtgcagaacctggagcagagctacatgccccccgacagcagcagccccgagaacaagagcctggaggtgagcgacaccagattccacagcttcagcttctacgagctgaagaacgtgaccaacaacttcgacgagagacccatcagcgtgggcggcaacaagatgggcgagggcggcttcggcgtggtgtacaagggctacgtgaacaacaactgcggcagcgaggaggcctgcagcaacggctag

SEQ ID NO: 85688 - DNA, 1011 bp, Artificial Sequence
  Description of Artificial Sequence: Synthetic coding sequence
atgcccttctgcgacaaggacagaaccctgatgacccccgtgcagaacctggagcagagctacatgccccccgacagcagcagccccgagaacaagagcctggaggtgagcgacaccagattccacagcttcagcttctacgagctgaagaacgtgaccaacaacttcgacgagagacccatcagcgtgggcggcaacaagatgggcgagggcggcttcggcgtggtgtacaagggctacgtgaacaacaccaccgtggccgtgaagaagctggccgccatggtggacatcaccaccgaggagctgaagcagcagttcgaccaggagatcaaggtgatggccaagtgccagcacgagaacctggtggagctgctgggcttcagcagcgacggcgacgacctgtgcctggtgtacgtgtacatgcccaacggcagcctgctggacagactgagctgcctggacggcaccccccccctgagctggcacatgagatgcaagatcgcccagggcgccgccaacggcatcaacttcctgcacgagaaccaccacatccacagagacatcaagagcgccaacatcctgctggacgaggccttcaccgccaagatcagcgacttcggcctggccagagccagcgagaagttcgcccagaccgtgatgaccagcagaatcgtgggcaccaccgcctacatggcccccgaggccctgagaggcgagatcacccccaagagcgacatctacagcttcggcgtggtgctgctggagatcatcaccggcctgcccgccgtggacgagcacagagagccccagctgctgctggacatcaaggaggagatcgaggacgaggagaagaccatcgaggactacatcgacaagaagatgaacgacgccgacagcaccagcgtggaggccatgtacagcgtggccagccagtgcctgcacgagaagaagaacaagagacccgacatcaagaaggtgcagcagctgctgcaggagatgaccgccagctag

SEQ ID NO: 85689 - DNA, 1011 bp, Artificial Sequence; identical to SEQ ID NO: 85688
  Description of Artificial Sequence: Synthetic coding sequence

SEQ ID NO: 85690 - DNA, 1383 bp, Artificial Sequence
  Description of Artificial Sequence: Synthetic coding sequence
atgaacaagcccatcacccccagcacctacgtgagatgcctgaacgtgggcctgatcagaaagctgagcgacttcatcgacccccaggagggctggaagaagctggccgtggccatcaagaagcccagcggcgacgacagatacaaccagttccacatcagaagattcgaggccctgctgcagaccggcaagagccccaccagcgagctgctgttcgactggggcaccaccaactgcaccgtgggcgacctggtggacctgctgatccagaacgagttcttcgcccccgccagcctgctgctgcccgacgccgtgcccaagaccgccaacaccctgcccagcaaggaggccatcaccgtgcagcagaagcagatgcccttctgcgacaaggacagaaccctgatgacccccgtgcagaacctggagcagagctacatgccccccgacagcagcagccccgagaacaagagcctggaggtgagcgacaccagattccacagcttcagcttctacgagctgaagaacgtgaccaacaacttcgacgagagacccatcagcgtgggcggcaacaagatgggcgagggcggcttcggcgtggtgtacaagggctacgtgaacaacaccaccgtggccgtgaagaagctggccgccatggtggacatcaccaccgaggagctgaagcagcagttcgaccaggagatcaaggtgatggccaagtgccagcacgagaacctggtggagctgctgggcttcagcagcgacggcgacgacctgtgcctggtgtacgtgtacatgcccaacggcagcctgctggacagactgagctgcctggacggcaccccccccctgagctggcacatgagatgcaagatcgcccagggcgccgccaacggcatcaacttcctgcacgagaaccaccacatccacagagacatcaagagcgccaacatcctgctggacgaggccttcaccgccaagatcagcgacttcggcctggccagagccagcgagaagttcgcccagaccgtgatgaccagcagaatcgtgggcaccaccgcctacatggcccccgaggccctgagaggcgagatcacccccaagagcgacatctacagcttcggcgtggtgctgctggagatcatcaccggcctgcccgccgtggacgagcacagagagccccagctgctgctggacatcaaggaggagatcgaggacgaggagaagaccatcgaggactacatcgacaagaagatgaacgacgccgacagcaccagcgtggaggccatgtacagcgtggccagccagtgcctgcacgagaagaagaacaagagacccgacatcaagaaggtgcagcagctgctgcaggagatgaccgccagctag

SEQ ID NO: 85691 - DNA, 270 bp, Artificial Sequence
  Description of Artificial Sequence: Synthetic coding sequence
atgaacaagcccatcacccccagcacctacgtgagatgcctgaacgtgggcctgatcagaaagctgagcgacttcatcgacccccaggagggctggaagaagctggccgtggccatcaagaagcccagcggcgacgacagatacaaccagttccacatcagaagattcgaggccctgctgcagaccggcaagagccccaccagcgagctgctgttcgactggggcaccaccaactgcaccgtgggcgacctggtggacctgctgatctag

SEQ ID NO: 85692 - DNA, 1383 bp, Artificial Sequence; identical to SEQ ID NO: 85690
  Description of Artificial Sequence: Synthetic coding sequence

SEQ ID NO: 85693 - DNA, 2394 bp, Artificial Sequence
  Description of Artificial Sequence: Synthetic coding sequence
atgtacctggagaccagaagagccatcttcgtgttctggatcttcctgcaggtgcagggcaccaaggacatcagcatcaacatctaccacagcgagaccaaggacatcgacaacccccccagaaacgagaccaccgagagcaccgagaagatgtacaagatgagcaccatgagaagaatcttcgacctggccaagcacagaaccaagagaagcgccttcttccccaccggcgtgaaggtgtgcccccaggagagcatgaagcagatcctggacagcctgcaggcctactacagactgagagtgtgccaggaggccgtgtgggaggcctacagaatcttcctggacagaatccccgacaccggcgagtaccaggactgggtgagcatctgccagcaggagaccttctgcctgttcgacatcggcaagaacttcagcaacagccaggagcacctggacctgctgcagcagagaatcaagcagagaagcttccccgacagaaaggacgagatcagcgccgagaagaccctgggcgagcccggcgagaccatcgtgatcagcaccgacgtggccaacgtgagcctgggccccttccccctgacccccgacgacaccctgctgaacgagatcctggacaacaccctgaacgacaccaagatgcccaccaccgagagagagaccgagttcgccgtgctggaggagcagagagtggagctgagcgtgagcctggtgaaccagaagttcaaggccgagctggccgacagccagagcccctactaccaggagctggccggcaagagccagctgcagatgcagaagatcttcaagaagctgcccggcttcaagaagatccacgtgctgggcttcagacccaagaaggagaaggacggcagcagcagcaccgagatgcagctgaccgccatcttcaagagacacagcgccgaggccaagagccccgccagcgacctgctgagcttcgacagcaacaagatcgagagcgaggaggtgtaccacggcaccatggaggaggacaagcagcccgagatctacctgaccgccaccgacctgaagagactgatcagcaaggccctggaggaggagcagagcctggacgtgggcaccatccagttcaccgacgagatcgccggcagcctgcccgccttcggccccgacacccagagcgagctgcccaccagcttcgccgtgatcaccgaggacgccaccctgagccccgagctgccccccgtggagccccagctggagaccgtggacggcgccgagcacggcctgcccgacaccagctggagcccccccgccatggccagcaccagcctgagcgaggccccccccttcttcatggccagcagcatcttcagcctgaccgaccagggcaccaccgacaccatggccaccgaccagaccatgctggtgcccggcctgaccatccccaccagcgactacagcgccatcagccagctggccctgggcatcagccacccccccgccagcagcgacgacagcagaagcagcgccggcggcgaggacatggtgagacacctggacgagatggacctgagcgacacccccgcccccagcgaggtgcccgagctgagcgagtacgtgagcgtgcccgaccacttcctggaggacaccacccccgtgagcgccctgcagtacatcaccaccagcagcatgaccatcgcccccaagggcagagagctggtggtgttcttcagcctgagagtggccaacatggccttcagcaacgacctgttcaacaagagcagcctggagtacagagccctggagcagcagttcacccagctgctggtgccctacctgagaagcaacctgaccggcttcaagcagctggagatcctgaacttcagaaacggcagcgtgatcgtgaacagcaagatgaagttcgccaagagcgtgccctacaacctgaccaaggccgtgcacggcgtgctggaggacttcagaagcgccgccgcccagcagctgcacctggagatcgacagctacagcctgaacatcgagcccgccgaccaggccgacccctgcaagttcctggcctgcggcgagttcgcccagtgcgtgaagaacgagagaaccgaggaggccgagtgcagatgcaagcccggctacgacagccagggcagcctggacggcctggagcccggcctgtgcggccccggcaccaaggagtgcgaggtgctgcagggcaagggcgccccctgcagactgcccgaccacagcgagaaccaggcctacaagaccagcgtgaagaagttccagaaccagcagaacaacaaggtgatcagcaagagaaacagcgagctgctgaccgtggagtacgaggagttcaaccaccaggactgggagggcaactag

SEQ ID NO: 85694 - DNA, 477 bp, Artificial Sequence
  Description of Artificial Sequence: Synthetic coding sequence
gagagacccaacggcaccagcgcccagcccgcccaggtgaagcccgagttctacagacaggccgagctgaagccctgcccctggaccggcagcaaccagagaagatgcatcaccttctgccccacccccgaccaggccgacccctgcaagttcctggcctgcggcgagttcgcccagtgcgtgaagaacgagagaaccgaggaggccgagtgcagatgcaagcccggctacgacagccagggcagcctggacggcctggagcccggcctgtgcggccccggcaccaaggagtgcgaggtgctgcagggcaagggcgccccctgcagactgcccgaccacagcgagaaccaggcctacaagaccagcgtgaagaagttccagaaccagcagaacaacaaggtgatcagcaagagaaacagcgagctgctgaccgtggagtacgaggagttcaaccaccaggactgggagggcaactag

SEQ ID NO: 85695 - DNA, 444 bp, Artificial Sequence
  Description of Artificial Sequence: Synthetic coding sequence
atgtacctggagaccagaagagccatcttcgtgttctggatcttcctgcaggtgcagggcaccaaggtgtgccaggaggccgtgtgggaggcctacagaatcttcctggacagaatccccgacaccggcgagtaccaggactgggtgagcatctgccagcaggagaccttctgcctgttcgacatcggcaagaacttcagcaacagccaggagcacctggacctgctgcagcagagaatcaagcagagaagcttccccgacagaaaggacgagatcagcgccgagaagaccctgggcgagcccggcgagaccatcgtgatcagcaccgagaagaacaagggcaagaccaagcccttcaacatcctgcagttcggcaacaaccaccacgagcacctgctgcccatcttctgcctgctgagcagcatcatctacacctactactag

SEQ ID NO: 85696 - DNA, 3726 bp, Artificial Sequence
  Description of Artificial Sequence: Synthetic coding sequence
atgatcatgttccccctgttcggcaagatcagcctgggcatcctgatcttcgtgctgatcgagggcgacttccccagcctgaccgcccagacctacctgagcatcgaggagatccaggagcccaagagcgccgtgagcttcctgctgcccgaggagagcaccgacctgagcctggccaccaagaagaagcagcccctggacagaagagagaccgagagacagtggctgatcagaagaagaagaagcatcctgttccccaacggcgtgaagatctgccccgacgagagcgtggccgaggccgtggccaaccacgtgaagtacttcaaggtgagagtgtgccaggaggccgtgtgggaggccttcagaaccttctgggacagactgcccggcagagaggagtaccactactggatgaacctgtgcgaggacggcgtgaccagcatcttcgagatgggcaccaacttcagcgagagcgtggagcacagaagcctgatcatgaagaagctgacctacgccaaggagaccgtgagcagcagcgagctgagcagccccgtgcccgtgggcgacaccagcaccctgggcgacaccaccctgagcgtgccccaccccgaggtggacgcctacgagggcgccagcgagagcagcctggagagacccgaggagagcatcagcaacgagatcgagaacgtgatcgaggaggccaccaagcccgccggcgagcagatcgccgagttcagcatccacctgctgggcaagcagtacagagaggagctgcaggacagcagcagcttccaccaccagcacctggaggaggagttcatcagcgaggtggagaacgccttcaccggcctgcccggctacaaggagatcagagtgctggagttcagaagccccaaggagaacgacagcggcgtggacgtgtactacgccgtgaccttcaacggcgaggccatcagcaacaccacctgggacctgatcagcctgcacagcaacaaggtggagaaccacggcctggtggagctggacgacaagcccaccgtggtgtacaccatcagcaacttcagagactacatcgccgagaccctgcagcagaacttcctgctgggcaacagcagcctgaaccccgaccccgacagcctgcagctgatcaacgtgagaggcgtgctgagacaccagaccgaggacctggtgtggaacacccagagcagcagcctgcaggccacccccagcagcatcctggacaacaccttccaggccgcctggcccagcgccgacgagagcatcaccagcagcatcccccccctggacttcagcagcggcccccccagcgccaccggcagagagctgtggagcgagagccccctgggcgacctggtgagcacccacaagctggccttccccagcaagatgggcctgagcagcagccccgaggtgctggaggtgagcagcctgaccctgcacagcgtgacccccgccgtgctgcagaccggcctgcccgtggccagcgaggagagaaccagcggcagccacctggtggaggacggcctggccaacgtggaggagagcgaggacttcctgagcatcgacagcctgcccagcagcagcttcacccagcccgtgcccaaggagaccatccccagcatggaggacagcgacgtgagcctgaccagcagcccctacctgaccagcagcatccccttcggcctggacagcctgaccagcaaggtgaaggaccagctgaaggtgagccccttcctgcccgacgccagcatggagaaggagctgatcttcgacggcggcctgggcagcggcagcggccagaaggtggacctgatcacctggccctggagcgagaccagcagcgagaagagcgccgagcccctgagcaagccctggctggaggacgacgacagcctgctgcccgccgagatcgaggacaagaagctggtgctggtggacaagatggacagcaccgaccagatcagcaagcacagcaagtacgagcacgacgacagaagcacccacttccccgaggaggagcccctgagcggccccgccgtgcccatcttcgccgacaccgccgccgagagcgccagcctgaccctgcccaagcacatcagcgaggtgcccggcgtggacgactacagcgtgaccaaggcccccctgatcctgaccagcgtggccatcagcgccagcaccgacaagagcgaccaggccgacgccatcctgagagaggacatggagcagatcaccgagagcagcaactacgagtggttcgacagcgaggtgagcatggtgaagcccgacatgcagaccctgtggaccatcctgcccgagagcgagagagtgtggaccagaaccagcagcctggagaagctgagcagagacatcctggccagcaccccccagagcgccgacagactgtggctgagcgtgacccagagcaccaagctgccccccaccaccatcagcaccctgctggaggacgaggtgatcatgggcgtgcaggacatcagcctggagctggacagaatcggcaccgactactaccagcccgagcaggtgcaggagcagaacggcaaggtgggcagctacgtggagatgagcaccagcgtgcacagcaccgagatggtgagcgtggcctggcccaccgagggcggcgacgacctgagctacacccagaccagcggcgccctggtggtgttcttcagcctgagagtgaccaacatgatgttcagcgaggacctgttcaacaagaacagcctggagtacaaggccctggagcagagattcctggagctgctggtgccctacctgcagagcaacctgaccggcttccagaacctggagatcctgaacttcagaaacggcagcatcgtggtgaacagcagaatgaagttcgccaacagcgtgccccccaacgtgaacaacgccgtgtacatgatcctggaggacttctgcaccaccgcctacaacaccatgaacctggccatcgacaagtacagcctggacgtggagagcggcgacgaggccaacccctgcaagttccaggcctgcaacgagttcagcgagtgcctggtgaacccctggagcggcgaggccaagtgcagatgcttccccggctacctgagcgtggaggagagaccctgccagagcctgtgcgacctgcagcccgacttctgcctgaacgacggcaagtgcgacatcatgcccggccacggcgccatctgcagatgcagagtgggcgagaactggtggtacagaggcaagcactgcgaggagttcgtgagcgagcccgtgatcatcggcatcaccatcgccagcgtggtgggcctgctggtgatcttcagcgccatcatctacttcttcatcagaaccctgcaggcccaccacgacagaagcgagagagagagccccttcagcggcagcagcagacagcccgacagcctgagcagcatcgagaacgccgtgaagtacaaccccgtgtacgagagccacagagccggctgcgagaagtacgagggcccctacccccagcaccccttctacagcagcgccagcggcgacgtgatcggcggcctgagcagagaggagatcagacagatgtacgagagcagcgagctgagcagagaggagatccaggagagaatgagagtgctggagctgtacgccaacgaccccgagttcgccgccttcgtgagagagcagcaggtggaggaggtgtag

SEQ ID NO: 85697 - DNA, 201 bp, Artificial Sequence
  Description of Artificial Sequence: Synthetic coding sequence
ggctacctgagcgtggaggagagaccctgccagagcctgtgcgacctgcagcccgacttctgcctgaacgacggcaagtgcgacatcatgcccggccacggcgccatctgcagcggcagcagcagacagcccgacagcctgagcagcatcgagaacgccgtgaagtacaaccccgtgtacgagagccacagagccggctag

SEQ ID NO: 85698 - DNA, 2745 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagcacggcttctggttcttcagagagagctgctag

SEQ ID NO: 85699 - DNA, 954 bp, Artificial Sequence
  Description of Artificial Sequence: Synthetic coding sequence
tgacccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaaccagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggactag

SEQ ID NO: 85700 - DNA, 5166 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtgatcggctgctgggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtggtgcagcgacctgcacctgctggacatgctgacccccaccgagagaaagagacagggctacatccacgagctgatcgtgaccgaggagaactacgtgaacgacctgcagctggtgaccgagatcttccagaagcccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaacatcctggagaacacccccgagaaccaccccgaccacagccacctgaagcacgccctggagaaggccgaggagctgtgcagccaggtgaacgagggcgtgagagagaaggagaacagcgacagactggagtggatccaggcccacgtgcagtgcgagggcctgagcgagcagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggacaccctgaaccccaagtggaacagcaactgccagttcttcatcagagacctggagcaggaggtgctgtgcatcaccgtgttcgagagagaccagttcagccccgacgacttcctgggcagaaccgagatcagagtggccgacatcaagaaggaccagggcagcaagggccccgtgaccaagtgcctgctgctgcacgaggtgcccaccggcgagatcgtggtgagactggacctgcagctgttcgacgagccctag

SEQ ID NO: 85701 - DNA, 4953 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtgatcggctgctgggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtggtgcagcgacctgcacctgctggacatgctgacccccaccgagagaaagagacagggctacatccacgagctgatcgtgaccgaggagaactacgtgaacgacctgcagctggtgaccgagatcttccagaagcccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaacatcctggagaacacccccgagaaccaccccgaccacagccacctgaagcacgccctggagaaggccgaggagctgtgcagccaggtgaacgagggcgtgagagagaaggagaacagcgacagactggagtggatccaggcccacgtgcagtgcgagggcctgagcgagcagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggacaccctgaaccccaagtggaacagcaactgccagttcttcatcagagacctggagcaggaggtgctgtgcatcaccgtgttcgagagagaccagttcagccccgacgacttcctgggcagaaccgagatcagagtggccgacatcaagaaggaccagggcagcaagggccccgtgaccaagtgcctgctgctgcacgaggtgcccaccggcgagatcgtggtgagactggacctgcagctgttcgacgagccctag

SEQ ID NO: 85702 - DNA, 3237 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccggccccagctgcaacgtgaagtag

SEQ ID NO: 85703 - DNA, 3663 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtgaagggcgagtgggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtag

SEQ ID NO: 85704 - DNA, 5166 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtgaagggcgagtgggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtggtgcagcgacctgcacctgctggacatgctgacccccaccgagagaaagagacagggctacatccacgagctgatcgtgaccgaggagaactacgtgaacgacctgcagctggtgaccgagatcttccagaagcccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaacatcctggagaacacccccgagaaccaccccgaccacagccacctgaagcacgccctggagaaggccgaggagctgtgcagccaggtgaacgagggcgtgagagagaaggagaacagcgacagactggagtggatccaggcccacgtgcagtgcgagggcctgagcgagcagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggacaccctgaaccccaagtggaacagcaactgccagttcttcatcagagacctggagcaggaggtgctgtgcatcaccgtgttcgagagagaccagttcagccccgacgacttcctgggcagaaccgagatcagagtggccgacatcaagaaggaccagggcagcaagggccccgtgaccaagtgcctgctgctgcacgaggtgcccaccggcgagatcgtggtgagactggacctgcagctgttcgacgagccctag

SEQ ID NO: 85705 - DNA, 3048 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgagggcctgtggaactgctgggagaacagagagttcagaaagaagacctag

SEQ ID NO: 85706 - DNA, 3063 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagcccgacttcctgctgcaccccagcatgagactgggccacatgcagcccagaatcgtgctgctgttccccgaccccctgcagtgcagcaccagcagactgctgcccatgctgagacccagacccggcgtgcccttcctgagaagccccagctgccagagccccagccaccccagcagacccatcagcgacgccgcccccagcgtgaagttcaccctgatgccccccggcagaatccacccctgcttcctgttcatccccgccgtgaacagcagaaacagcttcctggtgtacttcatcctgcccggcggcaccctgggctgcttctacctgtgcctgccccactacctgtag

SEQ ID NO: 85707 - DNA, 3435 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtag

SEQ ID NO: 85708 - DNA, 3648 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtag

SEQ ID NO: 85709 - DNA, 3537 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtag

SEQ ID NO: 85710 - DNA, 3450 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtgaagggcgagtgggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtag

SEQ ID NO: 85711 - DNA, 5151 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtggtgcagcgacctgcacctgctggacatgctgacccccaccgagagaaagagacagggctacatccacgagctgatcgtgaccgaggagaactacgtgaacgacctgcagctggtgaccgagatcttccagaagcccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaacatcctggagaacacccccgagaaccaccccgaccacagccacctgaagcacgccctggagaaggccgaggagctgtgcagccaggtgaacgagggcgtgagagagaaggagaacagcgacagactggagtggatccaggcccacgtgcagtgcgagggcctgagcgagcagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggacaccctgaaccccaagtggaacagcaactgccagttcttcatcagagacctggagcaggaggtgctgtgcatcaccgtgttcgagagagaccagttcagccccgacgacttcctgggcagaaccgagatcagagtggccgacatcaagaaggaccagggcagcaagggccccgtgaccaagtgcctgctgctgcacgaggtgcccaccggcgagatcgtggtgagactggacctgcagctgttcgacgagccctag

SEQ ID NO: 85712 - DNA, 4983 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttcggcatgggcggcatcgccagcatgccccccctgaccgccgtggcccccgtgcccatgggcagcatccccgtggtgggcatgagccccaccctggtgagcagcgtgcccaccgccgccgtgccccccctggccaacggcgccccccccgtgatccagcccctgcccgccttcgcccaccccgccgccaccctgcccaagagcagcagcttcagcagaagcggccccggcagccagctgaacaccaagctgcagaaggcccagagcttcgacgtggccagcgtgccccccgtggccgagtgggccgtgccccagagcagcagactgaagtacagacagctgttcaacagccacgacaagaccatgagcggccacctgaccggcccccaggccagaaccatcctgatgcagagcagcctgccccaggcccagctggccagcatctggaacctgagcgacatcgaccaggacggcaagctgaccgccgaggagttcatcctggccatgcacctgatcgacgtggccatgagcggccagcccctgccccccgtgctgccccccgagtacatcccccccagcttcagaagagtgagaagcggcagcggcatcagcgtgatcagcagcaccagcgtggaccagagactgcccgaggagcccgtgctggaggacgagcagcagcagctggagaagaagctgcccgtgaccttcgaggacaagaagagagagaacttcgagagaggcaacctggagctggagaagagaagacaggccctgctggagcagcagagaaaggagcaggagagactggcccagctggagagagccgagcaggagagaaaggagagagagagacaggagcaggagagaaagagacagctggagctggagaagcagctggagaagcagagagagctggagagacagagagaggaggagagaagaaaggagatcgagagaagagaggccgccaagagagagctggagagacagagacagctggagtgggagagaaacagaagacaggagctgctgaaccagagaaacaaggagcaggaggacatcgtggtgctgaaggccaagaagaagaccctggagttcgagctggaggccctgaacgacaagaagcaccagctggagggcaagctgcaggacatcagatgcagactgaccacccagagacaggagatcgagagcaccaacaagagcagagagctgagaatcgccgagatcacccacctgcagcagcagctgcaggagagccagcagatgctgggcagactgatccccgagaagcagatcctgaacgaccagctgaagcaggtgcagcagaacagcctgcacagagacagcctggtgaccctgaagagagccctggaggccaaggagctggccagacagcacctgagagaccagctggacgaggtggagaaggagaccagaagcaagctgcaggagatcgacatcttcaacaaccagctgaaggagctgagagagatccacaacaagcagcagctgcagaagcagaagagcatggaggccgagagactgaagcagaaggagcaggagagaaagatcatcgagctggagaagcagaaggaggaggcccagagaagagcccaggagagagacaagcagtggctggagcacgtgcagcaggaggacgagcaccagagacccagaaagctgcacgaggaggagaagctgaagagagaggagagcgtgaagaagaaggacggcgaggagaagggcaagcaggaggcccaggacaagctgggcagactgttccaccagcaccaggagcccgccaagcccgccgtgcaggccccctggagcaccgccgagaagggccccctgaccatcagcgcccaggagaacgtgaaggtggtgtactacagagccctgtaccccttcgagagcagaagccacgacgagatcaccatccagcccggcgacatcgtgatggtggacgagagccagaccggcgagcccggctggctgggcggcgagctgaagggcaagaccggctggttccccgccaactacgccgagaagatccccgagaacgaggtgcccgcccccgtgaagcccgtgaccgacagcaccagcgcccccgcccccaagctggccctgagagagacccccgcccccctggccgtgaccagcagcgagcccagcaccacccccaacaactgggccgacttcagcagcacctggcccaccagcaccaacgagaagcccgagaccgacaactgggacgcctgggccgcccagcccagcctgaccgtgcccagcgccggccagctgagacagagaagcgccttcacccccgccaccgccaccggcagcagccccagccccgtgctgggccagggcgagaaggtggagggcctgcaggcccaggccctgtacccctggagagccaagaaggacaaccacctgaacttcaacaagaacgacgtgatcaccgtgctggagcagcaggacatgtggtggttcggcgaggtgcagggccagaagggctggttccccaagagctacgtgaagctgatcagcggccccatcagaaagagcaccagcatggacagcggcagcagcgagagccccgccagcctgaagagagtggccagccccgccgccaagcccgtggtgagcggcgaggagttcatcgccatgtacacctacgagagcagcgagcagggcgacctgaccttccagcagggcgacgtgatcctggtgaccaagaaggacggcgactggtggaccggcaccgtgggcgacaaggccggcgtgttccccagcaactacgtgagactgaaggacagcgagggcagcggcaccgccggcaagaccggcagcctgggcaagaagcccgagatcgcccaggtgatcgccagctacaccgccaccggccccgagcagctgaccctggcccccggccagctgatcctgatcagaaagaagaaccccggcggctggtgggagggcgagctgcaggccagaggcaagaagagacagatcggctggttccccgccaactacgtgaagctgctgagccccggcaccagcaagatcacccccaccgagccccccaagagcaccgccctggccgccgtgtgccaggtgatcggcatgtacgactacaccgcccagaacgacgacgagctggccttcaacaagggccagatcatcaacgtgctgaacaaggaggaccccgactggtggaagggcgaggtgaacggccaggtgggcctgttccccagcaactacgtgaagctgaccaccgacatggaccccagccagcagtggtgcagcgacctgcacctgctggacatgctgacccccaccgagagaaagagacagggctacatccacgagctgatcgtgaccgaggagaactacgtgaacgacctgcagctggtgaccgagatcttccagaagcccctgatggagagcgagctgctgaccgagaaggaggtggccatgatcttcgtgaactggaaggagctgatcatgtgcaacatcaagctgctgaaggccctgagagtgagaaagaagatgagcggcgagaagatgcccgtgaagatgatcggcgacatcctgagcgcccagctgccccacatgcagccctacatcagattctgcagcagacagctgaacggcgccgccctgatccagcagaagaccgacgaggcccccgacttcaaggagttcgtgaagagactggccatggaccccagatgcaagggcatgcccctgagcagcttcatcctgaagcccatgcagagagtgaccagataccccctgatcatcaagaaccagctggtgttcaacagcgtgaccaactgcctgggccccagaaagttcctgcacagcggcaagctgtacaaggccaagagcaacaaggagctgtacggcttcctgttcaacgacttcctgctgctgacccagatcaccaagcccctgggcagcagcggcaccgacaaggtgttcagccccaagagcaacctgcagtacaagatgtacaagacccccatcttcctgaacgaggtgctggtgaagctgcccaccgaccccagcggcgacgagcccatcttccacatcagccacatcgacagagtgtacaccctgagagccgagagcatcaacgagagaaccgcctgggtgcagaagatcaaggccgccagcgagctgtacatcgagaccgagaagaagaagagagagaaggcctacctggtgagaagccagagagccaccggcatcggcagactgatggtgaacgtggtggagggcatcgagctgaagccctgcagaagccacggcaagagcaacccctactgcgaggtgaccatgggcagccagtgccacatcaccaagaccatccaggacaccctgaaccccaagtggaacagcaactgccagttcttcatcagagacctggagcaggaggtgctgtgcatcaccgtgttcgagagagaccagttcagccccgacgacttcctgggcagaaccgagatcagagtggccgacatcaagaaggaccagggcagcaagggccccgtgaccaagtgcctgctgctgcacgaggtgcccaccggcgagatcgtggtgagactggacctgcagctgttcgacgagccctag

SEQ ID NO: 85713 - DNA, 348 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttcagcatcgccatgaagctgatcaagctgaagctgcagggctaccagctgcccagcgccctgccccccgtgatgaagcagcagcccgtggccatcagcagcgcccccgccttctag

SEQ ID NO: 85714 - DNA, 237 bp, Artificial Sequence
  Description of Artificial Sequence: Synthetic coding sequence
atggcccagttccccacccccttcggcggcagcctggacatctgggccatcaccgtggaggagagagccaagcacgaccagcagttccacagcctgaagcccatcagcggcttcatcaccggcgaccaggccagaaacttcttcttccagagcggcctgccccagcccgtgctggcccagatctgggccctggccgacatgaacaacgacggcagaatggaccaggtggagttctag

SEQ ID NO: 85715 - DNA, 5094 bp, Artificial Sequence
  Description of Artificial Sequence: Synthetic coding sequence
atgatggcccagttccccaccgccatgaacggcggccccaacatgtgggccatcaccagcgaggagagaaccaagcacgacagacagttcgacaacctgaagcccagcggcggctacatcaccggcgaccaggccagaaacttcttcctgcagagcggcctgcccgcccccgtgctggccgagatctgggccctgagcgacctgaacaaggacggcaagatggaccagcaggagttcagcatcgccatgaagctgatcaagctgaagctgcagggccagcagctgcccgtggtgctgccccccatcatgaagcagccccccatgttcagccccctgatcagcgccagattcggcatgggcagcatgcccaacctgagcatcccccagcccctgccccccgccgcccccatcaccagcctgagcagcgccaccagcggcaccaacctgccccccctgatgatgcccacccccctggtgcccagcgtgagcaccagcagcctgcccaacggcaccgccagcctgatccagcccctgcccatcccctacagcagcagcaccctgccccacggcagcagctacagcctgatgatgggcggcttcggcggcgccagcatccagaaggcccagagcctgatcgacctgggcagcagcagcagcaccagcagcaccgccagcctgagcggcaacagccccaagaccggcaccagcgagtgggccgtgccccagcccaccagactgaagtacagacagaagttcaacaccctggacaagagcatgagcggctacctgagcggcttccaggccagaaacgccctgctgcagagcaacctgagccagacccagctggccaccatctggaccctggccgacgtggacggcgacggccagctgaaggccgaggagttcatcctggccatgcacctgaccgacatggccaaggccggccagcccctgcccctgaccctgccccccgagctggtgccccccagcttcagaggcggcaagcagatcgacagcatcaacggcaccctgcccagctaccagaagatgcaggaggaggagccccagaagaagctgcccgtgaccttcgaggacaagagaaaggccaactacgagagaggcaacatggagctggagaagagaagacaggccctgatggagcagcagcagagagaggccgagagaaaggcccagaaggagaaggaggagtgggagagaaagcagagagagctgcaggagcaggagtggaagaagcagctggagctggagaagagactggagaagcagagagagctggagagacagagagaggaggagagaagaaaggacatcgagagaagagaggccgccaagcaggagctggagagacagagaagactggagtgggagagaatcagaagacaggagctgctgaaccagaagaacagagagcaggaggagatcgtgagactgaacagcaagaagaagaacctgcacctggagctggaggccctgaacggcaagcaccagcagatcagcggcagactgcaggacgtgagactgaagaagcagacccagaagaccgagctggaggtgctggacaagcagtgcgacctggagatcatggagatcaagcagctgcagcaggagctgcaggagtaccagaacaagctgatctacctggtgcccgagaagcagctgctgaacgagagaatcaagaacatgcagttcagcaacacccccgacagcggcgtgagcctgctgcacaagaagagcctggagaaggaggagctgtgccagagactgaaggagcagctggacgccctggagaaggagaccgccagcaagctgagcgagatggacagcttcaacaaccagctgaagtgcggcaacatggacgacagcgtgctgcagtgcctgctgagcctgctgagctgcctgaacaacctgttcctgctgctgaaggagctgagagagacctacaacacccagcagctggccctggagcagctgtacaagatcaagagagacaagctgaaggagatcgagagaaagagactggagctgatgcagaagaagaagctggaggacgaggccgccagaaaggccaagcagggcaaggagaacctgtggaaggagaacctgagaaaggaggaggaggagaagcagaagagactgcaggaggagaagacccaggagaagatccaggaggaggagagaaaggccgaggagaagcagagaaaggacaaggacaccctgaaggccgaggagaagaagagagagaccgccagcgtgctggtgaactacagagccctgtaccccttcgaggccagaaaccacgacgagatgagcttcaacagcggcgacatcatccaggtggacgagaagaccgtgggcgagcccggctggctgtacggcagcttccagggcaacttcggctggttcccctgcaactacgtggagaagatgcccagcagcgagaacgagaaggccgtgagccccaagaaggccctgctgccccccaccgtgagcctgagcgccaccagcaccagcagcgagcccctgagcagcaaccagcccgccagcgtgaccgactaccagaacgtgagcttcagcaacctgaccgtgaacaccagctggcagaagaagagcgccttcaccagaaccgtgagccccggcagcgtgagccccatccacggccagggccaggtggtggagaacctgaaggcccaggccctgtgcagctggaccgccaagaaggacaaccacctgaacttcagcaagcacgacatcatcaccgtgctggagcagcaggagaactggtggttcggcgaggtgcacggcggcagaggctggttccccaagagctacgtgaagatcatccccggcagcgaggtgaagagagaggagcccgaggccctgtacgccgccgtgaacaagaagcccaccagcgccgcctacagcgtgggcgaggagtacatcgccctgtacccctacagcagcgtggagcccggcgacctgaccttcaccgagggcgaggagatcctggtgacccagaaggacggcgagtggtggaccggcagcatcggcgacagaagcggcatcttccccagcaactacgtgaagcccaaggaccaggagagcttcggcagcgccagcaagagcggcgccagcaacaagaagcccgagatcgcccaggtgaccagcgcctacgtggccagcggcagcgagcagctgagcctggcccccggccagctgatcctgatcctgaagaagaacaccagcggctggtggcagggcgagctgcaggccagaggcaagaagagacagaagggctggttccccgccagccacgtgaagctgctgggccccagcagcgagagagccacccccgccttccaccccgtgtgccaggtgatcgccatgtacgactacgccgccaacaacgaggacgagctgagcttcagcaagggccagctgatcaacgtgatgaacaaggacgaccccgactggtggcagggcgagatcaacggcgtgaccggcctgttccccagcaactacgtgaagatgaccaccgacagcgaccccagccagcagtggtgcgccgacctgcagaccctggacaccatgcagcccatcgagagaaagagacagggctacatccacgagctgatccagaccgaggagagatacatggccgacctgcagctggtggtggaggtgttccagaagagaatggccgagagcggcttcctgaccgagggcgagatggccctgatcttcgtgaactggaaggagctgatcatgagcaacaccaagctgctgaaggccctgagagtgagaaagaagaccggcggcgagaagatgcccgtgcagatgatcggcgacatcctggccgccgagctgagccacatgcaggcctacatcagattctgcagctgccagctgaacggcgccgccctgctgcagcagaagaccgacgaggacaccgacttcaaggagttcctgaagaagctggccagcgaccccagatgcaagggcatgcccctgagcagcttcctgctgaagcccatgcagagaatcaccagataccccctgctgatcagaagcatcctggagaacacccccgagagccacgccgaccacagcagcctgaagctggccctggagagagccgaggagctgtgcagccaggtgaacgagggcgtgagagagaaggagaacagcgacagactggagtggatccaggcccacgtgcagtgcgagggcctggccgagcagctgatcttcaacagcctgaccaactgcctgggccccagaaagctgctgcacagcggcaagctgtacaagaccaagagcaacaaggagctgcacggcttcctgttcaacgacttcctgctgctgacctacatggtgaagcagttcgccgtgagcagcggcagcgagaagctgttcagcagcaagagcaacgcccagttcaagatgtacaagacccccatcttcctgaacgaggtgctggtgaagctgcccaccgaccccagcagcgacgagcccgtgttccacatcagccacatcgacagagtgtacaccctgagaaccgacaacatcaacgagagaaccgcctgggtgcagaagatcaaggccgccagcgagcagtacatcgacaccgagaagaagaagagagagaaggcctaccaggccagaagccagaagaccagcggcatcggcagactgatggtgcacgtgatcgaggccaccgagctgaaggcctgcaagcccaacggcaagagcaacccctactgcgagatcagcatgggcagccagagctacaccaccagaaccatccaggacaccctgaaccccaagtggaacttcaactgccagttcttcatcaaggacctgtaccaggacgtgctgtgcctgaccctgttcgacagagaccagttcagccccgacgacttcctgggcagaaccgagatccccgtggccaagatcagaaccgagcaggagagcaagggccccatgaccagaagactgctgctgcacgaggtgcccaccggcgaggtgtgggtgagattcgacctgcagctgttcgagcagaagaccctgctgtag

SEQ ID NO: 85716 - DNA, 5013 bp, Artificial Sequence
  Description of Artificial Sequence: Synthetic coding sequence
atgatggcccagttccccaccgccatgaacggcggccccaacatgtgggccatcaccagcgaggagagaaccaagcacgacagacagttcgacaacctgaagcccagcggcggctacatcaccggcgaccaggccagaaacttcttcctgcagagcggcctgcccgcccccgtgctggccgagatctgggccctgagcgacctgaacaaggacggcaagatggaccagcaggagttcagcatcgccatgaagctgatcaagctgaagctgcagggccagcagctgcccgtggtgctgccccccatcatgaagcagccccccatgttcagccccctgatcagcgccagattcggcatgggcagcatgcccaacctgagcatcccccagcccctgccccccgccgcccccatcaccagcctgagcagcgccaccagcggcaccaacctgccccccctgatgatgcccacccccctggtgcccagcgtgagcaccagcagcctgcccaacggcaccgccagcctgatccagcccctgcccatcccctacagcagcagcaccctgccccacggcagcagctacagcctgatgatgggcggcttcggcggcgccagcatccagaaggcccagagcctgatcgacctgggcagcagcagcagcaccagcagcaccgccagcctgagcggcaacagccccaagaccggcaccagcgagtgggccgtgccccagcccaccagactgaagtacagacagaagttcaacaccctggacaagagcatgagcggctacctgagcggcttccaggccagaaacgccctgctgcagagcaacctgagccagacccagctggccaccatctggaccctggccgacgtggacggcgacggccagctgaaggccgaggagttcatcctggccatgcacctgaccgacatggccaaggccggccagcccctgcccctgaccctgccccccgagctggtgccccccagcttcagaggcggcaagcagatcgacagcatcaacggcaccctgcccagctaccagaagatgcaggaggaggagccccagaagaagctgcccgtgaccttcgaggacaagagaaaggccaactacgagagaggcaacatggagctggagaagagaagacaggccctgatggagcagcagcagagagaggccgagagaaaggcccagaaggagaaggaggagtgggagagaaagcagagagagctgcaggagcaggagtggaagaagcagctggagctggagaagagactggagaagcagagagagctggagagacagagagaggaggagagaagaaaggacatcgagagaagagaggccgccaagcaggagctggagagacagagaagactggagtgggagagaatcagaagacaggagctgctgaaccagaagaacagagagcaggaggagatcgtgagactgaacagcaagaagaagaacctgcacctggagctggaggccctgaacggcaagcaccagcagatcagcggcagactgcaggacgtgagactgaagaagcagacccagaagaccgagctggaggtgctggacaagcagtgcgacctggagatcatggagatcaagcagctgcagcaggagctgcaggagtaccagaacaagctgatctacctggtgcccgagaagcagctgctgaacgagagaatcaagaacatgcagttcagcaacacccccgacagcggcgtgagcctgctgcacaagaagagcctggagaaggaggagctgtgccagagactgaaggagcagctggacgccctggagaaggagaccgccagcaagctgagcgagatggacagcttcaacaaccagctgaaggagctgagagagacctacaacacccagcagctggccctggagcagctgtacaagatcaagagagacaagctgaaggagatcgagagaaagagactggagctgatgcagaagaagaagctggaggacgaggccgccagaaaggccaagcagggcaaggagaacctgtggaaggagaacctgagaaaggaggaggaggagaagcagaagagactgcaggaggagaagacccaggagaagatccaggaggaggagagaaaggccgaggagaagcagagaaaggacaaggacaccctgaaggccgaggagaagaagagagagaccgccagcgtgctggtgaactacagagccctgtaccccttcgaggccagaaaccacgacgagatgagcttcaacagcggcgacatcatccaggtggacgagaagaccgtgggcgagcccggctggctgtacggcagcttccagggcaacttcggctggttcccctgcaactacgtggagaagatgcccagcagcgagaacgagaaggccgtgagccccaagaaggccctgctgccccccaccgtgagcctgagcgccaccagcaccagcagcgagcccctgagcagcaaccagcccgccagcgtgaccgactaccagaacgtgagcttcagcaacctgaccgtgaacaccagctggcagaagaagagcgccttcaccagaaccgtgagccccggcagcgtgagccccatccacggccagggccaggtggtggagaacctgaaggcccaggccctgtgcagctggaccgccaagaaggacaaccacctgaacttcagcaagcacgacatcatcaccgtgctggagcagcaggagaactggtggttcggcgaggtgcacggcggcagaggctggttccccaagagctacgtgaagatcatccccggcagcgaggtgaagagagaggagcccgaggccctgtacgccgccgtgaacaagaagcccaccagcgccgcctacagcgtgggcgaggagtacatcgccctgtacccctacagcagcgtggagcccggcgacctgaccttcaccgagggcgaggagatcctggtgacccagaaggacggcgagtggtggaccggcagcatcggcgacagaagcggcatcttccccagcaactacgtgaagcccaaggaccaggagagcttcggcagcgccagcaagagcggcgccagcaacaagaagcccgagatcgcccaggtgaccagcgcctacgtggccagcggcagcgagcagctgagcctggcccccggccagctgatcctgatcctgaagaagaacaccagcggctggtggcagggcgagctgcaggccagaggcaagaagagacagaagggctggttccccgccagccacgtgaagctgctgggccccagcagcgagagagccacccccgccttccaccccgtgtgccaggtgatcgccatgtacgactacgccgccaacaacgaggacgagctgagcttcagcaagggccagctgatcaacgtgatgaacaaggacgaccccgactggtggcagggcgagatcaacggcgtgaccggcctgttccccagcaactacgtgaagatgaccaccgacagcgaccccagccagcagtggtgcgccgacctgcagaccctggacaccatgcagcccatcgagagaaagagacagggctacatccacgagctgatccagaccgaggagagatacatggccgacctgcagctggtggtggaggtgttccagaagagaatggccgagagcggcttcctgaccgagggcgagatggccctgatcttcgtgaactggaaggagctgatcatgagcaacaccaagctgctgaaggccctgagagtgagaaagaagaccggcggcgagaagatgcccgtgcagatgatcggcgacatcctggccgccgagctgagccacatgcaggcctacatcagattctgcagctgccagctgaacggcgccgccctgctgcagcagaagaccgacgaggacaccgacttcaaggagttcctgaagaagctggccagcgaccccagatgcaagggcatgcccctgagcagcttcctgctgaagcccatgcagagaatcaccagataccccctgctgatcagaagcatcctggagaacacccccgagagccacgccgaccacagcagcctgaagctggccctggagagagccgaggagctgtgcagccaggtgaacgagggcgtgagagagaaggagaacagcgacagactggagtggatccaggcccacgtgcagtgcgagggcctggccgagcagctgatcttcaacagcctgaccaactgcctgggccccagaaagctgctgcacagcggcaagctgtacaagaccaagagcaacaaggagctgcacggcttcctgttcaacgacttcctgctgctgacctacatggtgaagcagttcgccgtgagcagcggcagcgagaagctgttcagcagcaagagcaacgcccagttcaagatgtacaagacccccatcttcctgaacgaggtgctggtgaagctgcccaccgaccccagcagcgacgagcccgtgttccacatcagccacatcgacagagtgtacaccctgagaaccgacaacatcaacgagagaaccgcctgggtgcagaagatcaaggccgccagcgagcagtacatcgacaccgagaagaagaagagagagaaggcctaccaggccagaagccagaagaccagcggcatcggcagactgatggtgcacgtgatcgaggccaccgagctgaaggcctgcaagcccaacggcaagagcaacccctactgcgagatcagcatgggcagccagagctacaccaccagaaccatccaggacaccctgaaccccaagtggaacttcaactgccagttcttcatcaaggacctgtaccaggacgtgctgtgcctgaccctgttcgacagagaccagttcagccccgacgacttcctgggcagaaccgagatccccgtggccaagatcagaaccgagcaggagagcaagggccccatgaccagaagactgctgctgcacgaggtgcccaccggcgaggtgtgggtgagattcgacctgcagctgttcgagcagaagaccctgctgtag

SEQ ID NO: 85717 - DNA, 5013 bp, Artificial Sequence; identical to SEQ ID NO: 85716
  Description of Artificial Sequence: Synthetic coding sequence

SEQ ID NO: 85718 - DNA, 1836 bp, Artificial Sequence
  Description of Artificial Sequence: Synthetic coding sequence
atggcccagttccccaccgccatgaacggcggccccaacatgtgggccatcaccagcgaggagagaaccaagcacgacagacagttcgacaacctgaagcccagcggcggctacatcaccggcgaccaggccagaaacttcttcctgcagagcggcctgcccgcccccgtgctggccgagatctgggccctgagcgacctgaacaaggacggcaagatggaccagcaggagttcagcatcgccatgaagctgatcaagctgaagctgcagggccagcagctgcccgtggtgctgccccccatcatgaagcagccccccatgttcagccccctgatcagcgccagattcggcatgggcagcatgcccaacctgagcatcccccagcccctgccccccgccgcccccatcaccagcctgagcagcgccaccagcggcaccaacctgccccccctgatgatgcccacccccctggtgcccagcgtgagcaccagcagcctgcccaacggcaccgccagcctgatccagcccctgcccatcccctacagcagcagcaccctgccccacggcagcagctacagcctgatgatgggcggcttcggcggcgccagcatccagaaggcccagagcctgatcgacctgggcagcagcagaagctggagcagcggcagcagcgcccacagccccgccacccacagagcccccctgagcagccccgtgcccaacagcagcaccagcagcaccgccagcctgagcggcaacagccccaagaccggcaccagcgagtgggccgtgccccagcccaccagactgaagtacagacagaagttcaacaccctggacaagagcatgagcggctacctgagcggcttccaggccagaaacgccctgctgcagagcaacctgagccagacccagctggccaccatctggaccctggccgacgtggacggcgacggccagctgaaggccgaggagttcatcctggccatgcacctgaccgacatggccaaggccggccagcccctgcccctgaccctgccccccgagctggtgccccccagcttcagaggcggcaagcagatcgacagcatcaacggcaccctgcccagctaccagaagatgcaggaggaggagccccagaagaagctgcccgtgaccttcgaggacaagagaaaggccaactacgagagaggcaacatggagctggagaagagaagacaggccctgatggagcagcagcagagagaggccgagagaaaggcccagaaggagaaggaggagtgggagagaaagcagagagagctgcaggagcaggagtggaagaagcagctggagctggagaagagactggagaagcagagagagctggagagacagagagaggaggagagaagaaaggacatcgagagaagagaggccgccaagcaggagctggagagacagagaagactggagtgggagagaatcagaagacaggagctgctgaaccagaagaacagagagcaggaggagatcgtgagactgaacagcaagaagaagaacctgcacctggagctggaggccctgaacggcaagcaccagcagatcagcggcagactgcaggacgtgagactgaagaagcagacccagaagaccgagctggaggtgctggacaagcagtgcgacctggagatcatggagatcaagcagctgcagcaggagctgcaggagtaccagaacaagctgatctacctggtgcccgagaagcagctgctgaacgagagaatcaagaacatgcagttcagcaacacccccgacagcggcgtgagcctgctgcacaagaagagcctggagtag

SEQ ID NO: 85719 - DNA, 3750 bp, Artificial Sequence
  Description of Artificial Sequence: Synthetic coding sequence
atgatggcccagttccccaccgccatgaacggcggccccaacatgtgggccatcaccagcgaggagagaaccaagcacgacagacagttcgacaacctgaagcccagcggcggctacatcaccggcgaccaggccagaaacttcttcctgcagagcggcctgcccgcccccgtgctggccgagatctgggccctgagcgacctgaacaaggacggcaagatggaccagcaggagttcagcatcgccatgaagctgatcaagctgaagctgcagggccagcagctgcccgtggtgctgccccccatcatgaagcagccccccatgttcagccccctgatcagcgccagattcggcatgggcagcatgcccaacctgagcatcccccagcccctgccccccgccgcccccatcaccagcctgagcagcgccaccagcggcaccaacctgccccccctgatgatgcccacccccctggtgcccagcgtgagcaccagcagcctgcccaacggcaccgccagcctgatccagcccctgcccatcccctacagcagcagcaccctgccccacggcagcagctacagcctgatgatgggcggcttcggcggcgccagcatccagaaggcccagagcctgatcgacctgggcagcagcagcagcaccagcagcaccgccagcctgagcggcaacagccccaagaccggcaccagcgagtgggccgtgccccagcccaccagactgaagtacagacagaagttcaacaccctggacaagagcatgagcggctacctgagcggcttccaggccagaaacgccctgctgcagagcaacctgagccagacccagctggccaccatctggaccctggccgacgtggacggcgacggccagctgaaggccgaggagttcatcctggccatgcacctgaccgacatggccaaggccggccagcccctgcccctgaccctgccccccgagctggtgccccccagcttcagaggcggcaagcagatcgacagcatcaacggcaccctgcccagctaccagaagatgcaggaggaggagccccagaagaagctgcccgtgaccttcgaggacaagagaaaggccaactacgagagaggcaacatggagctggagaagagaagacaggccctgatggagcagcagcagagagaggccgagagaaaggcccagaaggagaaggaggagtgggagagaaagcagagagagctgcaggagcaggagtggaagaagcagctggagctggagaagagactggagaagcagagagagctggagagacagagagaggaggagagaagaaaggacatcgagagaagagaggccgccaagcaggagctggagagacagagaagactggagtgggagagaatcagaagacaggagctgctgaaccagaagaacagagagcaggaggagatcgtgagactgaacagcaagaagaagaacctgcacctggagctggaggccctgaacggcaagcaccagcagatcagcggcagactgcaggacgtgagactgaagaagcagacccagaagaccgagctggaggtgctggacaagcagtgcgacctggagatcatggagatcaagcagctgcagcaggagctgcaggagtaccagaacaagctgatctacctggtgcccgagaagcagctgctgaacgagagaatcaagaacatgcagttcagcaacacccccgacagcggcgtgagcctgctgcacaagaagagcctggagaaggaggagctgtgccagagactgaaggagcagctggacgccctggagaaggagaccgccagcaagctgagcgagatggacagcttcaacaaccagctgaagtgcggcaacatggacgacagcgtgctgcagtgcctgctgagcctgctgagctgcctgaacaacctgttcctgctgctgaaggagctgagagagacctacaacacccagcagctggccctggagcagctgtacaagatcaagagagacaagctgaaggagatcgagagaaagagactggagctgatgcagaagaagaagctggaggacgaggccgccagaaaggccaagcagggcaaggagaacctgtggaaggagaacctgagaaaggaggaggaggagaagcagaagagactgcaggaggagaagacccaggagaagatccaggaggaggagagaaaggccgaggagaagcagagaaaggacaaggacaccctgaaggccgaggagaagaagagagagaccgccagcgtgctggtgaactacagagccctgtaccccttcgaggccagaaaccacgacgagatgagcttcaacagcggcgacatcatccaggtggacgagaagaccgtgggcgagcccggctggctgtacggcagcttccagggcaacttcggctggttcccctgcaactacgtggagaagatgcccagcagcgagaacgagaaggccgtgagccccaagaaggccctgctgccccccaccgtgagcctgagcgccaccagcaccagcagcgagcccctgagcagcaaccagcccgccagcgtgaccgactaccagaacgtgagcttcagcaacctgaccgtgaacaccagctggcagaagaagagcgccttcaccagaaccgtgagccccggcagcgtgagccccatccacggccagggccaggtggtggagaacctgaaggcccaggccctgtgcagctggaccgccaagaaggacaaccacctgaacttcagcaagcacgacatcatcaccgtgctggagcagcaggagaactggtggttcggcgaggtgcacggcggcagaggctggttccccaagagctacgtgaagatcatccccggcagcgaggtgaagagagaggagcccgaggccctgtacgccgccgtgaacaagaagcccaccagcgccgcctacagcgtgggcgaggagtacatcgccctgtacccctacagcagcgtggagcccggcgacctgaccttcaccgagggcgaggagatcctggtgacccagaaggacggcgagtggtggaccggcagcatcggcgacagaagcggcatcttccccagcaactacgtgaagcccaaggaccaggagagcttcggcagcgccagcaagagcggcgccagcaacaagaagcccgagatcgcccaggtgaccagcgcctacgtggccagcggcagcgagcagctgagcctggcccccggccagctgatcctgatcctgaagaagaacaccagcggctggtggcagggcgagctgcaggccagaggcaagaagagacagaagggctggttccccgccagccacgtgaagctgctgggccccagcagcgagagagccacccccgccttccaccccgtgtgccaggtgatcgccatgtacgactacgccgccaacaacgaggacgagctgagcttcagcaagggccagctgatcaacgtgatgaacaaggacgaccccgactggtggcagggcgagatcaacggcgtgaccggcctgttccccagcaactacgtgaagatgaccaccgacagcgaccccagccagcagtggtgcgccgacctgcagaccctggacaccatgcagcccatcgagagaaagagacagggctacatccacgagctgatccagaccgaggagagatacatggccgacctgcagctggtggtggaggtgagaagactgctgctggccagcagcagaggcatctgctgcctgagctag

SEQ ID NO: 85720 - DNA, 1899 bp, Artificial Sequence
  Description of Artificial Sequence: Synthetic coding sequence
atgaacagatacaccaccatcagacagctgggcgacggcacctacggcagcgtgctgctgggcagaagcatcgagagcggcgagctgatcgccatcaagaagatgaagagaaagttctacagctgggaggagtgcatgaacctgagagaggtgaagagcctgaagaagctgaaccacgccaacgtggtgaagctgaaggaggtgatcagagagaacgaccacctgtacttcatcttcgagtacatgaaggagaacctgtaccagctgatcaaggagagaaacaagctgttccccgagagcgccatcagaaacatcatgtaccagatcctgcagggcctggccttcatccacaagcacggcttcttccacagagacctgaagcccgagaacctgctgtgcatgggccccgagctggtgaagatcgccgacttcggcctggccagagagatcagaagcaagcccccctacaccgactacgtgagcaccagatggtacagagcccccgaggtgctgctgagaagcaccaactacagcagccccatcgacgtgtgggccgtgggctgcatcatggccgaggtgtacaccctgagacccctgttccccggcgccagcgagatcgacaccatcttcaagatctgccaggtgctgggcacccccaagaagaccgactggcccgagggctaccagctgagcagcgccatgaacttcagatggccccagtgcgtgcccaacaacctgaagaccctgatccccaacgccagcagcgaggccgtgcagctgctgagagacatgctgcagtgggaccccaagaagagacccaccgccagccaggccctgagatacccctacttccaggtgggccaccccctgggcagcaccacccagaacctgcaggacagcgagaagccccagaagggcatcctggagaaggccggcccccccccctacatcaagcccgtgccccccgcccagccccccgccaagccccacaccagaatcagcagcagacagcaccaggccagccagccccccctgcacctgacctacccctacaaggccgaggtgagcagaaccgaccaccccagccacctgcaggaggacaagcccagccccctgctgttccccagcctgcacaacaagcacccccagagcaagatcaccgccggcctggagcacaagaacggcgagatcaagcccaagagcagaagaagatggggcctgatcagcagaagcaccaaggacagcgacgactgggccgacctggacgacctggacttcagccccagcctgagcagaatcgacctgaagaacaagaagagacagagcgacgacaccctgtgcagattcgagagcgtgctggacctgaagcccagcgagcccgtgggcaccggcaacagcgcccccacccagaccagctaccagagaagagacacccccaccctgagaagcgccgccaagcagcactacctgaagcacagcagatacctgcccggcatcagcatcagaaacggcatcctgagcaaccccggcaaggagttcatcccccccaacccctggagcagcagcggcctgagcggcaagagcagcggcaccatgagcgtgatcagcaaggtgaacagcgtgggcagcagcagcaccagcagcagcggcctgaccggcaactacgtgcccagcttcctgaagaaggagatcggcagcgccatgcagagagtgcacctggcccccatccccgaccccagccccggctacagcagcctgaaggccatgagaccccaccccggcagacccttcttccacacccagcccagaagcacccccggcctgatccccagaccccccgccgcccagcccgtgcacggcagaaccgactgggccagcaagtacgccagcagaagatag

SEQ ID NO: 85721 - DNA, 1899 bp, Artificial Sequence; identical to SEQ ID NO: 85720
  Description of Artificial Sequence: Synthetic coding sequence

SEQ ID NO: 85722 - DNA, 738 bp, Artificial Sequence
  Description of Artificial Sequence: Synthetic coding sequence
atgtgcgccgaggtgggccccgccctgtgcagaggcatggagagaaacagcctgggctgctgcgaggcccccaagaagctgagcctgagcttcagcatcgaggccatcctgaagagacccgccagaagaagcgacatggacagacccgagggccccggcgaggagggccccggcgaggccgccgccagcggcagcggcctggagaagccccccaaggaccagccccaggagggcagaaagagcaagagaagagtgagaaccaccttcaccaccgagcagctgcacgagctggagaagatcttccacttcacccactaccccgacgtgcacatcagaagccagctggccgccagaatcaacctgcccgaggccagagtgcagatctggttccagaaccagagagccaagtggagaaagcaggagaagatcggcaacctgggcgccccccagcagctgagcgaggccagcgtggccctgcccaccaacctggacgtggccggccccacctggaccagcaccgccctgagaagactggccccccccaccagctgctgccccagcgcccaggaccagctggccagcgcctggttccccgcctggatcaccctgctgcccgcccacccctgggagacccagcccgtgcccggcctgcccatccaccagacctgcatccccgtgctgtgcatcctgccccccccccaccccaagtggggcagcatctgcgccaccagcacctag

SEQ ID NO: 85723 - DNA, 738 bp, Artificial Sequence; identical to SEQ ID NO: 85722
  Description of Artificial Sequence: Synthetic coding sequence

SEQ ID NO: 85724 - DNA, 1749 bp, Artificial Sequence
  Description of Artificial Sequence: Synthetic coding sequence
atggccaacgaggactgccccaaggccgccgacagccccttcagcagcgacaagcacgcccagctgatcctggcccagatcaacaagatgagaaacggccagcacttctgcgacgtgcagctgcaggtgggccaggagagcttcaaggcccacagactggtgctggccgccagcagcccctacttcgccgccctgttcaccggcggcatgaaggagagcagcaaggacgtggtgcccatcctgggcatcgaggccggcatcttccagatcctgctggacttcatctacaccggcatcgtgaacatcggcgtgaacaacgtgcaggagctgatcatcgccgccgacatgctgcagctgaccgaggtggtgcacctgtgctgcgagttcctgaagggccagatcgaccccctgaactgcatcggcatcttccagttcagcgagcagatcgcctgccacgacctgctggagttcagcgagaactacatccacgtgcacttcctggaggtgcacagcggcgaggagttcctggccctgaccaaggaccagctgatcaagatcctgagaagcgaggagctgagcatcgaggacgagtaccaggtgttcctggccgccatgcagtggatcctgaaggacctgggcaagagaagaaagcacgtggtggaggtgctggaccccatcagattccccctgctgcccccccagagactgctgaagtacatcgagggcgtgagcgacttcaacctgagagtggccctgcagaccctgctgaaggagtactgcgaggtgtgcaagagccccaaggagaacaagttctgcagcttcctgcagaccagcaaggtgagacccagaaagaaggccagaaagtacctgtacgccgtgggcggctacaccagactgcagggcggcagatggagcgacagcagagccctgagctgcgtggagagattcgacaccttcagccagtactggaccaccgtgagcagcctgcaccaggccagaagcggcctgggcgtgaccgtgctgggcggcatggtgtacgccatcggcggcgagaaggacagcatgatcttcgactgcaccgagtgctacgaccccgtgaccaagcagtggaccaccgtggccagcatgaaccaccccagatgcggcctgggcgtgtgcgtgtgctacggcgccatctacgccctgggcggctgggtgggcgccgagatcggcaacaccatcgagagattcgaccccgacgagaacaagtgggaggtggtgggcaacatggccgtgagcagatactacttcggctgctgcgagatgcagggcctgatctacgtgatcggcggcatcagcaacgagggcatcgagctgagaagcttcgaggtgtacgaccccctgagcaagagatggagccccctgccccccatgggcaccagaagagcctacctgggcgtggccgccctgaacgactgcatctacagcgtgggcggctggaacgagacccaggacgccctgcacaccgtggagaagtacagcttcgaggaggagaagtgggtggaggtggccagcatgaaggtgcccagagccggcatgtgcgtggtggccgtgaacggcctgctgtacgtgagcggcggcagaagcagcagccacgacttcctggcccccgacacccacagatacgaggtgttcagactgaagtgggagaacatgtgcatcctgttcaacgaccacaagaccctgaccaagggcatcttcaacctgtag

SEQ ID NO: 85725 - DNA, 1755 bp, Artificial Sequence
  Description of Artificial Sequence: Synthetic coding sequence
atggccaacgaggactgccccaaggccgccgacagccccttcagcagcgacaagcacgcccagctgatcctggcccagatcaacaagatgagaaacggccagcacttctgcgacgtgcagctgcaggtgggccaggagagcttcaaggcccacagactggtgctggccgccagcagcccctacttcgccgccctgttcaccggcggcatgaaggagagcagcaaggacgtggtgcccatcctgggcatcgaggccggcatcttccagatcctgctggacttcatctacaccggcatcgtgaacatcggcgtgaacaacgtgcaggagctgatcatcgccgccgacatgctgcagctgaccgaggtggtgcacctgtgctgcgagttcctgaagggccagatcgaccccctgaactgcatcggcatcttccagttcagcgagcagatcgcctgccacgacctgctggagttcagcgagaactacatccacgtgcacttcctggaggtgcacagcggcgaggagttcctggccctgaccaaggaccagctgatcaagatcctgagaagcgaggagctgagcatcgaggacgagtaccaggtgttcctggccgccatgcagtggatcctgaaggacctgggcaagagaagaaagcacgtggtggaggtgctggaccccatcagattccccctgctgcccccccagagactgctgaagtacatcgagggcgtgagcgacttcaacctgagagtggccctgcagaccctgctgaaggagtactgcgaggtgtgcaagagccccaaggagaacaagttctgcagcttcctgcagaccagcaaggtgagacccagaaagaaggccagaaagtacctgtacgccgtgggcggctacaccagactgcagggcggcagatggagcgacagcagagccctgagctgcgtggagagattcgacaccttcagccagtactggaccaccgtgagcagcctgcaccaggccagaagcggcctgggcgtgaccgtgctgggcggcatggtgtacgccatcggcggcgagaaggacagcatgatcttcgactgcaccgagtgctacgaccccgtgaccaagcagtggaccaccgtggccagcatgaaccaccccagatgcggcctgggcgtgtgcgtgtgctacggcgccatctacgccctgggcggctgggtgggcgccgagatcggcaacaccatcgagagattcgaccccgacgagaacaagtgggaggtggtgggcaacatggccgtgagcagatactacttcggctgctgcgagatgcagggcctgatctacgtgatcggcggcatcagcaacgagggcatcgagctgagaagcttcgaggtgtacgaccccctgagcaagagatggagccccctgccccccatgggcaccagaagagcctacctgggcgtggccgccctgaacgactgcatctacagcgtgggcggctggaacgagacccaggacgccctgcacaccgtggagaagtacagcttcgaggaggagaagtgggtggaggtggccagcatgaaggtgcccagagccggcatgtgcgtggtggccgtgaacggcctgctgtacgtgagcggcggcagaagcagcagccacgacttcctggcccccggcaccctggacagcgtggaggtgtacaacccccacagcgacacctggaccgagatcggcaacatgatcaccagcagatgcgagggcggcgtggccgtgctgtag

SEQ ID NO: 85726 - DNA, 3879 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcaagagattcgccagcggcagcgccgacaagagcgtgatcatctggaccagcaagctggagggcatcctgaagtacaccagctggagcgtgatgagcagcctgcacctgcacctgcccttcctgggcctgcacaagaccgtgagagtgaccgccaccgacaaggcccccaagggccagggcggcagaatcgactgcctgagacccagcgtgcagaaccagcccggccagaagcacaacgacgccatccagtgcgtgagctacaaccccatcacccaccagctggccagctgcagcagcagcgacttcggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagcagatgggagagcttctggatgaacagagagaacgaggacgccgaggacgtgatcgtgaacagatacatccaggagatccccagcaccctgaagagcgccgtgtacagcagccagggcagcgaggccgaggaggaggagcccgaggaggaggacgacagccccagagacgacaacctggaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85727 - DNA, 3549 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcaagagattcgccagcggcagcgccgacaagagcgtgatcatctggaccagcaagctggagggcatcctgaagtacacccacaacgacgccatccagtgcgtgagctacaaccccatcacccaccagctggccagctgcagcagcagcgacttcggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85728 - DNA, 3726 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcaagagattcgccagcggcagcgccgacaagagcgtgatcatctggaccagcaagctggagggcatcctgaagtacacccacaacgacgccatccagtgcgtgagctacaaccccatcacccaccagctggccagctgcagcagcagcgacttcggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagcagatgggagagcttctggatgaacagagagaacgaggacgccgaggacgtgatcgtgaacagatacatccaggagatccccagcaccctgaagagcgccgtgtacagcagccagggcagcgaggccgaggaggaggagcccgaggaggaggacgacagccccagagacgacaacctggaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85729 - DNA, 3396 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggccgaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85730 - DNA, 3276 bp, Artificial Sequence
  Description of Artificial Sequence: Synthetic coding sequence
atgttcaacggcatcatcagcatcagaaacaagaacggcgaggagaaggtgaagatcgagagacccggcggcagcctgagccccatctggagcatctgctggaaccccagcagcagatgggagagcttctggatgaacagagagaacgaggacgccgaggacgtgatcgtgaacagatacatccaggagatccccagcaccctgaagagcgccgtgtacagcagccagggcagcgaggccgaggaggaggagcccgaggaggaggacgacagccccagagacgacaacctggaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85731 - DNA, 3099 bp, Artificial Sequence
  Description of Artificial Sequence: Synthetic coding sequence
atgttcaacggcatcatcagcatcagaaacaagaacggcgaggagaaggtgaagatcgagagacccggcggcagcctgagccccatctggagcatctgctggaaccccagcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85732 - DNA, 3252 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcctgtggagccccgagcagaagagcgtgagcaagcacaagagcagcagcaagatcatctgctgcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggccgaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgagaaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85733 - DNA, 2886 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacggcaagagattcgccagcggcagcgccgacaagagcgtgatcatctggaccagcaagctggagggcatcctgaagtacacccacaacgacgccatccagtgcgtgagctacaaccccatcacccaccagctggccagctgcagcagcagcgacttcggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggccttcatcagagtgcaggacctgagatacctggagctgatcagcagcatcgaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgtgcgagaacaccctgcacctgggccaggccgagcagggccccagatgcctgcaggccggccccgccagactgtag

SEQ ID NO: 85734 - DNA, 3357 bp, Artificial Sequence
  Description of Artificial Sequence: Synthetic coding sequence
atgagagccgtgctgacctggagagacaaggccgagcactgcatcaacgacatcgccttcaagcccgacggcacccagctgatcctggccgccggcagcagactgctggtgtacgacaccagcgacggcaccctgctgcagcccctgaagggccacaaggacaccgtgtactgcgtggcctacgccaaggacgtgctgtgcatcgagggcctgtggagccccgagcagaagagcgtgagcaagcacaagagcagcagcaagatcatctgctgcagctggaccaacgacggccagtacctggccctgggcatgttcaacggcatcatcagcatcagaaacaagaacggcgaggagaaggtgaagatcgagagacccggcggcagcctgagccccatctggagcatctgctggaaccccagcagagaggagagaaacgacatcctggccgtggccgactggggccagaaggtgagcttctaccagctgagcggcaagcagatcggcaaggacagagccctgaacttcgacccctgctgcatcagctacttcaccaagggcgagtacatcctgctgggcggcagcgacaagcaggtgagcctgttcaccaaggacggcgtgagactgggcaccgtgggcgagcagaacagctgggtgtggacctgccaggccaagcccgacagcaactacgtggtggtgggctgccaggacggcaccatcagcttctaccagctgatcttcagcaccgtgcacggcctgtacaaggacagatacgcctacagagacagcatgaccgacgtgatcgtgcagcacctgatcaccgagcagaaggtgagaatcaagtgcaaggagctggtgaagaagatcgccatctacagaaacagactggccatccagctgcccgagaagatcctgatctacgagctgtacagcgaggacctgagcgacatgcactacagagtgaaggagaagatcatcaagaagttcgagtgcaacctgctggtggtgtgcgccaaccacatcatcctgtgccaggagaagagactgcagtgcctgagcttcagcggcgtgaaggagagagagtggcagatggagagcctgatcagatacatcaaggtgatcggcggcccccccggcagagagggcctgctggtgggcctgaagaacggccagatcctgaagatcttcgtggacaacctgttcgccatcgtgctgctgaagcaggccaccgccgtgagatgcctggacatgagcgccagcagaaagaagctggccgtggtggacgagaacgacacctgcctggtgtacgacatcgacaccaaggagctgctgttccaggagcccaacgccaacagcgtggcctggaacacccagtgcgaggacatgctgtgcttcagcggcggcggctacctgaacatcaaggccagcaccttccccgtgcacagacagaagctgcagggcttcgtggtgggctacaacggcagcaagatcttctgcctgcacgtgttcagcatcagcgccgtggaggtgccccagagcgcccccatgtaccagtacctggacagaaagctgttcaaggaggcctaccagatcgcctgcctgggcgtgaccgacaccgactggagagagctggccatggaggccctggagggcctggacttcgagaccgccaagaaggagagaaagaagagaggcgagaccaacaacgacctgttcctggccgacgtgttcagctaccagggcaagttccacgaggccgccaagctgtacaagagaagcggccacgagaacctggccctggagatgtacaccgacctgtgcatgttcgagtacgccaaggacttcctgggcagcggcgaccccaaggagaccaagatgctgatcaccaagcaggccgactgggccagaaacatcaaggagcccaaggccgccgtggagatgtacatcagcgccggcgagcacgtgaaggccatcgagatctgcggcgaccacggctgggtggacatgctgatcgacatcgccagaaagctggacaaggccgagagagagcccctgctgctgtgcgccacctacctgaagaagctggacagccccggctacgccgccgagacctacctgaagatgggcgacctgaagagcctggtgcagctgcacgtggagacccagagatgggacgaggccttcgccctgggcgagaagcaccccgagttcaaggacgacatctacatgccctacgcccagtggctggccgagaacgacagattcgaggaggcccagaaggccttccacaaggccggcagacagagagaggccgtgcaggtgctggagcagctgaccaacaacgccgtggccgagagcagattcaacgacgccgcctactactactggatgctgagcatgcagtgcctggacatcgcccaggccgaccccgcccagaaggacaccatgctgggcaagttctaccacttccagagactggccgagctgtaccacggctaccacgccatccacagacacaccgaggaccccttcagcgtgcacagacccgagaccctgttcaacatcagcagattcctgctgcacagcctgcccaaggacacccccagcggcatcagcaaggtgaagatcctgttcaccctggccaagcagagcaaggccctgggcgcctacagactggccagacacgcctacgacaagctgagaggcctgtacatccccgccagattccagaagagcatcgagctgggcaccctgaccatcagagccaagcccttccacgacagcgaggagctggtgcccctgtgctacagatgcagcaccaacaaccccctgctgaacaacctgggcaacgtgtgcatcaactgcagacagcccttcatcttcagcgccagcagctacgacgtgctgcacctggtggagttctacctggaggagggcatcaccgacgaggaggccatcagcctgatcgacctggaggtgctgagacccaagagagacgacagacagctggagatcgccaacaacagcagccagatcctgagactggtggagaccaaggacagcatcggcgacgaggaccccttcaccgccaagctgagcttcgagcagggcggcagcgagttcgtgcccgtggtggtgagcagactggtgctgagaagcatgagcagaagagacgtgctgatcaagagatggcccccccccctgagatggcagtacttcagaagcctgctgcccgacgccagcatcaccatgtgccccagctgcttccagatgttccacagcgaggactacgagctgctggtgctgcagcacggctgctgcccctactgcagaagatgcaaggacgaccccggcccctag

SEQ ID NO: 85735 - DNA, 5250 bp, Artificial Sequence
  Description of Artificial Sequence: Synthetic coding sequence
atgcacctgaagcacctgagaaccctgctgagcccccaggacggcgccgccaaggtgacctgcatggcctggagccagaacaacgccaagttcgccgtgtgcaccgtggacagagtggtgctgctgtacgacgagcacggcgagagaagagacaagttcagcaccaagcccgccgacatgaagtacggcagaaagagctacatggtgaagggcatggccttcagccccgacagcaccaagatcgccatcggccagaccgacaacatcatctacgtgtacaagatcggcgaggactggggcgacaagaaggtgatctgcaacaagttcatccagaccagcgccgtgacctgcctgcagtggcccgccgagtacatcatcgtgttcggcctggccgagggcaaggtgagactggccaacaccaagaccaacaagagcagcaccatctacggcaccgagagctacgtggtgagcctgaccaccaactgcagcggcaagggcatcctgagcggccacgccgacggcaccatcgtgagatacttcttcgacgacgagggcagcggcgagagccagggcaagctggtgaaccacccctgccccccctacgccctggcctgggccaccaacagcatcgtggccgccggctgcgacagaaagatcgtggcctacggcaaggagggccacatgctgcagaccttcgactacagcagagacccccaggagagagagttcaccaccgccgtgagcagccccggcggccagagcgtggtgctgggcagctacgacagactgagagtgttcaactggatccccagaagaagcatctgggaggaggccaagcccaaggagatcaccaacctgtacaccatcaccgccctggcctggaagagagacggcagcagactgtgcgtgggcaccctgtgcggcggcgtggagcagttcgactgctgcctgagaagaagcatctacaagaacaagttcgagctgacctacgtgggccccagccaggtgatcgtgaagaacctgagcagcggcaccagagtggtgctgaagagccactacggctacgaggtggaggaggtgaagatcctgggcaaggagagatacctggtggcccacaccagcgagaccctgctgctgggcgacctgaacaccaacagactgagcgagatcgcctggcagggcagcggcggcaacgagaagtacttcttcgagaacgagaacgtgtgcatgatcttcaacgccggcgagctgaccctggtggagtacggcaacaacgacaccctgggcagcgtgagaaccgagttcatgaacccccacctgatcagcgtgagaatcaacgagagatgccagagaggcaccgaggacaacaagaagctggcctacctgatcgacatcaagaccatcgccatcgtggacctgatcggcggctacaacatcggcaccgtgagccacgagagcagagtggactggctggagctgaacgagaccggccacaagctgctgttcagagacagaaagctgagactgcacctgtacgacatcgagagctgcagcaagaccatgatcctgaacttctgcagctacatgcagtgggtgcccggcagcgacgtgctggtggcccagaacagaaacagcctgtgcgtgtggtacaacatcgaggcccccgagagagtgaccatgttcaccatcagaggcgacgtgatcggcctggagagaggcggcggcaagaccgaggtgatggtgatggagggcgtgaccaccgtggcctacaccctggacgagggcctgatcgagttcggcaccgccatcgacgacggcaactacatcagagccaccgccttcctggagaccctggagatgacccccgagaccgaggccatgtggaagaccctgagcaagctggccctggaggccagacagctgcacatcgccgagagatgcttcagcgccctgggccaggtggccaaggccagattcctgcacgagaccaacgagatcgccgaccaggtgagcagagagtacggcggcgagggcaccgacttctaccaggtgagagccagactggccatgctggagaagaactacaagctggccgagatgatcttcctggagcagaacgccgtggaggaggccatgggcatgtaccaggagctgcacagatgggacgagtgcatcgccgtggccgaggccaagggccaccccgccctggagaagctgagaagaagctactaccagtggctgatggacacccagcaggaggagagagccggcgagctgcaggagagccagggcgacggcctggccgccatcagcctgtacctgaaggccggcctgcccgccaaggccgccagactggtgctgaccagagaggagctgctggccaacaccgagctggtggagcacatcaccgccgccctgatcaagggcgagctgtacgagagagccggcgacctgttcgagaagatccacaacccccagaaggccctggagtgctacagaaagggcaacgccttcatgaaggccgtggagctggccagactggccttccccgtggaggtggtgaagctggaggaggcctggggcgaccacctggtgcagcagaagcagctggacgccgccatcaaccactacatcgaggccagatgcagcatcaaggccatcgaggccgccctgggcgccagacagtggaagaaggccatctacatcctggacctgcaggacagaaacaccgccagcaagtactaccccctggtggcccagcactacgccagcctgcaggagtacgagatcgccgaggagctgtacaccaagggcgacagaaccaaggacgccatcgacatgtacacccaggccggcagatgggagcaggcccacaagctggccatgaagtgcatgagacccgaggacgtgagcgtgctgtacatcacccaggcccaggagatggagaagcagggcaagtacagagaggccgagagactgtacgtgaccgtgcaggagcccgacctggccatcaccatgtacaagaagcacaagctgtacgacgacatgatcagactggtgggcaagcaccaccccgacctgctgagcgacacccacctgcacctgggcaaggagctggaggccgagggcagactgcaggaggccgagtaccactacctggaggcccaggagtggaaggccaccgtgaacatgtacagagccagcggcctgtgggaggaggcctacagagtggccagaacccagggcggcgccaacgcccacaagcacgtggcctacctgtgggccaagagcctgggcggcgaggccgccgtgagactgctgaacaagctgggcctgctggaggccgccgtggaccacgccgccgacaactgcagcttcgagttcgccttcgagctgagcagactggccctgaagcacaagacccccgaggtgcacctgaagtacgccatgttcctggaggacgagggcaagttcgaggaggccgaggccgagttcatcagagccggcaagcccaaggaggccgtgctgatgttcgtgcacaaccaggactgggaggccgcccagagagtggccgaggcccacgaccccgacagcgtggccgaggtgctggtgggccaggccagaggcgccctggaggagaaggacttccagaaggccgagggcctgctgctgagagcccagagacccggcctggccctgaactactacaaggaggccggcctgtggagcgacgccctgagaatctgcaaggactacgtgcccagccagctggaggccctgcaggaggagtacgagagagaggccaccaagaagggcgccagaggcgtggagggcttcgtggagcaggccagacactgggagcaggccggcgagtacagcagagccgtggactgctacctgaaggtgagagacagcggcaacagcggcctggccgagaagtgctggatgaaggccgccgagctgagcatcaagttcctgcccccccagagaaacatggaggtggtgctggccgtgggcccccagctgatcggcatcggcaagcacagcgccgccgccgagctgtacctgaacctggacctggtgaaggaggccatcgacgccttcatcgagggcgaggagtggaacaaggccaagagagtggccaaggagctggaccccagatacgaggactacgtggaccagcactacaaggagttcctgaagaaccagggcaaggtggacagcctggtgggcgtggacgtgatcgccgccctggacctgtacgtggagcagggccagtgggacaagtgcatcgagaccgccaccaagcagaactacaagatcctgcacaagtacgtggccctgtacgccacccacctgatcagagagggcagcagcgcccaggccctggccctgtacgtgcagcacggcgcccccgccaacccccagaacttcaacatctacaagagaatcttcaccgacatggtgagcagccccggcaccaactgcgccgaggcctaccacagctgggccgacctgagagacgtgctgttcaacctgtgcgagaacctggtgaagagcagcgaggccaacagccccgcccacgaggagttcaagaccatgctgctgatcgcccactactacgccaccagaagcgccgcccagagcgtgaagcagctggagaccgtggccgccagactgagcgtgagcctgctgagacacacccagctgctgcccgtggacaaggccttctacgaggccggcatcgccgccaaggccgtgggctgggacaacatggccttcatcttcctgaacagattcctggacctgaccgacgccatcgaggagggcaccctggacggcctggaccacagcgacttccaggacaccgacatccccttcgaggtgcccctgcccgccaagcagcacgtgcccgaggccgagagagaggaggtgagagactgggtgctgaccgtgagcatggaccagagactggagcaggtgctgcccagagacgagagaggcgcctacgaggccagcctggtggccgccagcaccggcgtgagagccctgccctgcctgatcaccggctaccccatcctgagaaacaagatcgagttcaagagacccggcaaggccgccaacaaggacaactggaacaagttcctgatggccatcaagaccagccacagccccgtgtgccaggacgtgctgaagttcatcagccagtggtgcggcggcctgcccagcaccagcttcagcttccagtag

SEQ ID NO: 85736 - DNA, 1536 bp, Artificial Sequence
  Description of Artificial Sequence: Synthetic coding sequence
atggcctggagccagaacaacgccaagttcgccgtgtgcaccgtggacagagtggtgctgctgtacgacgagcacggcgagagaagagacaagttcagcaccaagcccgccgacatgaagtacggcagaaagagctacatggtgaagggcatggccttcagccccgacagcaccaagatcgccatcggccagaccgacaacatcatctacgtgtacaagatcggcgaggactggggcgacaagaaggtgatctgcaacaagttcatccagaccagcgccgtgacctgcctgcagtggcccgccgagtacatcatcgtgttcggcctggccgagggcaaggtgagactggccaacaccaagaccaacaagagcagcaccatctacggcaccgagagctacgtggtgagcctgaccaccaactgcagcggcaagggcatcctgagcggccacgccgacggcaccatcgtgagatacttcttcgacgacgagggcagcggcgagagccagggcaagctggtgaaccacccctgccccccctacgccctggcctgggccaccaacagcatcgtggccgccggctgcgacagaaagatcgtggcctacggcaaggagggccacatgctgcagaccttcgactacagcagagacccccaggagagagagttcaccaccgccgtgagcagccccggcggccagagcgtggtgctgggcagctacgacagactgagagtgttcaactggatccccagaagaagcatctgggaggaggccaagcccaaggagatcaccaacctgtacaccatcaccgccctggcctggaagagagacggcagcagactgtgcgtgggcaccctgtgcggcggcgtggagcagttcgactgctgcctgagaagaagcatctacaagaacaagttcgagctgacctacgtgggccccagccaggtgatcgtgaagaacctgagcagcggcaccagagtggtgctgaagagccactacggctacgaggtggaggaggtgaagatcctgggcaaggagagatacctggtggcccacaccagcgagaccctgctgctgggcgacctgaacaccaacagactgagcgagatcgcctggcagggcagcggcggcaacgagaagtacttcttcgagaacgagaacgtgtgcatgatcttcaacgccggcgagctgaccctggtggagtacggcaacaacgacaccctgggcagcgtgagaaccgagttcatgaacccccacctgatcagcgtgagaatcaacgagagatgccagagaggcaccgaggacaacaagaagctggcctacctgatcgacatcaagaccatcgccatcgtggacctgatcggcggctacaacatcggcaccgtgagccacgagagcagagtggactggctggagctgaacgagaccggccacaagctgctgttcagagacagaaagctgagagtgagaagagccaccaaggccctgggcatcggctggcccaccgagggcgtgagacaggccgccaccagagactag

SEQ ID NO: 85737 - DNA, 369 bp, Artificial Sequence
  Description of Artificial Sequence: Synthetic coding sequence
atgacccacctgctgctgaccgccaccgtgacccccagcgagcagaacagcagcagagagcccggctgggagaccgccatggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggtgagaagcgcctgcctgccccccaccagctggcccggcaccctggtgcactaccccctgatccccctgcccagctag

SEQ ID NO: 85738 - DNA, 447 bp, Artificial Sequence
  Description of Artificial Sequence: Synthetic coding sequence
atggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaagagcctggccgtgagccccagactggagtgcaccggcgccatcagcgcccactgcaagctgtgcctgagcgacagcagcgacagccccaccagccccagcagagtgggcggcaccaccggccacagatgcagcgagctggcccagatctacagcaaggccgagagaagcagcaccgccgccaccagcagccccaacagcagaaaggagaacgccgccagaaaggtgagcggctag

SEQ ID NO: 85739 - DNA, 399 bp, Artificial Sequence
  Description of Artificial Sequence: Synthetic coding sequence
atggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagatacagagtggagtacgaggccctgtgcaaggtggaggccgagcagaacgagttcatcgaccagttcatcttccagaagtag

SEQ ID NO: 85740 - DNA, 216 bp, Artificial Sequence
  Description of Artificial Sequence: Synthetic coding sequence
gacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggtgagcggctag

SEQ ID NO: 85741 - DNA, 345 bp, Artificial Sequence
  Description of Artificial Sequence: Synthetic coding sequence
atggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagaaacgagctgaagatcagcctgctgtag

SEQ ID NO: 85742 - DNA, 477 bp, Artificial Sequence
  Description of Artificial Sequence: Synthetic coding sequence
atgacccacctgctgctgaccgccaccgtgacccccagcgagcagaacagcagcagagagcccggctgggagaccgccatggccaaggacatcctgggcgaggccggcctgcacttcgacgagctgaacaagctgagagtgctggaccccgaggtgacccagcagaccatcgagctgaaggaggagtgcaaggacttcgtggacaagatcggccagttccagaagatcgtgggcggcctgatcgagctggtggaccagctggccaaggaggccgagaacgagaagatgaaggccatcggcgccagaaacctgctgaagagcatcgccaagcagagagaggcccagcagcagcagctgcaggccctgatcgccgagaagaagatgcagctggagagatacagagtggagtacgaggccctgtgcaaggtggaggccgagcagaacgagttcatcgaccagttcatcttccagaagtag

SEQ ID NO: 85743 - DNA, 399 bp, Artificial Sequence; identical to SEQ ID NO: 85739
  Description of Artificial Sequence: Synthetic coding sequence

SEQ ID NO: 85744 - DNA, 642 bp, Artificial Sequence
  Description of Artificial Sequence: Synthetic coding sequence
atggaggacctgctggacctggacgaggagctgagatacagcctggccaccagcagagccaagatgggcagaagagcccagcaggagagcgcccaggccgagaaccacctgaacggcaagaacagcagcctgaccctgaccggcgagaccagcagcgccaagctgcccagatgcagacagggcggctgggccggcgacagcgtgaaggccagcaacggcacccagaccggcaagcagcagctggacctgaacgcctgctaccacaagacccaccacagagacctgggcctggccagcctggaggaggccgacatccccatcatccccgacctggaggaggtgcaggaggaggacttcgtgctgcaggtggccgccccccccagcatccagatcaagagagtgatgacctacagagacctggacaacgacctgatgaagtacagcgccatccagaccctggacggcgagatcgacctgaagctgctgaccaaggtgctggcccccgagcacgaggtgagagaggacgacgtgggctgggactgggaccacctgttcaccgaggtgagcagcgaggtgctgaccgagtgggaccccctgcagaccgagaaggaggaccccgccggccaggccagacacacctag

SEQ ID NO: 85745 - DNA, 627 bp, Artificial Sequence
  Description of Artificial Sequence: Synthetic coding sequence
atggaggacctgctggacctggacgaggagctgagatacagcctggccaccagcagagccaagatgggcagaagagcccagcaggagagcgcccaggccgagaaccacctgaacggcaagaacagcagcctgaccctgaccggcgagaccagcagcgccaagctgcccagatgcagacagggcggctgggccggcgacagcgtgaaggccagcaagttcagaagaaaggccagcgaggagatcgaggacttcagactgagaccccagagcctgaacggcagcgactacggcggcgacatccccatcatccccgacctggaggaggtgcaggaggaggacttcgtgctgcaggtggccgccccccccagcatccagatcaagagagtgatgacctacagagacctggacaacgacctgatgaagtacagcgccatccagaccctggacggcgagatcgacctgaagctgctgaccaaggtgctggcccccgagcacgaggtgagagaggacgacgtgggctgggactgggaccacctgttcaccgaggtgagcagcgaggtgctgaccgagtgggaccccctgcagaccgagaaggaggaccccgccggccaggccagacacacctag

SEQ ID NO: 85746 - DNA, 342 bp, Artificial Sequence
  Description of Artificial Sequence: Synthetic coding sequence
atggaggacctgctggacctggacgaggagctgagatacagcctggccaccagcagagccaagatgggcagaagagcccagcaggagagcgcccaggccgagaaccacctgaacggcaagaacagcagcctgaccctgaccggcgagaccagcagcgccaagctgcccagatgcagacagggcggctgggccggcgacagcgtgaaggccagcaagttcagaagaaaggccagcgaggagatcgaggagtacgtgagcagcatcctgatcctgatggtgagctacgtggacctgggccagcagtgcagcctgggcggccacgacctgttccacctgtgctag

SEQ ID NO: 85747 - DNA, 1290 bp, Artificial Sequence
  Description of Artificial Sequence: Synthetic coding sequence
atgaccgccgccctggccgtggtgaccaccagcggcctggaggacggcgtgcccagaagcagaggcgagggcaccggcgaggtggtgctggagagaggccccggcgccgcctaccacatgttcgtggtgatggaggacctggtggagaagctgaagctgctgagatacgaggaggagttcctgagaaagagcaacctgaaggcccccagcagacactacttcgccctgcccaccaaccccggcgagcagttctacatgttctgcaccctggccgcctggctgatcaacaaggccggcagacccttcgagcagccccaggagtacgacgaccccaacgccaccatcagcaacatcctgagcgagctgagaagcttcggcagaaccgccgacttcccccccagcaagctgaagagcggctacggcgagcacgtgtgctacgtgctggactgcttcgccgaggaggccctgaagtacatcggcttcacctggaagagacccatctaccccgtggaggagctggaggaggagagcgtggccgaggacgacgccgagctgaccctgaacaaggtggacgaggagttcgtggaggaggagaccgacaacgaggagaacttcatcgacctgaacgtgctgaaggcccagacctaccacctggacatgaacgagaccgccaagcaggaggacatcctggagagcaccaccgacgccgccgagtggagcctggaggtggagagagtgctgccccagctgaaggtgaccatcagaaccgacaacaaggactggagaatccacgtggaccagatgcaccagcacagaagcggcatcgagagcgccctgaaggagaccaagggcttcctggacaagctgcacaacgagatcaccagaaccctggagaagatcagcagcagagagaagtacatcaacaaccagctggagaacctggtgcaggagtacagagccgcccaggcccagctgagcgaggccaaggagagataccagcagggcaacggcggcgtgaccgagagaaccagactgctgagcgaggtgatggaggagctggagaaggtgaagcaggagatggaggagaagggcagcagcatgaccgacggcgcccccctggtgaagatcaagcagagcctgaccaagctgaagcaggagaccgtggagatggacatcagaatcggcatcgtggagcacaccctgctgcagagcaagctgaaggagaagagcaacatgaccagaaacatgcacgccaccgtgatccccgagcccgccaccggcttctactag

SEQ ID NO: 85748 - DNA, 2334 bp, Artificial Sequence
  Description of Artificial Sequence: Synthetic coding sequence
atgagactgaagatcagcctgctgaaggagcccaagcaccaggagctggtgagctgcgtgggctggaccaccgccgaggagctgtacagctgcagcgacgaccaccagatcgtgaagtggaacctgctgaccagcgagaccacccagatcgtgaagctgcccgacgacatctaccccatcgacttccactggttccccaagagcctgggcgtgaagaagcagacccaggccgagagcttcgtgctgaccagcagcgacggcaagttccacctgatcagcaagctgggcagagtggagaagagcgtggaggcccactgcggcgccgtgctggccggcagatggaactacgagggcaccgccctggtgaccgtgggcgaggacggccagatcaagatctggagcaagaccggcatgctgagaagcaccctggcccagcagggcacccccgtgtacagcgtggcctggggccccgacagcgagaaggtgctgtacaccgccggcaagcagctgatcatcaagcccctgcagcccaacgccaaggtgctgcagtggaaggcccacgacggcatcatcctgaaggtggactggaacagcgtgaacgacctgatcctgagcgccggcgaggactgcaagtacaaggtgtgggacagctacggcagacccctgtacaacagccagccccacgagcaccccatcaccagcgtggcctgggcccccgacggcgagctgttcgccgtgggcagcttccacaccctgagactgtgcgacaagaccggctggagctacgccctggagaagcccaacaccggcagcatcttcaacatcgcctggagcatcgacggcacccagatcgccggcgcctgcggcaacggccacgtggtgttcgcccacgtggtggagcagcactgggagtggaagaacttccaggtgaccctgaccaagagaagagccatgcaggtgagaaacgtgctgaacgacgccgtggacctgctggagttcagagacagagtgatcaaggccagcctgaactacgcccacctggtggtgagcaccagcctgcagtgctacgtgttcagcaccaagaactggaacacccccatcatcttcgacctgaaggagggcaccgtgagcctgatcctgcaggccgagagacacttcctgctggtggacggcagcagcatctacctgtacagctacgagggcagattcatcagcagccccaagttccccggcatgagaaccgacatcctgaacgcccagaccgtgagcctgagcaacgacaccatcgccatcagagacaaggccgacgagaagatcatcttcctgttcgaggccagcaccggcaagcccctgggcgacggcaagttcctgagccacaagaacgagatcctggagatcgccctggaccagaagggcctgaccaacgacagaaagatcgccttcatcgacaagaacagagacctgtgcatcaccagcgtgaagagattcggcaaggaggagcagatcatcaagctgggcaccatggtgcacaccctggcctggaacgacacctgcaacatcctgtgcggcctgcaggacaccagattcatcgtgtggtactaccccaacaccgtgtacgtggacagagacatcctgcccaagaccctgtacgagagagacgccagcgagttcagcaagaacccccacatcgtgagcttcgtgggcaaccaggtgaccatcagaagagccgacggcagcctggtgcacatcagcatcaccccctaccccgccatcctgcacgagtacgtgagcagcagcaagtgggaggacgccgtgagactgtgcagattcgtgaaggagcagaccatgtgggcctgcctggccgccatggccgtggccaacagagacatgaccaccgccgagatcgcctacgccgccatcggcgagatcgacaaggtgcagtacatcaacagcatcaagaacctgcccagcaaggagagcaagatggcccacatcctgctgttcagcggcaacatccaggaggccgagatcgtgctgctgcaggccggcctggtgtaccaggccatccagatcaacatcaacctgtacaactgggagagagccctggagctggccgtgaagtacaagacccacgtggacaccgtgctggcctacagacagaagttcctggagaccttcggcaagcaggagaccaacaagagatacctgcactacgccgagggcctgcagatcgactgggagaagatcaaggccaagatcgagatggagatcaccaaggagagagagcagagcagcagcagccagagcagcaagagcatcggcctgaagccctag

SEQ ID NO: 85749 - DNA, 195 bp, Artificial Sequence
  Description of Artificial Sequence: Synthetic coding sequence
atgagactgaagatcagcctgctgaaggagcccaagcaccaggagctggtgagctgcgtgggctggaccaccgccgaggagctgtacagctgcagcgacgaccaccagatcgtgaagtggaacctgctgaccagcgagaccacccagatcgtgaagctgcccgacgacatctaccccatcgacttccactggtag

SEQ ID NO: 85750 - DNA, 1923 bp, Artificial Sequence
  Description of Artificial Sequence: Synthetic coding sequence
atgctgagaagcaccctggcccagcagggcacccccgtgtacagcgtggcctggggccccgacagcgagaaggtgctgtacaccgccggcaagcagctgatcatcaagcccctgcagcccaacgccaaggtgctgcagtggaaggcccacgacggcatcatcctgaaggtggactggaacagcgtgaacgacctgatcctgagcgccggcgaggactgcaagtacaaggtgtgggacagctacggcagacccctgtacaacagccagccccacgagcaccccatcaccagcgtggcctgggcccccgacggcgagctgttcgccgtgggcagcttccacaccctgagactgtgcgacaagaccggctggagctacgccctggagaagcccaacaccggcagcatcttcaacatcgcctggagcatcgacggcacccagatcgccggcgcctgcggcaacggccacgtggtgttcgcccacgtggtggagcagcactgggagtggaagaacttccaggtgaccctgaccaagagaagagccatgcaggtgagaaacgtgctgaacgacgccgtggacctgctggagttcagagacagagtgatcaaggccagcctgaactacgcccacctggtggtgagcaccagcctgcagtgctacgtgttcagcaccaagaactggaacacccccatcatcttcgacctgaaggagggcaccgtgagcctgatcctgcaggccgagagacacttcctgctggtggacggcagcagcatctacctgtacagctacgagggcagattcatcagcagccccaagttccccggcatgagaaccgacatcctgaacgcccagaccgtgagcctgagcaacgacaccatcgccatcagagacaaggccgacgagaagatcatcttcctgttcgaggccagcaccggcaagcccctgggcgacggcaagttcctgagccacaagaacgagatcctggagatcgccctggaccagaagggcctgaccaacgacagaaagatcgccttcatcgacaagaacagagacctgtgcatcaccagcgtgaagagattcggcaaggaggagcagatcatcaagctgggcaccatggtgcacaccctggcctggaacgacacctgcaacatcctgtgcggcctgcaggacaccagattcatcgtgtggtactaccccaacaccgtgtacgtggacagagacatcctgcccaagaccctgtacgagagagacgccagcgagttcagcaagaacccccacatcgtgagcttcgtgggcaaccaggtgaccatcagaagagccgacggcagcctggtgcacatcagcatcaccccctaccccgccatcctgcacgagtacgtgagcagcagcaagtgggaggacgccgtgagactgtgcagattcgtgaaggagcagaccatgtgggcctgcctggccgccatggccgtggccaacagagacatgaccaccgccgagatcgcctacgccgccatcggcgagatcgacaaggtgcagtacatcaacagcatcaagaacctgcccagcaaggagagcaagatggcccacatcctgctgttcagcggcaacatccaggaggccgagatcgtgctgctgcaggccggcctggtgtaccaggccatccagatcaacatcaacctgtacaactgggagagagccctggagctggccgtgaagtacaagacccacgtggacaccgtgctggcctacagacagaagttcctggagaccttcggcaagcaggagaccaacaagagatacctgcactacgccgagggcctgcagatcgactgggagaagatcaaggccaagatcgagatggagatcaccaaggagagagagcagagcagcagcagccagagcagcaagagcatcggcctgaagccctag

SEQ ID NO: 85751 - DNA, 366 bp, Artificial Sequence
  Description of Artificial Sequence: Synthetic coding sequence
atgagactgaagatcagcctgctgaaggagcccaagcaccaggagctggtgagctgcgtgggctggaccaccgccgaggagctgtacagctgcagcgacgaccaccagatcgtgaagtggaacctgctgaccagcgagaccacccagatcgtgaagctgcccgacgacatctaccccatcgacttccactggttccccaagagcctgggcgtgaagaagcagacccaggccgagagcttcgtgctgaccagcagcgacggcaagttccacctgatcagcaagctgggcagagtggagaagagcgtggaggcccactgcggcgccgtgctggccggcagatggaactacgagggcaccgccctgtag

SEQ ID NO: 85752 - DNA, 1923 bp, Artificial Sequence; identical to SEQ ID NO: 85750
  Description of Artificial Sequence: Synthetic coding sequence

SEQ ID NO: 85753 - DNA, 540 bp, Artificial Sequence
  Description of Artificial Sequence: Synthetic coding sequence
atgagactgaagatcagcctgctgaaggagcccaagcaccaggagctggtgagctgcgtgggctggaccaccgccgaggagctgtacagctgcagcgacgaccaccagatcgtgaagtggaacctgctgaccagcgagaccacccagatcgtgaagctgcccgacgacatctaccccatcgacttccactggttccccaagagcctgggcgtgaagaagcagacccaggccgagagcttcgtgctgaccagcagcgacggcaagttccacctgatcagcaagctgggcagagtggagaagagcgtggaggcccactgcggcgccgtgctggccggcagatggaactacgagggcaccgccctggtgaccgtgggcgaggacggccagatcaagatctggagcaagaccggcatgctgagaagcaccctggcccagcagggcacccccgtgtacagcgtggcctggggccccgacagcgagaaggtgctgtacaccgccggcaagcagctgatcatcaagcccctgcagcccaacgcctag

SEQ ID NO: 85754 - DNA, 1227 bp, Artificial Sequence
  Description of Artificial Sequence: Synthetic coding sequence
atggccagcgtggccagctgcgacagcagacccagcagcgacgagctgcccggcgaccccagcagccaggaggaggacgaggactacgacttcgaggacagagtgagcgacagcggcagctacagcagcgccagcagcgactacgacgacctggagcccgagtggctggacagcgtgcagaagaacggcgagctgttctacctggagctgagcgaggacgaggaggagagcctgctgcccgagacccccaccgtgaaccacgtgagattcagcgagaacgagatcatcatcgaggacgactacaaggagagaaagaagtacgagcccaagctgaagcagttcaccaagatcctgagaagaaagagactgctgcccaagagatgcaacaagaagaacagcaacgacaacggccccgtgagcatcctgaagcaccagagcaaccagaagaccggcgtgatcgtgcagcagagatacaaggacgtgaacgtgtacgtgaaccccaagaagctgaccgtgatcaaggccaaggagcagctgaagctgctggaggtgctggtgggcatcatccaccagaccaagtggagctggagaagaaccggcaagcagggcgacggcgagagactggtggtgcacggcctgctgcccggcggcagcgccatgaagagcggccaggtgctgatcggcgacgtgctggtggccgtgaacgacgtggacgtgaccaccgagaacatcgagagagtgctgagctgcatccccggccccatgcaggtgaagctgaccttcgagaacgcctacgacgtgaagagagagaccagccaccccagacagaagaagacccagagcaacaccagcgacctggtgaagctgctgtggggcgaggaggtggagggcatccagcagagcggcctgaacaccccccacatcatcatgtacctgaccctgcagctggacagcgagaccagcaaggaggagcaggagatcctgtaccactaccccatgagcgaggccagccagaagctgaagagcgtgagaggcatcttcctgaccctgtgcgacatgctggagaacgtgaccggcacccaggtgaccagcagcagcctgctgctgaacggcaagcagatccacgtggcctactggaaggagagcgacaagctgctgctgatcggcctgcccgccgaggagatcgagctgcccagcagcgcccacacccacggcgagagaaactag

SEQ ID NO: 85755 - DNA, 2829 bp, Artificial Sequence
  Description of Artificial Sequence: Synthetic coding sequence
atggccagcgtggccagctgcgacagcagacccagcagcgacgagctgcccggcgaccccagcagccaggaggaggacgaggactacgacttcgaggacagagtgagcgacagcggcagctacagcagcgccagcagcgactacgacgacctggagcccgagtggctggacagcgtgcagaagaacggcgagctgttctacctggagctgagcgaggacgaggaggagagcctgctgcccgagacccccaccgtgaaccacgtgagattcagcgagaacgagatcatcatcgaggacgactacaaggagagaaagaagtacgagcccaagctgaagcagttcaccaagatcctgagaagaaagagactgctgcccaagagatgcaacaagaagaacagcaacgacaacggccccgtgagcatcctgaagcaccagagcaaccagaagaccggcgtgatcgtgcagcagagatacaaggacgtgaacgtgtacgtgaaccccaagaagctgaccgtgatcaaggccaaggagcagctgaagctgctggaggtgctggtgggcatcatccaccagaccaagtggagctggagaagaaccggcaagcagggcgacggcgagagactggtggtgcacggcctgctgcccggcggcagcgccatgaagagcggccaggtgctgatcggcgacgtgctggtggccgtgaacgacgtggacgtgaccaccgagaacatcgagagagtgctgagctgcatccccggccccatgcaggtgaagctgaccttcgagaacgcctacgacgtgaagagagagaccagccaccccagacagaagaagacccagagcaacaccagcgacctggtgaagctgctgtggggcgaggaggtggagggcatccagcagagcggcctgaacaccccccacatcatcatgtacctgaccctgcagctggacagcgagaccagcaaggaggagcaggagatcctgtaccactaccccatgagcgaggccagccagaagctgaagagcgtgagaggcatcttcctgaccctgtgcgacatgctggagaacgtgaccggcacccaggtgaccagcagcagcctgctgctgaacggcaagcagatccacgtggcctactggaaggagagcgacaagctgctgctgatcggcctgcccgccgaggaggtgcccctgcccagactgagaaacatgatcgagaacgtgatccagaccctgaagttcatgtacggcagcctggacagcgccttctgccagatcgagaacgtgcccagactggaccacttcttcaacctgttcttccagagagccctgcagcccgccaagctgcacagcagcgccagccccagcgcccagcagtacgacgccagcagcgccgtgctgctggacaacctgcccggcgtgagatggctgaccctgcccctggagatcaagatggagctggacatggccctgagcgacctggaggccgccgacttcgccgagctgagcgaggactactacgacatgagaagactgtacaccatcctgggcagcagcctgttctacaagggctacctgatctgcagccacctgcccaaggacgacctgatcgacatcgccgtgtactgcagacactactgcctgctgcccctggccgccaagcagagaatcggccagctgatcatctggagagaggtgttcccccagcaccacctgagacccctggccgacagcagcaccgaggtgttccccgagcccgagggcagatacttcctgctggtggtgggcctgaagcactacatgctgtgcgtgctgctggaggccggcggctgcgccagcaaggccatcggcagccccggccccgactgcgtgtacgtggaccaggtgaagaccaccctgcaccagctggacggcgtggacagcagaatcgacgagagactggccagcagccccgtgccctgcctgagctgcgccgactggttcctgaccggcagcagagagaagaccgacagcctgaccaccagccccatcctgagcagactgcagggcaccagcaaggtggccaccagccccacctgcagaagaaccctgttcggcgactacagcctgaagaccagaaagcccagccccagctgcagcagcggcggcagcgacaacggctgcgagggcggcgaggacgacggcttcagcccccacaccacccccgacgccgtgagaaagcagagagagagccagggcagcgacggcctggaggagagcggcaccctgctgaaggtgaccaagaagaagagcaccctgcccaaccccttccacctgggcaacctgaagaaggacctgcccgagaaggagctggagatctacaacaccgtgaagctgaccagcggccccgagaacaccctgttccactacgtggccctggagaccgtgcagggcatcttcatcacccccaccctggaggaggtggcccagctgagcggcagcatccacccccagctgatcaagaacttccaccagtgctgcctgagcatcagagccgtgttccagcagaccctggtggaggagaagaagaagggcctgaacagcggcgaccacagcgacagcgccaagagcgtgagcagcctgaaccccgtgaaggagcacggcgtgctgttcgagtgcagccccggcaactggaccgaccagaagaaggccccccccgtgatggcctactgggtggtgggcagactgttcctgcaccccaagccccaggagctgtacgtgtgcttccacgacagcgtgaccgagatcgccatcgagatcgccttcaagctgttcttcggcctgaccctgtag

SEQ ID NO: 85756 - DNA, 2688 bp, Artificial Sequence
  Description of Artificial Sequence: Synthetic coding sequence
atgaacaagagcgagaacctgctgttcgccggcagcagcctggccagccaggtgcacgccgccgccgtgaacggcgacaagggcgccctgcagagactgatcgtgggcaacagcgccctgaaggacaaggaggaccagttcggcagaacccccctgatgtactgcgtgctggccgacagactggactgcgccgacgccctgctgaaggccggcgccgacgtgaacaagaccgaccacagccagagaaccgccctgcacctggccgcccagaagggcaactacagattcatgaagctgctgctgaccagaagagccaactggatgcagaaggacctggaggagatgacccccctgcacctgaccaccagacacagaagccccaagtgcctggccctgctgctgaagttcatggcccccggcgaggtggacacccaggacaagaacaagcagaccgccctgcactggagcgcctactacaacaaccccgagcacgtgaagctgctgatcaagcacgacagcaacatcggcatccccgacgtggagggcaagatccccctgcactgggccgccaaccacaaggaccccagcgccgtgcacaccgtgagatgcatcctggacgccgcccccaccgagagcctgctgaactggcaggactacgagggcagaacccccctgcacttcgccgtggccgacggcaacgtgaccgtggtggacgtgctgaccagctacgagagctgcaacatcaccagctacgacaacctgttcagaacccccctgcactgggccgccctgctgggccacgcccagatcgtgcacctgctgctggagagaaacaagagcggcaccatccccagcgacagccagggcgccacccccctgcactacgccgcccagagcaacttcgccgagaccgtgaaggtgttcctgaagcaccccagcgtgaaggacgacagcgacctggagggcagaaccagcttcatgtgggccgccggcaagggcagcgacgacgtgctgagaaccatgctgagcctgaagagcgacatcgacatcaacatggccgacaagtacggcggcaccgccctgcacgccgccgccctgagcggccacgtgagcaccgtgaagctgctgctggagaacaacgcccaggtggacgccaccgacgtgatgaagcacacccccctgttcagagcctgcgagatgggccacaaggacgtgatccagaccctgatcaagggcggcgccagagtggacctggtggaccaggacggccacagcctgctgcactgggccgccctgggcggcaacgccgacgtgtgccagatcctgatcgagaacaagatcaaccccaacgtgcaggactacgccggcagaacccccctgcagtgcgccgcctacggcggctacatcaactgcatggccgtgctgatggagaacaacgccgaccccaacatccaggacaaggagggcagaaccgccctgcactggagctgcaacaacggctacctggacgccatcaagctgctgctggacttcgccgccttccccaaccagatggagaacaacgaggagagatacacccccctggactacgccctgctgggcgagagacacgaggtgatccagttcatgctggagcacggcgccctgagcatcgccgccatccaggacatcgccgccttcaagatccaggccgtgtacaagggctacaaggtgagaaaggccttcagagacagaaagaacctgctgatgaagcacgagcagctgagaaaggacgccgccgccaagaagagagaggaggagaacaagagaaaggaggccgagcagcagaagggcagaagaagccccgacagctgcagaccccaggccctgccctgcctgcccagcacccaggacgtgcccagcagacagagcagagcccccagcaagcagccccccgccggcaacgtggcccagggccccgagcccagagacagcagaggcagccccggcggcagcctgggcggcgccctgcagaaggagcagcacgtgagcagcgacctgcagggcaccaacagcagaagacccaacgagaccgccagagagcacagcaagggccagagcgcctgcgtgcacttcagacccaacgagggcagcgacggcagcagacaccccggcgtgcccagcgtggagaagagcagagagctgagactgcagatcatccagagagagagaagaagaaaggagctgttcagaaagaagaacaaggccgccgccgtgatccagagagcctggagaagctaccagctgagaaagcacctgagccacctgagacacatgaagcagctgggcgccggcgacgtggacagatggagacaggagagcaccgccctgctgctgcaggtgtggagaaaggagctggagctgaagttcccccagaccaccgccgtgagcaaggcccccaagagccccagcaagggcaccagcggcaccaagagcaccaagcacagcgtgctgaagcagatctacggctgcagccacgagggcaagatccaccaccccaccagaagcgtgaaggccagcagcgtgctgagactgaacagcgtgagcaacctgcagtgcatccacctgctggagaacagcggcagaagcaagaacttcagctacaacctgcagagcgccacccagcccaagaacaagaccaagccctag

SEQ ID NO: 85757 - DNA, 3198 bp, Artificial Sequence
  Description of Artificial Sequence: Synthetic coding sequence
atgaacaagagcgagaacctgctgttcgccggcagcagcctggccagccaggtgcacgccgccgccgtgaacggcgacaagggcgccctgcagagactgatcgtgggcaacagcgccctgaaggacaaggaggaccagttcggcagaacccccctgatgtactgcgtgctggccgacagactggactgcgccgacgccctgctgaaggccggcgccgacgtgaacaagaccgaccacagccagagaaccgccctgcacctggccgcccagaagggcaactacagattcatgaagctgctgctgaccagaagagccaactggatgcagaaggacctggaggagatgacccccctgcacctgaccaccagacacagaagccccaagtgcctggccctgctgctgaagttcatggcccccggcgaggtggacacccaggacaagaacaagcagaccgccctgcactggagcgcctactacaacaaccccgagcacgtgaagctgctgatcaagcacgacagcaacatcggcatccccgacgtggagggcaagatccccctgcactgggccgccaaccacaaggaccccagcgccgtgcacaccgtgagatgcatcctggacgccgcccccaccgagagcctgctgaactggcaggactacgagggcagaacccccctgcacttcgccgtggccgacggcaacgtgaccgtggtggacgtgctgaccagctacgagagctgcaacatcaccagctacgacaacctgttcagaacccccctgcactgggccgccctgctgggccacgcccagatcgtgcacctgctgctggagagaaacaagagcggcaccatccccagcgacagccagggcgccacccccctgcactacgccgcccagagcaacttcgccgagaccgtgaaggtgttcctgaagcaccccagcgtgaaggacgacagcgacctggagggcagaaccagcttcatgtgggccgccggcaagggcagcgacgacgtgctgagaaccatgctgagcctgaagagcgacatcgacatcaacatggccgacaagtacggcggcaccgccctgcacgccgccgccctgagcggccacgtgagcaccgtgaagctgctgctggagaacaacgcccaggtggacgccaccgacgtgatgaagcacacccccctgttcagagcctgcgagatgggccacaaggacgtgatccagaccctgatcaagggcggcgccagagtggacctggtggaccaggacggccacagcctgctgcactgggccgccctgggcggcaacgccgacgtgtgccagatcctgatcgagaacaagatcaaccccaacgtgcaggactacgccggcagaacccccctgcagtgcgccgcctacggcggctacatcaactgcatggccgtgctgatggagaacaacgccgaccccaacatccaggacaaggagggcagaaccgccctgcactggagctgcaacaacggctacctggacgccatcaagctgctgctggacttcgccgccttccccaaccagatggagaacaacgaggagagatacacccccctggactacgccctgctgggcgagagacacgaggtgatccagttcatgctggagcacggcgccctgagcatcgccgccatccaggacatcgccgccttcaagatccaggccgtgtacaagggctacaaggtgagaaaggccttcagagacagaaagaacctgctgatgaagcacgagcagctgagaaaggacgccgccgccaagaagagagaggaggagaacaagagaaaggaggccgagcagcagaagggcagaagaagccccgacagctgcagaccccaggccctgccctgcctgcccagcacccaggacgtgcccagcagacagagcagagcccccagcaagcagccccccgccggcaacgtggcccagggccccgagcccagagacagcagaggcagccccggcggcagcctgggcggcgccctgcagaaggagcagcacgtgagcagcgacctgcagggcaccaacagcagaagacccaacgagaccgccagagagcacagcaagggccagagcgcctgcgtgcacttcagacccaacgagggcagcgacggcagcagacaccccggcgtgcccagcgtggagaagagcagaggcgagaccgccggcgacgagagatgcgccaagggcaagggcttcgtgaagcagcccagctgcatcagagtggccggccccgacgagaagggcgaggacagcagaagagccgccgccagcctgcccccccacgacagccactggaagcccagcagaagacacgacaccgagcccaaggccaagtgcgccccccagaagagaagaacccaggagctgagaggcggcagatgcagccccgccggcagcagcagacccggcagcgccagaggcgaggccgtgcacgccggccagaaccccccccaccacagaacccccagaaacaaggtgacccaggccaagctgaccggcggcctgtacagccacctgccccagagcaccgaggagctgagaagcggcgccagaagactggagaccagcaccctgagcgaggacttccaggtgagcaaggagaccgaccccgcccccggccccctgagcggccagagcgtgaacatcgacctgctgcccgtggagctgagactgcagatcatccagagagagagaagaagaaaggagctgttcagaaagaagaacaaggccgccgccgtgatccagagagcctggagaagctaccagctgagaaagcacctgagccacctgagacacatgaagcagctgggcgccggcgacgtggacagatggagacaggagagcaccgccctgctgctgcaggtgtggagaaaggagctggagctgaagttcccccagaccaccgccgtgagcaaggcccccaagagccccagcaagggcaccagcggcaccaagagcaccaagcacagcgtgctgaagcagatctacggctgcagccacgagggcaagatccaccaccccaccagaagcgtgaaggccagcagcgtgctgagactgaacagcgtgagcaacctgcagtgcatccacctgctggagaacagcggcagaagcaagaacttcagctacaacctgcagagcgccacccagcccaagaacaagaccaagccctag

SEQ ID NO: 85758 - DNA, 306 bp, Artificial Sequence
  Description of Artificial Sequence: Synthetic coding sequence
atgaacaagagcgagaacctgctgttcgccggcagcagcctggccagccaggtgcacgccgccgccgtgaacggcgacaagggcgccctgcagagactgatcgtgggcaacagcgccctgaaggacaaggaggaccagttcggcagaacccccctgatgtactgcgtgctggccgacagactggactgcgccgacgccctgctgaaggccggcgccgacgtgaacaagaccgaccacagccagagaaccgccctgcacctggccgcccagaaggccctgagaaccatcagcaccggcagaatctag

SEQ ID NO: 85759 - DNA, 2967 bp, Artificial Sequence
  Description of Artificial Sequence: Synthetic coding sequence
atgaagctgctgctgaccagaagagccaactggatgcagaaggacctggaggagatgacccccctgcacctgaccaccagacacagaagccccaagtgcctggccctgctgctgaagttcatggcccccggcgaggtggacacccaggacaagaacaagcagaccgccctgcactggagcgcctactacaacaaccccgagcacgtgaagctgctgatcaagcacgacagcaacatcggcatccccgacgtggagggcaagatccccctgcactgggccgccaaccacaaggaccccagcgccgtgcacaccgtgagatgcatcctggacgccgcccccaccgagagcctgctgaactggcaggactacgagggcagaacccccctgcacttcgccgtggccgacggcaacgtgaccgtggtggacgtgctgaccagctacgagagctgcaacatcaccagctacgacaacctgttcagaacccccctgcactgggccgccctgctgggccacgcccagatcgtgcacctgctgctggagagaaacaagagcggcaccatccccagcgacagccagggcgccacccccctgcactacgccgcccagagcaacttcgccgagaccgtgaaggtgttcctgaagcaccccagcgtgaaggacgacagcgacctggagggcagaaccagcttcatgtgggccgccggcaagggcagcgacgacgtgctgagaaccatgctgagcctgaagagcgacatcgacatcaacatggccgacaagtacggcggcaccgccctgcacgccgccgccctgagcggccacgtgagcaccgtgaagctgctgctggagaacaacgcccaggtggacgccaccgacgtgatgaagcacacccccctgttcagagcctgcgagatgggccacaaggacgtgatccagaccctgatcaagggcggcgccagagtggacctggtggaccaggacggccacagcctgctgcactgggccgccctgggcggcaacgccgacgtgtgccagatcctgatcgagaacaagatcaaccccaacgtgcaggactacgccggcagaacccccctgcagtgcgccgcctacggcggctacatcaactgcatggccgtgctgatggagaacaacgccgaccccaacatccaggacaaggagggcagaaccgccctgcactggagctgcaacaacggctacctggacgccatcaagctgctgctggacttcgccgccttccccaaccagatggagaacaacgaggagagatacacccccctggactacgccctgctgggcgagagacacgaggtgatccagttcatgctggagcacggcgccctgagcatcgccgccatccaggacatcgccgccttcaagatccaggccgtgtacaagggctacaaggtgagaaaggccttcagagacagaaagaacctgctgatgaagcacgagcagctgagaaaggacgccgccgccaagaagagagaggaggagaacaagagaaaggaggccgagcagcagaagggcagaagaagccccgacagctgcagaccccaggccctgccctgcctgcccagcacccaggacgtgcccagcagacagagcagagcccccagcaagcagccccccgccggcaacgtggcccagggccccgagcccagagacagcagaggcagccccggcggcagcctgggcggcgccctgcagaaggagcagcacgtgagcagcgacctgcagggcaccaacagcagaagacccaacgagaccgccagagagcacagcaagggccagagcgcctgcgtgcacttcagacccaacgagggcagcgacggcagcagacaccccggcgtgcccagcgtggagaagagcagaggcgagaccgccggcgacgagagatgcgccaagggcaagggcttcgtgaagcagcccagctgcatcagagtggccggccccgacgagaagggcgaggacagcagaagagccgccgccagcctgcccccccacgacagccactggaagcccagcagaagacacgacaccgagcccaaggccaagtgcgccccccagaagagaagaacccaggagctgagaggcggcagatgcagccccgccggcagcagcagacccggcagcgccagaggcgaggccgtgcacgccggccagaaccccccccaccacagaacccccagaaacaaggtgacccaggccaagctgaccggcggcctgtacagccacctgccccagagcaccgaggagctgagaagcggcgccagaagactggagaccagcaccctgagcgaggacttccaggtgagcaaggagaccgaccccgcccccggccccctgagcggccagagcgtgaacatcgacctgctgcccgtggagctgagactgcagatcatccagagagagagaagaagaaaggagctgttcagaaagaagaacaaggccgccgccgtgatccagagagcctggagaagctaccagctgagaaagcacctgagccacctgagacacatgaagcagctgggcgccggcgacgtggacagatggagacaggagagcaccgccctgctgctgcaggtgtggagaaaggagctggagctgaagttcccccagaccaccgccgtgagcaaggcccccaagagccccagcaagggcaccagcggcaccaagagcaccaagcacagcgtgctgaagcagatctacggctgcagccacgagggcaagatccaccaccccaccagaagcgtgaaggccagcagcgtgctgagactgaacagcggcaaggccgccaccgccaagcagatggtgggcaagaacatgggcaagcacttccccctgttccacccccagagacagaagaccctggagcagatctggcccggcttcagcaacggccacctgatcagctgggactactactgcagccagcacctgagcccctag

SEQ ID NO: 85760 - DNA, 3723 bp, Artificial Sequence
  Description of Artificial Sequence: Synthetic coding sequence
atgagcgtgaaggagggcgcccagagaaagtgggccgccctgaaggagaagctgggcccccaggacagcgaccccaccgaggccaacctggagagcgccgaccccgagctgtgcatcagactgctgcagatgcccagcgtggtgaactacagcggcctgagaaagagactggagggcagcgacggcggctggatggtgcagttcctggagcagagcggcctggacctgctgctggaggccctggccagactgagcggcagaggcgtggccagaatcagcgacgccctgctgcagctgacctgcgtgagctgcgtgagagccgtgatgaacagcagacagggcatcgagtacatcctgagcaaccagggctacgtgagacagctgagccaggccctggacaccagcaacgtgatggtgaagaagcaggtgttcgagctgctggccgccctgtgcatctacagccccgagggccacgtgctgaccctggacgccctggaccactacaagaccgtgtgcagccagcagtacagattcagcatcgtgatgaacgagctgagcggcagcgacaacgtgccctacgtggtgaccctgctgagcgtgatcaacgccgtgatcctgggccccgaggacctgagagccagaacccagctgagaaacgagttcatcggcctgcagctgctggacgtgctggccagactgagagacctggaggacgccgacctgctgatccagctggaggccttcgaggaggccaaggccgaggacgaggaggagctgctgagagtgagcggcggcgtggacatgagcagccaccaggaggtgttcgccagcctgttccacaaggtgagctgcagccccgtgagcgcccagctgctgagcgtgctgcagggcctgctgcacctggagcccaccctgagaagcagccagctgctgtgggaggccctggagagcctggtgaacagagccgtgctgctggccagcgacgcccaggagtgcaccctggaggaggtggtggagagactgctgagcgtgaagggcagacccagacccagccccctggtgaaggcccacaagagcgtgcaggccaacctggaccagagccagagaggcagcagcccccagaacaccaccacccccaagcccagcgtggagggccagcagcccgccgccgccgccgcctgcgagcccgtggaccacgcccagagcgagagcatcctgaaggtgagccagcccagagccctggagcagcaggccagcaccccccccccccccccccccccccccctgctgcccggcagcagcgccgagcccccccccccccccccccccccccccctgcccagcgtgggcgccaaggccctgcccaccgcccccccccccccccccctgcccggcctgggcgccatggccccccccgccccccccctgcccccccccctgcccggcagctgcgagttcctgccccccccccccccccccctgcccggcctgggctgcccccccccccccccccccctgctgcccggcatgggctggggccccccccccccccccccccccctgctgccctgcacctgcagcccccccgtggccggcggcatggaggaggtgatcgtggcccaggtggaccacggcctgggcagcgcctgggtgcccagccacagaagagtgaacccccccaccctgagaatgaagaagctgaactggcagaagctgcccagcaacgtggccagagagcacaacagcatgtgggccagcctgagcagccccgacgccgaggccgtggagcccgacttcagcagcatcgagagactgttcagcttccccgccgccaagcccaaggagcccaccatggtggcccccagagccagaaaggagcccaaggagatcaccttcctggacgccaagaagagcctgaacctgaacatcttcctgaagcagttcaagtgcagcaacgaggaggtggccgccatgatcagagccggcgacaccaccaagttcgacgtggaggtgctgaagcagctgctgaagctgctgcccgagaagcacgagatcgagaacctgagagccttcaccgaggagagagccaagctggccagcgccgaccacttctacctgctgctgctggccatcccctgctaccagctgagaatcgagtgcatgctgctgtgcgagggcgccgccgccgtgctggacatggtgagacccaaggcccagctggtgctggccgcctgcgagagcctgctgaccagcagacagctgcccatcttctgccagctgatcctgagaatcggcaacttcctgaactacggcagccacaccggcgacgccgacggcttcaagatcagcaccctgctgaagctgaccgagaccaagagccagcagaacagagtgaccctgctgcaccacgtgctggaggaggccgagaagagccaccccgacctgctgcagctgcccagagacctggagcagcccagccaggccgccggcatcaacctggagatcatcagaagcgaggccagcagcaacctgaagaagctgctggagaccgagagaaaggtgagcgccagcgtggccgaggtgcaggagcagtacaccgagagactgcaggccagcatcagcgccttcagagccctggacgagctgttcgaggccatcgagcagaagcagagagagctggccgactacctgtgcgaggacgcccagcagctgagcctggaggacaccttcagcaccatgaaggccttcagagacctgttcctgagagccctgaaggagaacaaggacagaaaggagcaggccgccaaggccgagagaagaaagcagcagctggccgaggaggaggccagaagacccagaggcgaggacggcaagcccgtgagaaagggccccggcaagcaggaggaggtgtgcgtgatcgacgccctgctggccgacatcagaaagggcttccagctgagaaagaccgccagaggcagaggcgacaccgacggcggcagcaaggccgccagcatggacccccccagagccaccgagcccgtggccaccagcaaccccgccggcgaccccgtgggcagcaccagatgccccgccagcgagcccggcctggacgccaccaccgccagcgagagcagaggctgggacctggtggacgccgtgacccccggcccccagcccaccctggagcagctggaggagggcggccccagacccctggagagaagaagcagctggtacgtggacgccagcgacgtgctgaccaccgaggacccccagtgcccccagcccctggagggcgcctggcccgtgaccctgggcgacgcccaggccctgaagcccctgaagttcagcagcaaccagccccccgccgccggcagcagcagacaggacgccaaggaccccaccagcctgctgggcgtgctgcaggccgaggccgacagcaccagcgagggcctggaggacgccgtgcacagcagaggcgccagaccccccgccgccggccccggcggcgacgaggacgaggacgaggaggacaccgcccccgagagcgccctggacaccagcctggacaagagcttcagcgaggacgccgtgaccgacagcagcggcagcggcaccctgcccagagccagaggcagagccagcaagggcaccggcaagagaagaaagaagagacccagcagaagccaggagggcctgagacccagacccaaggccaagtag

SEQ ID NO: 85761 - DNA, 3750 bp, Artificial Sequence
  Description of Artificial Sequence: Synthetic coding sequence
atgagcgtgaaggagggcgcccagagaaagtgggccgccctgaaggagaagctgggcccccaggacagcgaccccaccgaggccaacctggagagcgccgaccccgagctgtgcatcagactgctgcagatgcccagcgtggtgaactacagcggcctgagaaagagactggagggcagcgacggcggctggatggtgcagttcctggagcagagcggcctggacctgctgctggaggccctggccagactgagcggcagaggcgtggccagaatcagcgacgccctgctgcagctgacctgcgtgagctgcgtgagagccgtgatgaacagcagacagggcatcgagtacatcctgagcaaccagggctacgtgagacagctgagccaggccctggacaccagcaacgtgatggtgaagaagcaggtgttcgagctgctggccgccctgtgcatctacagccccgagggccacgtgctgaccctggacgccctggaccactacaagaccgtgtgcagccagcagtacagattcagcatcgtgatgaacgagctgagcggcagcgacaacgtgccctacgtggtgaccctgctgagcgtgatcaacgccgtgatcctgggccccgaggacctgagagccagaacccagctgagaaacgagttcatcggcctgcagctgctggacgtgctggccagactgagagacctggaggacgccgacctgctgatccagctggaggccttcgaggaggccaaggccgaggacgaggaggagctgctgagagtgagcggcggcgtggacatgagcagccaccaggaggtgttcgccagcctgttccacaaggtgagctgcagccccgtgagcgcccagctgctgagcgtgctgcagggcctgctgcacctggagcccaccctgagaagcagccagctgctgtgggaggccctggagagcctggtgaacagagccgtgctgctggccagcgacgcccaggagtgcaccctggaggaggtggtggagagactgctgagcgtgaagggcagacccagacccagccccctggtgaaggcccacaagagcgtgcaggccaacctggaccagagccagagaggcagcagcccccagaacaccaccacccccaagcccagcgtggagggccagcagcccgccgccgccgccgcctgcgagcccgtggaccacgcccagagcgagagcatcctgaaggtgagccagcccagagccctggagcagcaggccagcaccccccccccccccccccccccccccctgctgcccggcagcagcgccgagcccccccccccccccccccccccccccctgcccagcgtgggcgccaaggccctgcccaccgcccccccccccccccccctgcccggcctgggcgccatggccccccccgccccccccctgcccccccccctgcccggcagctgcgagttcctgccccccccccccccccccctgcccggcctgggctgcccccccccccccccccccctgctgcccggcatgggctggggccccccccccccccccccccccctgctgccctgcacctgcagcccccccgtggccggcggcatggaggaggtgatcgtggcccaggtggaccacggcctgggcagcgcctgggtgcccagccacagaagagtgaacccccccaccctgagaatgaagaagctgaactggcagaagctgcccagcaacgtggccagagagcacaacagcatgtgggccagcctgagcagccccgacgccgaggccgtggagcccgacttcagcagcatcgagagactgttcagcttccccgccgccaagcccaaggagcccaccatggtggcccccagagccagaaaggagcccaaggagatcaccttcctggacgccaagaagagcctgaacctgaacatcttcctgaagcagttcaagtgcagcaacgaggaggtggccgccatgatcagagccggcgacaccaccaagttcgacgtggaggtgctgaagcagctgctgaagctgctgcccgagaagcacgagatcgagaacctgagagccttcaccgaggagagagccaagctggccagcgccgaccacttctacctgctgctgctggccatcccctgctaccagctgagaatcgagtgcatgctgctgtgcgagggcgccgccgccgtgctggacatggtgagacccaaggcccagctggtgctggccgcctgcgagagcctgctgaccagcagacagctgcccatcttctgccagctgatcctgagaatcggcaacttcctgaactacggcagccacaccggcgacgccgacggcttcaagatcagcaccctgctgaagctgaccgagaccaagagccagcagaacagagtgaccctgctgcaccacgtgctggaggaggccgagaagagccaccccgacctgctgcagctgcccagagacctggagcagcccagccaggccgccggcatcaacctggagatcatcagaagcgaggccagcagcaacctgaagaagctgctggagaccgagagaaaggtgagcgccagcgtggccgaggtgcaggagcagtacaccgagagactgcaggccagcatcagcgccttcagagccctggacgagctgttcgaggccatcgagcagaagcagagagagctggccgactacctgtgcgaggacgcccagcagctgagcctggaggacaccttcagcaccatgaaggccttcagagacctgttcctgagagccctgaaggagaacaaggacagaaaggagcaggccgccaaggccgagagaagaaagcagcagctggccgaggaggaggccagaagacccagaggcgaggacggcaagcccgtgagaaagggccccggcaagcaggaggaggtgtgcgtgatcgacgccctgctggccgacatcagaaagggcttccagctgagaaagaccgccagaggcagaggcgacaccgacggcggcagcaaggccgccagcatggacccccccagagccaccgagcccgtggccaccagcaaccccgccggcgaccccgtgggcagcaccagatgccccgccagcgagcccggcctggacgccaccaccgccagcgagagcagaggctgggacctggtggacgccgtgacccccggcccccagcccaccctggagcagctggaggagggcggccccagacccctggagagaagaagcagctggtacgtggacgccagcgacgtgctgaccaccgaggacccccagtgcccccagcccctggagggcgcctggcccgtgaccctgggcgacgcccaggccctgaagcccctgaagttcagcagcaaccagccccccgccgccggcagcagcagacaggacgccaaggaccccaccagcctgctgggcgtgctgcaggccgaggccgacagcaccagcgagggcctggaggacgccgtgcacagcagaggcgccagaccccccgccgccggccccggcggcgacgaggacgaggacgaggaggacaccgcccccgagagcgccctggacaccagcctggacaagagcttcagcgaggacgccgtgaccgacagcagcggcagcggcaccctgcccagagccagaggcagagccagcaagggcaccggcaagagaagaaagaagagacccagcagaagccaggaggaggtgccccccgacagcgacgacaacaagaccaagaagctgtgcgtgatccagtag

SEQ ID NO: 85762 - DNA, 705 bp, Artificial Sequence
  Description of Artificial Sequence: Synthetic coding sequence
atgagcgtgaaggagggcgcccagagaaagtgggccgccctgaaggagaagctgggcccccaggacagcgaccccaccgaggccaacctggagagcgccgaccccgagctgtgcatcagactgctgcagatgcccagcgtggtgaactacagcggcctgagaaagagactggagggcagcgacggcggctggatggtgcagttcctggagcagagcggcctggacctgctgctggaggccctggccagactgagcggcagaggcgtggccagaatcagcgacgccctgctgcagctgacctgcgtgagctgcgtgagagccgtgatgaacagcagacagggcatcgagtacatcctgagcaaccagggctacgtgagacagctgagccaggccctggacaccagcaacgtgatggtgaagaagcaggtgttcgagctgctggccgccctgtgcatctacagccccgagggccacgtgctgaccctggacgccctggaccactacaagaccgtgtgcagccagcagtacagattcagcatcgtgatgaacgagctgagcggcagcgacaacgtgccctacgtggtgaccctgctgagcgtgatcaacgccgtgatcctgggccccgaggacctgagagccagaacccagctgagaaacgagttcatcggcctgcagctgctggacgtgctggccagactgagatag

SEQ ID NO: 85763 - DNA, 1758 bp, Artificial Sequence
  Description of Artificial Sequence: Synthetic coding sequence
atgagccagcagcacaccctgcccgtgaccctgagccccgccctgagccaggagctgctgaagaccgtgcccccccccgtgaacacccaccaggagcagatgaagcagcccacccccctgccccccccctgccagaaggtgcccgtggagctgcccgtggaggtgcccagcaagcaggaggagaagcacatgaccgccgtgaagggcctgcccgagcaggagtgcgagcagcagcagaaggagccccaggagcaggagctgcagcagcagcactgggagcagcacgaggagtaccagaaggccgagaaccccgagcagcagctgaagcaggagaagacccagagagaccagcagctgaacaagcagctggaggaggagaagaagctgctggaccagcagctggaccaggagctggtgaagagagacgagcagctgggcatgaagaaggagcagctgctggagctgcccgagcagcaggagggccacctgaagcacctggagcagcaggagggccagctgaagcaccccgagcagcaggagggccagctggagctgcccgagcagcaggagggccagctggagctgcccgagcagcaggagggccagctggagctgcccgagcagcaggagggccagctggagctgcccgagcagcaggagggccagctggagctgcccgagcagcaggagggccagctggagctgccccagcagcaggagggccagctggagctgagcgagcagcaggagggccagctggagctgagcgagcagcaggagggccagctgaagcacctggagcaccaggagggccagctggaggtgcccgaggagcagatgggccagctgaagtacctggagcagcaggagggccagctgaagcacctggaccagcaggagaagcagcccgagctgcccgagcagcagatgggccagctgaagcacctggagcagcaggagggccagcccaagcacctggagcagcaggagggccagctggagcagctggaggagcaggagggccagctgaagcacctggagcagcaggagggccagctggagcacctggagcaccaggagggccagctgggcctgcccgagcagcaggtgctgcagctgaagcagctggagaagcagcagggccagcccaagcacctggaggaggaggagggccagctgaagcacctggtgcagcaggagggccagctgaagcacctggtgcagcaggagggccagctggagcagcaggagagacaggtggagcacctggagcagcaggtgggccagctgaagcacctggaggagcaggagggccagctgaagcacctggagcagcagcagggccagctggaggtgcccgagcagcaggtgggccagcccaagaacctggagcaggaggagaagcagctggagctgcccgagcagcaggagggccaggtgaagcacctggagaagcaggaggcccagctggagctgcccgagcagcaggtgggccagcccaagcacctggagcagcaggagaagcacctggagcaccccgagcagcaggacggccagctgaagcacctggagcagcaggagggccagctgaaggacctggagcagcagaagggccagctggagcagcccgtgttcgcccccgcccccggccaggtgcaggacatccagcccgccctgcccaccaagggcgaggtgctgctgcccgtggagcaccagcagcagaagcaggaggtgcagtggccccccaagcacaagtag

SEQ ID NO: 85764 - DNA, 1320 bp, Artificial Sequence
  Description of Artificial Sequence: Synthetic coding sequence
atgaagaaggagcagctgctggagctgcccgagcagcaggagggccacctgaagcacctggagcagcaggagggccagctgaagcaccccgagcagcaggagggccagctggagctgcccgagcagcaggagggccagctggagctgcccgagcagcaggagggccagctggagctgcccgagcagcaggagggccagctggagctgcccgagcagcaggagggccagctggagctgcccgagcagcaggagggccagctggagctgccccagcagcaggagggccagctggagctgagcgagcagcaggagggccagctggagctgagcgagcagcaggagggccagctgaagcacctggagcaccaggagggccagctggaggtgcccgaggagcagatgggccagctgaagtacctggagcagcaggagggccagctgaagcacctggaccagcaggagaagcagcccgagctgcccgagcagcagatgggccagctgaagcacctggagcagcaggagggccagcccaagcacctggagcagcaggagggccagctggagcagctggaggagcaggagggccagctgaagcacctggagcagcaggagggccagctggagcacctggagcaccaggagggccagctgggcctgcccgagcagcaggtgctgcagctgaagcagctggagaagcagcagggccagcccaagcacctggaggaggaggagggccagctgaagcacctggtgcagcaggagggccagctgaagcacctggtgcagcaggagggccagctggagcagcaggagagacaggtggagcacctggagcagcaggtgggccagctgaagcacctggaggagcaggagggccagctgaagcacctggagcagcagcagggccagctggaggtgcccgagcagcaggtgggccagcccaagaacctggagcaggaggagaagcagctggagctgcccgagcagcaggagggccaggtgaagcacctggagaagcaggaggcccagctggagctgcccgagcagcaggtgggccagcccaagcacctggagcagcaggagaagcacctggagcaccccgagcagcaggacggccagctgaagcacctggagcagcaggagggccagctgaaggacctggagcagcagaagggccagctggagcagcccgtgttcgcccccgcccccggccaggtgcaggacatccagcccgccctgcccaccaagggcgaggtgctgctgcccgtggagcaccagcagcagaagcaggaggtgcagtggccccccaagcacaagtag

SEQ ID NO: 85765 - DNA, 1914 bp, Artificial Sequence
  Description of Artificial Sequence: Synthetic coding sequence
atgggcctgctgagccagggcagccccctgagctgggaggagaccaagagacacgccgaccacgtgagaagacacggcatcctgcagttcctgcacatctaccacgccgtgaaggacagacacaaggacgtgctgaagtggggcgacgaggtggagtacatgctggtgagcttcgaccacgagaacaagaaggtgagactggtgctgagcggcgagaaggtgctggagaccctgcaggagaagggcgagagaaccaaccccaaccaccccaccctgtggagacccgagtacggcagctacatgatcgagggcacccccggccagccctacggcggcaccatgagcgagttcaacaccgtggaggccaacatgagaaagagaagaaaggaggccaccagcatcctggaggagaaccaggccctgtgcaccatcaccagcttccccagactgggctgccccggcttcaccctgcccgaggtgaagcccaaccccgtggagggcggcgccagcaagagcctgttcttccccgacgaggccatcaacaagcaccccagattcagcaccctgaccagaaacatcagacacagaagaggcgagaaggtggtgatcaacgtgcccatcttcaaggacaagaacacccccagccccttcatcgagaccttcaccgaggacgacgaggccagcagagccagcaagcccgaccacatctacatggacgccatgggcttcggcatgggcaactgctgcctgcaggtgaccttccaggcctgcagcatcagcgaggccagatacctgtacgaccagctggccaccatctgccccatcgtgatggccctgagcgccgccagccccttctacagaggctacgtgagcgacatcgactgcagatggggcgtgatcagcgccagcgtggacgacagaaccagagaggagagaggcctggagcccctgaagaacaacaactacagaatcagcaagagcagatacgacagcatcgacagctacctgagcaagtgcggcgagaagtacaacgacatcgacctgaccatcgacaaggagatctacgagcagctgctgcaggagggcatcgaccacctgctggcccagcacgtggcccacctgttcatcagagaccccctgaccctgttcgaggagaagatccacctggacgacgccaacgagagcgaccacttcgagaacatccagagcaccaactggcagaccatgagattcaagccccccccccccaacagcgacatcggctggagagtggagttcagacccatggaggtgcagctgaccgacttcgagaacagcgcctacgtggtgttcgtggtgctgctgaccagagtgatcctgagctacaagctggacttcctgatccccctgagcaaggtggacgagaacatgaaggtggcccagaagagagacgccgtgctgcagggcatgttctacttcagaaaggacatctgcaagggcggcaacgccgtggtggacggctgcggcaaggcccagaacagcaccgagctggccgccgaggagtacaccctgatgagcatcgacaccatcatcaacggcaaggagggcgtgttccccggcctgatccccatcctgaacagctacctggagaacatggaggtggacgtggacaccagatgcagcatcctgaactacctgaagctgatcaagaagagagccagcggcgagctgatgaccgtggccagatggatgagagagttcatcgccaaccaccccgactacaagcaggacagcgtgatcaccgacgagatgaactacagcctgatcctgaagtgcaaccagatcgccaacgagctgtgcgagtgccccgagctgctgggcagcgccttcagaaaggtgaagtacagcggcagcaagaccgacagcagcaactag

SEQ ID NO: 85766 - DNA, 870 bp, Artificial Sequence
  Description of Artificial Sequence: Synthetic coding sequence
atgtacttcctgacccccatcctggtggccatcctgtgcatcctggtggtgtggatcttcaagaacgccgacagaagcatggagaagaagaagggcgagcccagaaccagagccgaggccagaccctgggtggacgaggacctgaaggacagcagcgacctgcaccaggccgaggaggacgccgacgagtggcaggagagcgaggagaacgtggagcacatccccttcagccacaaccactaccccgagaaggagatggtgaagagaagccaggagttctacgagctgctgaacaagagaagaagcgtgagattcatcagcaacgagcaggtgcccatggaggtgatcgacaacgtgatcagaaccgccggcaccgcccccagcggcgcccacaccgagccctggaccttcgtggtggtgaaggaccccgacgtgaagcacaagatcagaaagatcatcgaggaggaggaggagatcaactacatgaagagaatgggccacagatgggtgaccgacctgaagaagctgagaaccaactggatcaaggagtacctggacaccgcccccatcctgatcctgatcttcaagcaggtgcacggcttcgccgccaacggcaagaagaaggtgcactactacaacgagatcagcgtgagcatcgcctgcggcatcctgctggccgccctgcagaacgccggcctggtgaccgtgaccaccacccccctgaactgcggccccagactgagagtgctgctgggcagacccgcccacgagaagctgctgatgctgctgcccgtgggctaccccagcaaggaggccaccgtgcccgacctgaagagaaagcccctggaccagatcatggtgaccgtgtag

SEQ ID NO: 85767 - DNA, 813 bp, Artificial Sequence
  Description of Artificial Sequence: Synthetic coding sequence
atgtacttcctgacccccatcctggtggccatcctgtgcatcctggtggtgtggatcttcaagaacgccgacagaagcatggagaagaagaagggcgagcccagaaccagagccgaggccagaccctgggtggacgaggacctgaaggacagcagcgacctgcaccaggccgaggaggacgccgacgagtggcaggagagcgaggagaacgtggagcacatccccttcagccacaaccactaccccgagaaggagatggtgaagagaagccaggagttctacgagctgctgaacaagagaagaagcgtgagattcatcagcaacgagcaggtgcccatggaggtgatcgacaacgtgatcagaaccgccggcaccgcccccagcggcgcccacaccgagccctggaccttcgtggtggtgaaggaccccgacgtgaagcacaagatcagaaagatcatcgaggaggaggaggagatcaactacatgaagagaatgggccacagatgggtgaccgacctgaagaagctgagaaccaactggatcaaggagtacctggacaccgcccccatcctgatcctgatcttcaagcaggtgcacggcttcgccgccaacggcaagaagaaggtgcactactacaacgagatcagcgtgagcatcgcctgcggcatcctgctggccgccctgcaggtgaacaacggcatcaccatgagacaccagaccgccagacacagacacctgatcgagggccccggcagaagcagcgaggcctgcagcaagctgagcagccagggctgccccggcttctactgctag

SEQ ID NO: 85768 - DNA, 744 bp, Artificial Sequence
  Description of Artificial Sequence: Synthetic coding sequence
atgtacttcctgacccccatcctggtggccatcctgtgcatcctggtggtgtggatcttcaagaacgccgacagaagcatggagaagaagaagggcgagcccagaaccagagccgaggccagaccctgggtggacgaggacctgaaggacagcagcgacctgcaccaggccgaggaggacgccgacgagtggcaggagagcgaggagaacgtggagcacatccccttcagccacaaccactaccccgagaaggagatggtgaagagaagccaggagttctacgagctgctgaacaagagaagaagcgtgagattcatcagcaacgagcaggtgcccatggaggtgatcgacaacgtgatcagaaccgccggcaccgcccccagcggcgcccacaccgagccctggaccttcgtggtggtgaaggaccccgacgtgaagcacaagatcagaaagatcatcgaggaggaggaggagatcaactacatgaagagaatgggccacagatgggtgaccgacctgaagaagctgagaaccaactggatcaaggagtacctggacaccgcccccatcctgatcctgatcttcaagcaggtgcacggcttcgccgccaacggcaagaagaaggtgcactactacaacgagatcagcgtgagcatcgcctgcggcatcctgctggccgccctgcaggtgttcggcaagatcatcctgaaggagctggccctgatcagcttcctgaacctgtag

SEQ ID NO: 85769 - DNA, 855 bp, Artificial Sequence
  Description of Artificial Sequence: Synthetic coding sequence
atgtacttcctgacccccatcctggtggccatcctgtgcatcctggtggtgtggatcttcaagaacgccgacagaagcatggagaagaagaagggcgagcccagaaccagagccgaggccagaccctgggtggacgaggacctgaaggacagcagcgacctgcaccaggccgaggaggacgccgacgagtggcaggagagcgaggagaacgtggagcacatccccttcagccacaaccactaccccgagaaggagatggtgaagagaagccaggagttctacgagctgctgaacaagagaagaagcgtgagattcatcagcaacgagcaggtgcccatggaggtgatcgacaacgtgatcagaaccgccggcaccgcccccagcggcgcccacaccgagccctggaccttcgtggtggtgaaggaccccgacgtgaagcacaagatcagaaagatcatcgaggaggaggaggagatcaactacatgaagagaatgggccacagatgggtgaccgacctgaagaagctgagaaccaactggatcaaggagtacctggacaccgcccccatcctgatcctgatcttcaagcaggtgcacggcttcgccgccaacggcaagaagaaggtgcactactacaacgagatcagcgtgagcatcgcctgcggcatcctgctggccgccctgcaggtgaacaacggcatcaccatgagacaccagaccgccagacacagacacctgatcgagggccccggcagaagcagcgaggcctgcagcaagctgagcagccagggctgccccggcgccagcgccgccggcagcctgttccacttcgccatcgagttcgccgccccctag

SEQ ID NO: 85770 - DNA, 2850 bp, Artificial Sequence
  Description of Artificial Sequence: Synthetic coding sequence
atggagccccccggcagaagcagcagaagcaccgccagccacaccctgcaccagtactgctgccccacccaggtgctggacagcatgaagctgacccccagcggcagactggccgagagcagcgtggagggcgacgcccccggcagcgacctgagcaccgccgtggacagccccggcagccagcccccctacagactgagccagctgccccccagcagcagccacatgggcggcccccccgccggcgtgggcctgccctgggcccagagagccagactgcagcccgccagcgtggccctgagaaagcaggaggaggaggagatcaagagaagcaaggccctgagcgacagctacgagctgagcaccgacctgcaggacaagaaggtggagatgctggagagaaagtacggcggcagcttcctgagcagaagagccgccagaaccatccagaccgccttcagacagtacagaatgaacaagaacttcgagagactgagaagcagcgccagcgagagcagaatgagcagaagaatcatcctgagcaacatgagaatgcagttcagcttcgaggagtacgagaaggcccagaaccccgcctacttcgagggcaagcccgccagcctggacgagggcgccatggccggcgccagaagccacagactggagagaggcctgccctacggcggcagctgcggcggcggcatcgacggcggcggcagcagcgtgaccaccagcggcgagttcagcaacgacatcaccgagctggaggacagcttcagcaagcaggtgaagagcctggccgagagcatcgacgaggccctgaactgccaccccagcggccccatgagcgaggagcccggcagcgcccagctggagaagagagagagcaaggagcagcaggaggacagcagcgccaccagcttcagcgacctgcccctgtacctggacgacaccgtgccccagcagagccccgagagactgcccagcaccgagccccccccccagggcagacccgagttctgggcccccgcccccctgccccccgtgcccccccccgtgcccagcggcaccagagaggacggcagcagagaggagggcaccagaagaggccccggctgcctggagtgcagagacttcagactgagagccgcccacctgcccctgctgaccatcgagccccccagcgacagcagcgtggacctgagcgacagaagcgacagaggcagcgtgcacagacagctggtgtacgaggccgacggctgcagcccccacggcaccctgaagcacaagggcccccccggcagagcccccatcccccacagacactaccccgcccccgagggccccgcccccgccccccccggccccctgccccccgcccccaacagcggcaccggccccagcggcgtggccggcggcagaagactgggcaagtgcgaggccgccggcgagaacagcgacggcggcgacaacgagagcctggagagcagcagcaacagcaacgagaccatcaactgcagcagcggcagcagcagcagagacagcctgagagagccccccgccaccggcctgtgcaagcagacctaccagagagagaccagacacagctgggacagccccgccttcaacaacgacgtggtgcagagaagacactacagaatcggcctgaacctgttcaacaagaagcccgagaagggcatccagtacctgatcgagagaggcttcctgagcgacacccccgtgggcgtggcccacttcatcctggagagaaagggcctgagcagacagatgatcggcgagttcctgggcaacagacagaagcagttcaacagagacgtgctggactgcgtggtggacgagatggacttcagcagcatggacctggacgacgccctgagaaagttccagagccacatcagagtgcagggcgaggcccagaaggtggagagactgatcgaggccttcagccagagatactgcgtgtgcaaccccgccctggtgagacagttcagaaaccccgacaccatcttcatcctggccttcgccatcatcctgctgaacaccgacatgtacagccccagcgtgaaggccgagagaaagatgaagctggacgacttcatcaagaacctgagaggcgtggacaacggcgaggacatccccagagacctgctggtgggcatctaccagagaatccagggcagagagctgagaaccaacgacgaccacgtgagccaggtgcaggccgtggagagaatgatcgtgggcaagaagcccgtgctgagcctgccccacagaagactggtgtgctgctgccagctgtacgaggtgcccgaccccaacagaccccagagactgggcctgcaccagagagaggtgttcctgttcaacgacctgctggtggtgaccaagatcttccagaagaagaagatcctggtgacctacagcttcagacagagcttccccctggtggagatgcacatgcagctgttccagaacagctactaccagttcggcatcaagctgctgagcgccgtgcccggcggcgagagaaaggtgctgatcatcttcaacgcccccagcctgcaggacagactgagattcaccagcgacctgagagagagcatcgccgaggtgcaggagatggagaagtacagagtggagagcgagctggagaagcagaagggcatgatgagacccaacgccagccagcccggcggcgccaaggacagcgtgaacggcaccatggccagaagcagcctggaggacacctacggcgccggcgacggcctgaagagaggcgccctgagcagcagcctgagagacctgagcgacgccggcgtgtgctactag

SEQ ID NO: 85771 - DNA, 4437 bp, Artificial Sequence
  Description of Artificial Sequence: Synthetic coding sequence
atggaggccggcagcggcccccccggcggccccggcagcgagagccccaacagagccgtggagtacctgctggagctgaacaacatcatcgagagccagcagcagctgctggagacccagagaagaagaatcgaggagctggagggccagctggaccagctgacccaggagaacagagacctgagagaggagagccagctgcacagaggcgagctgcacagagacccccacggcgccagagacagccccggcagagagagccagtaccagaacctgagagagacccagttccaccacagagagctgagagagagccagttccaccaggccgccagagacgtgggctaccccaacagagagggcgcctaccagaacagagaggccgtgtacagagacaaggagagagacgccagctaccccctgcaggacaccaccggctacaccgccagagagagagacgtggcccagtgccacctgcaccacgagaaccccgccctgggcagagagagaggcggcagagaggccggccccgcccaccccggcagagagaaggaggccggctacagcgccgccgtgggcgtgggccccagaccccccagagagagaggccagctgagcagaggcgccagcagaagcagcagccccggcgccggcggcggccacagcaccagcaccagcaccagccccgccaccaccctgcagagaaacgtggagggcgacgcccccggcagcgacctgagcaccgccgtggacagccccggcagccagcccccctacagactgagccagctgccccccagcagcagccacatgggcggcccccccgccggcgtgggcctgccctgggcccagagagccagactgcagcccgccagcgtggccctgagaaagcaggaggaggaggagatcaagagaagcaaggccctgagcgacagctacgagctgagcaccgacctgcaggacaagaaggtggagatgctggagagaaagtacggcggcagcttcctgagcagaagagccgccagaaccatccagaccgccttcagacagtacagaatgaacaagaacttcgagagactgagaagcagcgccagcgagagcagaatgagcagaagaatcatcctgagcaacatgagaatgcagttcagcttcgaggagtacgagaaggcccagaaccccgcctacttcgagggcaagcccgccagcctggacgagggcgccatggccggcgccagaagccacagactggagagaggcctgccctacggcggcagctgcggcggcggcatcgacggcggcggcagcagcgtgaccaccagcggcgagttcagcaacgacatcaccgagctggaggacagcttcagcaagcaggtgaagagcctggccgagagcatcgacgaggccctgaactgccaccccagcggccccatgagcgaggagcccggcagcgcccagctggagaagagagagagcaaggagcagcaggaggacagcagcgccaccagcttcagcgacctgcccctgtacctggacgacaccgtgccccagcagagccccgagagactgcccagcaccgagccccccccccagggcagacccgagttctgggcccccgcccccctgccccccgtgcccccccccgtgcccagcggcaccagagaggacggcagcagagaggagggcaccagaagaggccccggctgcctggagtgcagagacttcagactgagagccgcccacctgcccctgctgaccatcgagccccccagcgacagcagcgtggacctgagcgacagaagcgacagaggcagcgtgcacagacagctggtgtacgaggccgacggctgcagcccccacggcaccctgaagcacaagggcccccccggcagagcccccatcccccacagacactaccccgcccccgagggccccgcccccgccccccccggccccctgccccccgcccccaacagcggcaccggccccagcggcgtggccggcggcagaagactgggcaagtgcgaggccgccggcgagaacagcgacggcggcgacaacgagagcctggagagcagcagcaacagcaacgagaccatcaactgcagcagcggcagcagcagcagagacagcctgagagagccccccgccaccggcctgtgcaagcagacctaccagagagagaccagacacagctgggacagccccgccttcaacaacgacgtggtgcagagaagacactacagaatcggcctgaacctgttcaacaagaagcccgagaagggcatccagtacctgatcgagagaggcttcctgagcgacacccccgtgggcgtggcccacttcatcctggagagaaagggcctgagcagacagatgatcggcgagttcctgggcaacagacagaagcagttcaacagagacgtgctggactgcgtggtggacgagatggacttcagcagcatggacctggacgacgccctgagaaagttccagagccacatcagagtgcagggcgaggcccagaaggtggagagactgatcgaggccttcagccagagatactgcgtgtgcaaccccgccctggtgagacagttcagaaaccccgacaccatcttcatcctggccttcgccatcatcctgctgaacaccgacatgtacagccccagcgtgaaggccgagagaaagatgaagctggacgacttcatcaagaacctgagaggcgtggacaacggcgaggacatccccagagacctgctggtgggcatctaccagagaatccagggcagagagctgagaaccaacgacgaccacgtgagccaggtgcaggccgtggagagaatgatcgtgggcaagaagcccgtgctgagcctgccccacagaagactggtgtgctgctgccagctgtacgaggtgcccgaccccaacagaccccagagactgggcctgcaccagagagaggtgttcctgttcaacgacctgctggtggtgaccaagatcttccagaagaagaagatcctggtgacctacagcttcagacagagcttccccctggtggagatgcacatgcagctgttccagaacagctactaccagttcggcatcaagctgctgagcgccgtgcccggcggcgagagaaaggtgctgatcatcttcaacgcccccagcctgcaggacagactgagattcaccagcgacctgagagagagcatcgccgaggtgcaggagatggagaagtacagagtggagagcgagctggagaagcagaagggcatgatgagacccaacgccagccagcccggcggcgccaaggacagcgtgaacggcaccatggccagaagcagcctggaggacacctacggcgccggcgacggcctgaagagaggcgccctgagcagcagcctgagagacctgagcgacgccggcaagagaggcagaagaaacagcgtgggcagcctggacagcaccatcgagggcagcgtgatcagcagccccagaccccaccagagaatgcccccccccccccccccccccccccccgaggagtacaagagccagagacccgtgagcaacagcagcagcttcctgggcagcctgttcggcagcaagagaggcaagggccccttccagatgccccccccccccaccggccaggccagcgccagcagcagcagcgccagcagcacccaccaccaccaccaccaccaccaccacggccacagccacggcggcctgggcgtgctgcccgacggccagagcaagctgcaggccctgcacgcccagtactgccagggccccggccccgccccccccccctacctgcccccccagcagcccagcctgcccccccccccccagcagcccccccccctgccccagctgggcagcatcccccccccccccgccagcgccccccccgtgggcccccacagacacttccacgcccacggccccgtgcccggcccccagcactacaccctgggcagacccggcagagcccccagaagaggcgccggcggccacccccagttcgccccccacggcagacaccccctgcaccagcccaccagccccctgcccctgtacagccccgccccccagcacccccccgcccacaagcagggccccaagcacttcatcttcagccaccacccccagatgatgcccgccgccggcgccgccggcggccccggcagcagaccccccggcggcagctacagccacccccaccacccccagagccccctgagcccccacagccccatccccccccaccccagctacccccccctgcccccccccagcccccacaccccccacagccccctgccccccaccagcccccacggccccctgcacgccagcggcccccccggcaccgccaacccccccagcgccaaccccaaggccaagcccagcagaatcagcaccgtggtgtag

SEQ ID NO: 85772 - DNA, 4467 bp, Artificial Sequence
  Description of Artificial Sequence: Synthetic coding sequence
atggaggccggcagcggcccccccggcggccccggcagcgagagccccaacagagccgtggagtacctgctggagctgaacaacatcatcgagagccagcagcagctgctggagacccagagaagaagaatcgaggagctggagggccagctggaccagctgacccaggagaacagagacctgagagaggagagccagctgcacagaggcgagctgcacagagacccccacggcgccagagacagccccggcagagagagccagtaccagaacctgagagagacccagttccaccacagagagctgagagagagccagttccaccaggccgccagagacgtgggctaccccaacagagagggcgcctaccagaacagagaggccgtgtacagagacaaggagagagacgccagctaccccctgcaggacaccaccggctacaccgccagagagagagacgtggcccagtgccacctgcaccacgagaaccccgccctgggcagagagagaggcggcagagaggccggccccgcccaccccggcagagagaaggaggccggctacagcgccgccgtgggcgtgggccccagaccccccagagagagaggccagctgagcagaggcgccagcagaagcagcagccccggcgccggcggcggccacagcaccagcaccagcaccagccccgccaccaccctgcagagaaagagcgacggcgagaacagcagaaccgtgagcgtggagggcgacgcccccggcagcgacctgagcaccgccgtggacagccccggcagccagcccccctacagactgagccagctgccccccagcagcagccacatgggcggcccccccgccggcgtgggcctgccctgggcccagagagccagactgcagcccgccagcgtggccctgagaaagcaggaggaggaggagatcaagagaagcaaggccctgagcgacagctacgagctgagcaccgacctgcaggacaagaaggtggagatgctggagagaaagtacggcggcagcttcctgagcagaagagccgccagaaccatccagaccgccttcagacagtacagaatgaacaagaacttcgagagactgagaagcagcgccagcgagagcagaatgagcagaagaatcatcctgagcaacatgagaatgcagttcagcttcgaggagtacgagaaggcccagaaccccgcctacttcgagggcaagcccgccagcctggacgagggcgccatggccggcgccagaagccacagactggagagaggcctgccctacggcggcagctgcggcggcggcatcgacggcggcggcagcagcgtgaccaccagcggcgagttcagcaacgacatcaccgagctggaggacagcttcagcaagcaggtgaagagcctggccgagagcatcgacgaggccctgaactgccaccccagcggccccatgagcgaggagcccggcagcgcccagctggagaagagagagagcaaggagcagcaggaggacagcagcgccaccagcttcagcgacctgcccctgtacctggacgacaccgtgccccagcagagccccgagagactgcccagcaccgagccccccccccagggcagacccgagttctgggcccccgcccccctgccccccgtgcccccccccgtgcccagcggcaccagagaggacggcagcagagaggagggcaccagaagaggccccggctgcctggagtgcagagacttcagactgagagccgcccacctgcccctgctgaccatcgagccccccagcgacagcagcgtggacctgagcgacagaagcgacagaggcagcgtgcacagacagctggtgtacgaggccgacggctgcagcccccacggcaccctgaagcacaagggcccccccggcagagcccccatcccccacagacactaccccgcccccgagggccccgcccccgccccccccggccccctgccccccgcccccaacagcggcaccggccccagcggcgtggccggcggcagaagactgggcaagtgcgaggccgccggcgagaacagcgacggcggcgacaacgagagcctggagagcagcagcaacagcaacgagaccatcaactgcagcagcggcagcagcagcagagacagcctgagagagccccccgccaccggcctgtgcaagcagacctaccagagagagaccagacacagctgggacagccccgccttcaacaacgacgtggtgcagagaagacactacagaatcggcctgaacctgttcaacaagaagcccgagaagggcatccagtacctgatcgagagaggcttcctgagcgacacccccgtgggcgtggcccacttcatcctggagagaaagggcctgagcagacagatgatcggcgagttcctgggcaacagacagaagcagttcaacagagacgtgctggactgcgtggtggacgagatggacttcagcagcatggacctggacgacgccctgagaaagttccagagccacatcagagtgcagggcgaggcccagaaggtggagagactgatcgaggccttcagccagagatactgcgtgtgcaaccccgccctggtgagacagttcagaaaccccgacaccatcttcatcctggccttcgccatcatcctgctgaacaccgacatgtacagccccagcgtgaaggccgagagaaagatgaagctggacgacttcatcaagaacctgagaggcgtggacaacggcgaggacatccccagagacctgctggtgggcatctaccagagaatccagggcagagagctgagaaccaacgacgaccacgtgagccaggtgcaggccgtggagagaatgatcgtgggcaagaagcccgtgctgagcctgccccacagaagactggtgtgctgctgccagctgtacgaggtgcccgaccccaacagaccccagagactgggcctgcaccagagagaggtgttcctgttcaacgacctgctggtggtgaccaagatcttccagaagaagaagatcctggtgacctacagcttcagacagagcttccccctggtggagatgcacatgcagctgttccagaacagctactaccagttcggcatcaagctgctgagcgccgtgcccggcggcgagagaaaggtgctgatcatcttcaacgcccccagcctgcaggacagactgagattcaccagcgacctgagagagagcatcgccgaggtgcaggagatggagaagtacagagtggagagcgagctggagaagcagaagggcatgatgagacccaacgccagccagcccggcggcgccaaggacagcgtgaacggcaccatggccagaagcagcctggaggacacctacggcgccggcgacggcctgaagagaggcgccctgagcagcagcctgagagacctgagcgacgccggcaagagaggcagaagaaacagcgtgggcagcctggacagcaccatcgagggcagcgtgatcagcagccccagaccccaccagagaatgcccccccccccccccccccccccccccgaggagtacaagagccagagacccgtgagcaacagcagcagcttcctgggcagcctgttcggcagcaagagaggcaagggccccttccagatgccccccccccccaccggccaggccagcgccagcagcagcagcgccagcagcacccaccaccaccaccaccaccaccaccacggccacagccacggcggcctgggcgtgctgcccgacggccagagcaagctgcaggccctgcacgcccagtactgccagggccccggccccgccccccccccctacctgcccccccagcagcccagcctgcccccccccccccagcagcccccccccctgccccagctgggcagcatcccccccccccccgccagcgccccccccgtgggcccccacagacacttccacgcccacggccccgtgcccggcccccagcactacaccctgggcagacccggcagagcccccagaagaggcgccggcggccacccccagttcgccccccacggcagacaccccctgcaccagcccaccagccccctgcccctgtacagccccgccccccagcacccccccgcccacaagcagggccccaagcacttcatcttcagccaccacccccagatgatgcccgccgccggcgccgccggcggccccggcagcagaccccccggcggcagctacagccacccccaccacccccagagccccctgagcccccacagccccatccccccccaccccagctacccccccctgcccccccccagcccccacaccccccacagccccctgccccccaccagcccccacggccccctgcacgccagcggcccccccggcaccgccaacccccccagcgccaaccccaaggccaagcccagcagaatcagcaccgtggtgtag

SEQ ID NO: 85773 - DNA, 3549 bp, Artificial Sequence
  Description of Artificial Sequence: Synthetic coding sequence
atggagagcctgctggagaaccccgtgagagccgtgctgtacctgaaggagctgaccgccatcgtgcagaaccagcagagcctgatccacacccagagagagagaatcgacgagctggagagaagactggacgagctgagcgccgagaacagaagcctgtgggagcaccagcagctgctgcaggcccagcccccccccggcctggtgccccccagcagcgcccccctgcccgccgcccccgccaccgcccccgccgccgccgccagagcccaggagcccctgcaggaccagggccagagaagcgccgccgccccccaccccgcccccgacagaccccccagacagcaccacggccagctgctggagcagccccagagaggccccggcagcagagcccacaccccccagagcccccacaagcacctgggcacccagggcgccgtgaccgacaaggagaaggagagaccccccagctgctgcgccgccgccggcgccctgctgcagcacaagagccccagcgccctgggcaagggcgtgctgagcagaagacccgagaacgagaccgtgctgcaccagttctgctgccccgccgccgacgcctgcagcgacctggccagccagagcgacggcagctgcacccaggccggcggcggcatggaggacagcgtggtggccgccgccgccgtggccgccggcagacccagcgcccacgcccccaaggcccaggcccaggagctgcaggaggaggaggagagacccggcgccggcgccgccagccccagagccggcccccagcacaaggccagccccggcagacagcagcccgccctggccaccgccctgtgcccccacgcccccgccgccagcgactacgagctgagcctggacctgaagaacaagcagatcgagatgctggagcacaagtacggcggccacctggtgagcagaagagccgcctgcaccatccagaccgccttcagacagtaccagctgagcaagaacttcgagaagatcagaaacagcctgctggagagcagactgcccagaagaatcagcctgagaaaggtgagaagccccaccgccgagagcctggccgccgagaaggccctgatggagggctacggcctggtgggcctgcccctggtgagaagccccagcctgccccccaccttcgccggcaccctgaccgagctggaggacagcttcaccgagcaggtgcagagcctggccaagagcatcgacgacgccctgagcacctggagcctgaagaccatgtgcagcctgagagagagcggcgcctaccagctgcaccaggccctgcaggccgccgccggcccccccggcctggaggccgagggcagagcccccgagagcgccggccccggccccggcgacgacgccgccgagacccccggcctgccccccgcccacagcggcaccctgatgatggccttcagagacgtgaccgtgcagatcgccaaccagaacatcagcgtgagcagcagcaccgccctgagcgtggccaactgcctgggcgcccagaccgtgcaggcccccgccgagcccgccgccggcaaggccgagcagggcgagaccagcggcagagaggcccccgaggcccccgccgtgggcagagaggacgccagcgccgaggacagctgcgccgaggccgccgccagcggcgccgccgacggcgccaccgcccccaagaccgaggaggaggaggaggaggaggagaccgccgaggtgggcagaggcgccgaggccgaggccggcgacctggagcagctgagcagcagcagcaccagcaccaagagcgccaagagcggcagcgaggccagcgccagcgccagcaaggacgccctgcaggccatgatcctgagcctgcccagataccactgcgagaaccccgccagctgcaagagccccaccctgagcaccgacaccctgagaaagagactgtacagaatcggcctgaacctgttcaacatcaaccccgacaagggcatccagttcctgatcagcagaggcttcatccccgacacccccatcggcgtggcccacttcctgctgcagagaaagggcctgagcagacagatgatcggcgagttcctgggcaacagcaagaagcagttcaacagagacgtgctggactgcgtggtggacgagatggacttcagcagcatggagctggacgaggccctgagaaagttccaggcccacatcagagtgcagggcgaggcccagaaggtggagagactgatcgaggccttcagccagagatactgcatgtgcaaccccgaggtggtgcagcagttccacaaccccgacaccatcttcatcctggccttcgccatcatcctgctgaacaccgacatgtacagccccaacatcaagcccgacagaaagatgatgctggaggacttcatcagaaacctgagaggcgtggacgacggcgccgacatccccagagagctggtggtgggcatctacgagagaatccagcagaaggagctgaagagcaacgaggaccacgtgacctacgtgaccaaggtggagaagagcatcgtgggcatgaagaccgtgctgagcgtgccccacagaagactggtgtgctgcagcagactgttcgaggtgaccgacgtgaacaagctgcagaagcaggccgcccaccagagagaggtgttcctgttcaacgacctgctggtgatcctgaagctgtgccccaagaagaagagcagcagcacctacaccttctgcaagagcgtgggcctgctgggcatgcagttccagctgttcgagaacgagtactacagccacggcatcaccctggtgacccccctgagcggcagcgagaagaagcaggtgctgcacttctgcgccctgggcagcgacgagatgcagaagttcgtggaggacctgaaggagagcatcgccgaggtgaccgagctggagcagatcagaatcgagtgggagctggagaagcagcagggcaccaagaccctgagcttcaagccctgcggcgcccagggcgacccccagagcaagcagggcagccccaccgccaagagagaggccgccctgagagagagacccgccgagagcaccgtggaggtgagcatccacaacagactgcagaccagccagcacaacagcggcctgggcgccgagagaggcgcccccgtgcccccccccgacctgcagcccagcccccccagacagcagaccccccccctgcccccccccccccccaccccccccggcaccctggtgcagtgccagcagatcgtgaaggtgatcgtgctggacaagccctgcctggccagaatggagcccctgctgagccaggccctgagctgctacaccagcagcagcagcgacagctgcggcagcacccccctgggcggccccggcagccccgtgaaggtgacccaccagccccccctgcccccccccccccccccctacaaccacccccaccagttctgcccccccggcagcctgctgcacggccacagatacagcagcggcagcagaagcctggtgtag

SEQ ID NO: 85774 - DNA, 2280 bp, Artificial Sequence
  Description of Artificial Sequence: Synthetic coding sequence
atgctggagcacaagtacggcggccacctggtgagcagaagagccgcctgcaccatccagaccgccttcagacagtaccagctgagcaagaacttcgagaagatcagaaacagcctgctggagagcagactgcccagaagaatcagcctgagaaaggtgagaagccccaccgccgagagcctggccgccgagaaggccctgatggagggctacggcctggtgggcctgcccctggtgagaagccccagcctgccccccaccttcgccggcaccctgaccgagctggaggacagcttcaccgagcaggtgcagagcctggccaagagcatcgacgacgccctgagcacctggagcctgaagaccatgtgcagcctgagagagagcggcgcctaccagctgcaccaggccctgcaggccgccgccggcccccccggcctggaggccgagggcagagcccccgagagcgccggccccggccccggcgacgacgccgccgagacccccggcctgccccccgcccacagcggcaccctgatgatggccttcagagacgtgaccgtgcagatcgccaaccagaacatcagcgtgagcagcagcaccgccctgagcgtggccaactgcctgggcgcccagaccgtgcaggcccccgccgagcccgccgccggcaaggccgagcagggcgagaccagcggcagagaggcccccgaggcccccgccgtgggcagagaggacgccagcgccgaggacagctgcgccgaggccgccgccagcggcgccgccgacggcgccaccgcccccaagaccgaggaggaggaggaggaggaggagaccgccgaggtgggcagaggcgccgaggccgaggccggcgacctggagcagctgagcagcagcagcaccagcaccaagagcgccaagagcggcagcgaggccagcgccagcgccagcaaggacgccctgcaggccatgatcctgagcctgcccagataccactgcgagaaccccgccagctgcaagagccccaccctgagcaccgacaccctgagaaagagactgtacagaatcggcctgaacctgttcaacatcaaccccgacaagggcatccagttcctgatcagcagaggcttcatccccgacacccccatcggcgtggcccacttcctgctgcagagaaagggcctgagcagacagatgatcggcgagttcctgggcaacagcaagaagcagttcaacagagacgtgctggactgcgtggtggacgagatggacttcagcagcatggagctggacgaggccctgagaaagttccaggcccacatcagagtgcagggcgaggcccagaaggtggagagactgatcgaggccttcagccagagatactgcatgtgcaaccccgaggtggtgcagcagttccacaaccccgacaccatcttcatcctggccttcgccatcatcctgctgaacaccgacatgtacagccccaacatcaagcccgacagaaagatgatgctggaggacttcatcagaaacctgagaggcgtggacgacggcgccgacatccccagagagctggtggtgggcatctacgagagaatccagcagaaggagctgaagagcaacgaggaccacgtgacctacgtgaccaaggtggagaagagcatcgtgggcatgaagaccgtgctgagcgtgccccacagaagactggtgtgctgcagcagactgttcgaggtgaccgacgtgaacaagctgcagaagcaggccgcccaccagagagaggtgttcctgttcaacgacctgctggtgatcctgaagctgtgccccaagaagaagagcagcagcacctacaccttctgcaagagcgtgggcctgctgggcatgcagttccagctgttcgagaacgagtactacagccacggcatcaccctggtgacccccctgagcggcagcgagaagaagcaggtgctgcacttctgcgccctgggcagcgacgagatgcagaagttcgtggaggacctgaaggagagcatcgccgaggtgaccgagctggagcagatcagaatcgagtgggagctggagaagcagcagggcaccaagaccctgagcttcaagccctgcggcgcccagggcgacccccagagcaagcagggcagccccaccgccaagagagaggccgccctgagagagagacccgccgagagcaccgtggaggtgctgatcaacgccagccccgccagactgaccatcctgcccatcagcagagacaccatcaagagctactgctag

SEQ ID NO: 85775 - DNA, 3549 bp, Artificial Sequence; identical to SEQ ID NO: 85773
  Description of Artificial Sequence: Synthetic coding sequence

SEQ ID NO: 85776 - DNA, 1797 bp, Artificial Sequence
  Description of Artificial Sequence: Synthetic coding sequence
atgaagcccaccggcaccgaccccagaatcctgagcatcgccgccgaggtggccaagagccccgagcagaacgtgcccgtgatcctgctgaagctgaaggagatcatcaacatcacccccctgggcagcagcgagctgaagaagatcaagcaggacatctactgctacgacctgatccagtactgcctgctggtgctgagccaggactacagcagaatccagggcggctggaccaccatcagccagctgacccagatcctgagccactgctgcgtgggcctggagcccggcgaggacgccgaggagttctacaacgagctgctgcccagcgccgccgagaacttcctggtgctgggcagacagctgcagacctgcttcatcaacgccgccaaggccgaggagaaggacgagctgctgcacttcttccagatcgtgaccgacagcctgttctggctgctgggcggccacgtggagctgatccagaacgtgctgcagagcgaccacttcctgcacctgctgcaggccgacaacgtgcagatcggcagcgccgtgatgatgatgctgcagaacatcctgcagatcaacagcggcgacctgctgagaatcggcagaaaggccctgtacagcatcctggacgaggtgatcttcaagctgttcagcacccccagccccgtgatcagaagcaccgccaccaagctgctgctgctgatggccgagagccaccaggagatcctgatcctgctgagacagagcacctgctacaagggcctgagaagactgctgagcaagcaggagaccggcaccgagttcagccaggagctgagacagctggtgggcctgctgagccccatggtgtaccaggaggtggaggagcagaagctgcaccaggccgcctgcctgatccaggcctactggaagggcttccagaccagaaagagactgaagaagctgcccagcgccgtgatcgccctgcagagaagcttcagaagcaagagaagcaagatgctgctggagatcaacagacagaaggaggaggaggacctgaagctgcagctgcagctgcagagacagagagccatgagactgagcagagagctgcagctgagcatgctggagatcgtgcaccccggccaggtggagaagcactacagagagatggaggagaagagcgccctgatcatccagaagcactggagaggctacagagagagaaagaacttccaccagcagagacagagcctgatcgagtacaaggccgccgtgaccctgcagagagccgccctgaagttcctggccaagtgcagaaagaagaagaagctgttcgccccctggagaggcctgcaggagctgaccgacgccagaagagtggagctgaagaagagagtggacgactacgtgagaagacacctgggcagccccatgagcgacgtggtgagcagagagctgcacgcccaggcccaggagagactgcagcactacttcatgggcagagccctggaggagagagcccagcagcacagagaggccctgatcgcccagatcagcaccaacgtggagcagctgatgaaggcccccagcctgaaggaggccgagggcaaggagcccgagctgttcctgagcagaagcagacccgtggccgccaaggccaagcaggcccacctgaccaccctgaagcacatccaggccccctggtggaagaagctgggcgaggagagcggcgacgagatcgacgtgcccaaggacgagctgagcatcgagctggagaacctgttcatcggcggcaccaagcccccctag

SEQ ID NO: 85777 - DNA, 1398 bp, Artificial Sequence
  Description of Artificial Sequence: Synthetic coding sequence
atgaagcccaccggcaccgaccccagaatcctgagcatcgccgccgaggtggccaagagccccgagcagaacgtgcccgtgatcctgctgaagctgaaggagatcatcaacatcacccccctgggcagcagcgagctgaagaagatcaagcaggacatctactgctacgacctgatccagtactgcctgctggtgctgagccaggactacagcagaatccagggcggctggaccaccatcagccagctgacccagatcctgagccactgctgcgtgggcctggagcccggcgaggacgccgaggagttctacaacgagctgctgcccagcgccgccgagaacttcctggtgctgggcagacagctgcagacctgcttcatcaacgccgccaaggccgaggagaaggacgagctgctgcacttcttccagatcgtgaccgacagcctgttctggctgctgggcggccacgtggagctgatccagaacgtgctgcagagcgaccacttcctgcacctgctgcaggccgacaacgtgcagatcggcagcgccgtgatgatgatgctgcagaacatcctgcagatcaacagaagcaagagaagcaagatgctgctggagatcaacagacagaaggaggaggaggacctgaagctgcagctgcagctgcagagacagagagccatgagactgagcagagagctgcagctgagcatgctggagatcgtgcaccccggccaggtggagaagcactacagagagatggaggagaagagcgccctgatcatccagaagcactggagaggctacagagagagaaagaacttccaccagcagagacagagcctgatcgagtacaaggccgccgtgaccctgcagagagccgccctgaagttcctggccaagtgcagaaagaagaagaagctgttcgccccctggagaggcctgcaggagctgaccgacgccagaagagtggagctgaagaagagagtggacgactacgtgagaagacacctgggcagccccatgagcgacgtggtgagcagagagctgcacgcccaggcccaggagagactgcagcactacttcatgggcagagccctggaggagagagcccagcagcacagagaggccctgatcgcccagatcagcaccaacgtggagcagctgatgaaggcccccagcctgaaggaggccgagggcaaggagcccgagctgttcctgagcagaagcagacccgtggccgccaaggccaagcaggcccacctgaccaccctgaagcacatccaggccccctggtggaagaagctgggcgaggagagcggcgacgagatcgacgtgcccaaggacgagctgagcatcgagctggagaacctgttcatcggcggcaccaagcccccctag

SEQ ID NO: 85778 - DNA, 264 bp, Artificial Sequence
  Description of Artificial Sequence: Synthetic coding sequence
atgaagcccaccggcaccgaccccagaatcctgagcatcgccgccgaggtggccaagagccccgagcagaacgtgcccgtgatcctgctgaagctgaaggagatcatcaacatcacccccctgggcagcagcgagctgaagaagatcaagcaggacatctactgctacgacctgatccagtactgcctgctggtgctgagccaggactacagcagaatccagggcggctggaccaccatcagccagctgacccagatcctgtag

SEQ ID NO: 85779 - DNA, 1332 bp, Artificial Sequence
  Description of Artificial Sequence: Synthetic coding sequence
atggaggaggacagcctggaggacagcaacctgccccccaaggtgtggcacagcgagatgaccgtgagcgtgaccggcgagccccccagcaccgtggaggaggagggcatccccaaggagaccgacatcgagatcatccccgagatccccgagaccctggagcccctgagcctgcccgacgtgctgagaatcagcgccgtgctggaggacaccaccgaccagctgagcatcctgaactacatcatgcccgtgcagtacgagggcagacagagcatctgcgtgaagagcagagagatgaacctggagggcaccaacctggacaagctgcccatggccagcaccatcaccaagatccccagccccctgatcaccgaggagggccccaacctgcccgagatcagacacagaggcagattcgccgtggagttcaacaagatgcaggacctggtgttcaagaagcccaccagacagaccatcatgaccaccgagaccctgaagaagatccagatcgacagacagttcttcagcgacgtgatcgccgacaccatcaaggagctgcaggacagcgccacctacaacagcctgctgcaggccctgagcaaggagagagagaacaagatgcacttctacgacatcatcgccagagaggagaagggcagaaagcagatcatcagcctgcagaagcagctgatcaacgtgaagaaggagtggcagttcgaggtgcagagccagaacgagtacatcgccaacctgaaggaccagctgcaggagatgaaggccaagagcaacctggagaacagatacatgaagaccaacaccgagctgcagatcgcccagacccagaagaagtgcaacagaaccgaggagctgctggtggaggagatcgagaagctgagaatgaagaccgaggaggaggccagaacccacaccgagatcgagatgttcctgagaaaggagcagcagaagctggaggagagactggagttctggatggagaagtacgacaaggacaccgagatgaagcagaacgagctgaacgccctgaaggccaccaaggccagcgacctggcccacctgcaggacctggccaagatgatcagagagtacgagcaggtgatcatcgaggacagaatcgagaaggagagaagcaagaagaaggtgaagcaggacctgctggagctgaagagcgtgatcaagctgcaggcctggtggagaggcaccatgatcagaagagagatcggcggcttcaagatgcccaaggacaaggtggacagcaaggacagcaagggcaagggcaagggcaaggacaagagaagaggcaagaagaagtag

SEQ ID NO: 85780 - DNA, 165 bp, Artificial Sequence
  Description of Artificial Sequence: Synthetic coding sequence
atggaggaggacagcctggaggacagcaacctgccccccaaggtgtggcacagcgagatgaccgtgagcgtgaccggcgagccccccagcaccgtggaggaggagggcatccccaaggagaccgacatcgagatcatccccgagatccccgagaccctggagtag

SEQ ID NO: 85781 - DNA, 1332 bp, Artificial Sequence; identical to SEQ ID NO: 85779
  Description of Artificial Sequence: Synthetic coding sequence

SEQ ID NO: 85782 - DNA, 4974 bp, Artificial Sequence
  Description of Artificial Sequence: Synthetic coding sequence
atgagcgccgccgacgaggtggacggcctgggcgtggccagaccccactacggcagcgtgctggacaacgagagactgaccgccgaggagatggacgagagaagaagacagaacgtggcctacgagtacctgtgccacctggaggaggccaagagatggatggaggcctgcctgggcgaggacctgccccccaccaccgagctggaggagggcctgagaaacggcgtgtacctggccaagctgggcaacttcttcagccccaaggtggtgagcctgaagaagatctacgacagagagcagaccagatacaaggccaccggcctgcacttcagacacaccgacaacgtgatccagtggctgaacgccatggacgagatcggcctgcccaagatcttctaccccgagaccaccgacatctacgacagaaagaacatgcccagatgcatctactgcatccacgccctgagcctgtacctgttcaagctgggcctggccccccagatccaggacctgtacggcaaggtggacttcaccgaggaggagatcaacaacatgaagaccgagctggagaagtacggcatccagatgcccgccttcagcaagatcggcggcatcctggccaacgagctgagcgtggacgaggccgccctgcacgccgccgtgatcgccatcaacgaggccatcgacagaagaatccccgccgacaccttcgccgccctgaagaaccccaacgccatgctggtgaacctggaggagcccctggccagcacctaccaggacatcctgtaccaggccaagcaggacaagatgaccaacgccaagaacagaaccgagaacagcgagagagagagagacgtgtacgaggagctgctgacccaggccgagatccagggcaacatcaacaaggtgaacaccttcagcgccctggccaacatcgacctggccctggagcagggcgacgccctggccctgttcagagccctgcagagccccgccctgggcctgagaggcctgcagcagcagaacagcgactggtacctgaagcagctgctgagcgacaagcagcagaagagacagagcggccagaccgaccccctgcagaaggaggagctgcagagcggcgtggacgccgccaacagcgccgcccagcagtaccagagaagactggccgccgtggccctgatcaacgccgccatccagaagggcgtggccgagaagaccgtgctggagctgatgaaccccgaggcccagctgccccaggtgtaccccttcgccgccgacctgtaccagaaggagctggccaccctgcagagacagagccccgagcacaacctgacccaccccgagctgagcgtggccgtggagatgctgagcagcgtggccctgatcaacagagccctggagagcggcgacgtgaacaccgtgtggaagcagctgagcagcagcgtgaccggcctgaccaacatcgaggaggagaactgccagagatacctggacgagctgatgaagctgaaggcccaggcccacgccgagaacaacgagttcatcacctggaacgacatccaggcctgcgtggaccacgtgaacctggtggtgcaggaggagcacgagagaatcctggccatcggcctgatcaacgaggccctggacgagggcgacgcccagaagaccctgcaggccctgcagatccccgccgccaagctggagggcgtgctggccgaggtggcccagcactaccaggacaccctgatcagagccaagagagagaaggcccaggagatccaggacgagagcgccgtgctgtggctggacgagatccagggcggcatctggcagagcaacaaggacacccaggaggcccagaagttcgccctgggcatcttcgccatcaacgaggccgtggagagcggcgacgtgggcaagaccctgagcgccctgagaagccccgacgtgggcctgtacggcgtgatccccgagtgcggcgagacctaccacagcgacctggccgaggccaagaagaagaagctggccgtgggcgacaacaacagcaagtgggtgaagcactgggtgaagggcggctactactactaccacaacctggagacccaggagggcggctgggacgagccccccaacttcgtgcagaacagcatgcagctgagcagagaggagatccagagcagcatcagcggcgtgaccgccgcctacaacagagagcagctgtggctggccaacgagggcctgatcaccagactgcaggccagatgcagaggctacctggtgagacaggagttcagaagcagaatgaacttcctgaagaagcagatccccgccatcacctgcatccagagccagtggagaggctacaagcagaagaaggcctaccaggacagactggcctacctgagaagccacaaggacgaggtggtgaagatccagagcctggccagaatgcaccaggccagaaagagatacagagacagactgcagtacttcagagaccacatcaacgacatcatcaagatccaggccttcatcagagccaacaaggccagagacgactacaagaccctgatcaacgccgaggacccccccatggtggtggtgagaaagttcgtgcacctgctggaccagagcgaccaggacttccaggaggagctggacctgatgaagatgagagaggaggtgatcaccctgatcagaagcaaccagcagctggagaacgacctgaacctgatggacatcaagatcggcctgctggtgaagaacaagatcaccctgcaggacgtggtgagccacagcaagaagctgaccaagaagaacaaggagcagctgagcgacatgatgatgatcaacaagcagaagggcggcctgaaggccctgagcaaggagaagagagagaagctggaggcctaccagcacctgttctacctgctgcagaccaaccccacctacctggccaagctgatcttccagatgccccagaacaagagcaccaagttcatggacagcgtgatcttcaccctgtacaactacgccagcaaccagagagaggagtacctgctgctgagactgttcaagaccgccctgcaggaggagatcaagagcaaggtggaccagatccaggagatcgtgaccggcaaccccaccgtgatcaagatggtggtgagcttcaacagaggcgccagaggccagaacgccctgagacagatcctggcccccgtggtgaaggagatcatggacgacaagagcctgaacatcaagaccgaccccgtggacatctacaagagctgggtgaaccagatggagagccagaccggcgaggccagcaagctgccctacgacgtgacccccgagcaggccctggcccacgaggaggtgaagaccagactggacagcagcatcagaaacatgagagccgtgaccgacaagttcctgagcgccatcgtgagcagcgtggacaagatcccctacggcatgagattcatcgccaaggtgctgaaggacagcctgcacgagaagttccccgacgccggcgaggacgagctgctgaagatcatcggcaacctgctgtactacagatacatgaaccccgccatcgtggcccccgacgccttcgacatcatcgacctgagcgccggcggccagctgaccaccgaccagagaagaaacctgggcagcatcgccaagatgctgcagcacgccgccagcaacaagatgttcctgggcgacaacgcccacctgagcatcatcaacgagtacctgagccagagctaccagaagttcagaagattcttccagaccgcctgcgacgtgcccgagctgcaggacaagttcaacgtggacgagtacagcgacctggtgaccctgaccaagcccgtgatctacatcagcatcggcgagatcatcaacacccacaccctgctgctggaccaccaggacgccatcgcccccgagcacaacgaccccatccacgagctgctggacgacctgggcgaggtgcccaccatcgagagcctgatcggcgagagcagcggcaacctgaacgaccccaacaaggaggccctggccaagaccgaggtgagcctgaccctgaccaacaagttcgacgtgcccggcgacgagaacgccgagatggacgccagaaccatcctgctgaacaccaagagactgatcgtggacgtgatcagattccagcccggcgagaccctgaccgagatcctggagacccccgccaccagcgagcaggaggccgagcaccagagagccatgcagagaagagccatcagagacgccaagacccccgacaagatgaagaagagcaagagcgtgaaggaggacagcaacctgaccctgcaggagaagaaggagaagatccagaccggcctgaagaagctgaccgagctgggcaccgtggaccccaagaacaagtaccaggagctgatcaacgacatcgccagagacatcagaaaccagagaagatacagacagagaagaaaggccgagctggtgaagctgcagcagacctacgccgccctgaacagcaaggccaccttctacggcgagcaggtggactactacaagagctacatcaagacctgcctggacaacctggccagcaagggcaaggtgagcaagaagcccagagagatgaagggcaagaagagcaagaagatcagcctgaagtacaccgccgccagactgcacgagaagggcgtgctgctggagatcgaggacctgcaggtgaaccagttcaagaacgtgatcttcgagatcagccccaccgaggaggtgggcgacttcgaggtgaaggccaagttcatgggcgtgcagatggagaccttcatgctgcactaccaggacctgctgcagctgcagtacgagggcgtggccgtgatgaagctgttcgacagagccaaggtgaacgtgaacctgctgatcttcctgctgaacaagaagttctacggcaagtag

SEQ ID NO: 85783 - DNA, 4728 bp, Artificial Sequence
  Description of Artificial Sequence: Synthetic coding sequence
atgccccacgaggagctgcccagcctgcagagacccagatacggcagcatcgtggacgacgagagactgagcgccgaggagatggacgagagaagaagacagaacatcgcctacgagtacctgtgccacctggaggaggccaagagatggatggaggtgtgcctggtggaggagctgccccccaccaccgagctggaggagggcctgagaaacggcgtgtacctggccaagctggccaagttcttcgcccccaagatggtgagcgagaagaagatctacgacgtggagcagaccagatacaagaagagcggcctgcacttcagacacaccgacaacaccgtgcagtggctgagagccatggagagcatcggcctgcccaagatcttctaccccgagaccaccgacgtgtacgacagaaagaacatccccagaatgatctactgcatccacgccctgagcctgtacctgttcaagctgggcatcgccccccagatccaggacctgctgggcaaggtggacttcaccgaggaggagatcagcaacatgagaaaggagctggagaagtacggcatccagatgcccagcttcagcaagatcggcggcatcctggccaacgagctgagcgtggacgaggccgccctgcacgccgccgtgatcgccatcaacgaggccgtggagaagggcatcgccgagcagaccgtggtgaccctgagaaaccccaacgccgtgctgaccctggtggacgacaacctggcccccgagtaccagaaggagctgtgggacgccaagaagaagaaggaggagaacgccagactgaagaacagctgcatcagcgaggaggagagagacgcctacgaggagctgctgacccaggccgagatccagggcaacatcaacaaggtgaacagacaggccgccgtggaccacatcaacgccgtgatccccgagggcgaccccgagaacaccctgctggccctgaagaagcccgaggcccagctgcccgccgtgtaccccttcgccgccgccatgtaccagaacgagctgttcaacctgcagaagcagaacaccatgaactacctggcccacgaggagctgctgatcgccgtggagatgctgagcgccgtggccctgctgaaccaggccctggagagcaacgacctggtgagcgtgcagaaccagctgagaagccccgccatcggcctgaacaacctggacaaggcctacgtggagagatacgccaacaccctgctgagcgtgaagctggaggtgctgagccagggccaggacaacctgagctggaacgagatccagaactgcatcgacatggtgaacgcccagatccaggaggagaacgacagagtggtggccgtgggctacatcaacgaggccatcgacgagggcaaccccctgagaaccctggagaccctgctgctgcccaccgccaacatcagcgacgtggaccccgcccacgcccagcactaccaggacgtgctgtaccacgccaagagccagaagctgggcgacagcgagagcgtgagcaaggtgctgtggctggacgagatccagcaggccgtggacgacgccaacgtggacaaggacagagccaagcagtgggtgaccctggtggtggacgtgaaccagtgcctggagggcaagaagagcagcgacatcctgagcgtgctgaagagcagcaccagcaacgccaacgacatcatccccgagtgcgccgacaagtactacgacgccctggtgaaggccaaggagctgaagagcgagagagtgagcagcgacggcagctggctgaagctgaacctgcacaagaagtacgactactactacaacaccgacagcaaggagagcagctgggtgacccccgagagctgcctgtacaaggagagctggctgaccggcaaggagatcgaggacatcatcgaggaggtgaccgtgggctacatcagagagaacatctggagcgccagcgaggagctgctgctgagattccaggccaccagcagcggccccatcctgagagaggagttcgaggccagaaagagcttcctgcacgagcaggaggagaacgtggtgaagatccaggccttctggaagggctacaagcagagaaaggagtacatgcacagaagacagaccttcatcgacaacaccgacagcatcgtgaagatccagagctggttcagaatggccaccgccagaaagagctacctgagcagactgcagtacttcagagaccacaacaacgagatcgtgaagatccagagcctgctgagagccaacaaggccagagacgactacaagaccctggtgggcagcgagaacccccccctgaccgtgatcagaaagttcgtgtacctgctggaccagagcgacctggacttccaggaggagctggaggtggccagactgagagaggaggtggtgaccaagatcagagccaaccagcagctggagaaggacctgaacctgatggacatcaagatcggcctgctggtgaagaacagaatcaccctggaggacgtgatcagccacagcaagaagctgaacaagaagaagggcggcgagatggagatcctgaacaacaccgacaaccagggcatcaagagcctgagcaaggagagaagaaagaccctggagacctaccagcagctgttctacctgctgcagaccaaccccctgtacctggccaagctgatcttccagatgccccagaacaagagcaccaagttcatggacaccgtgatcttcaccctgtacaactacgccagcaaccagagagaggagtacctgctgctgaagctgttcaagaccgccctggaggaggagatcaagagcaaggtggaccaggtgcaggacatcgtgaccggcaaccccaccgtgatcaagatggtggtgagcttcaacagaggcgccagaggccagaacaccctgagacagctgctggcccccgtggtgaaggagatcatcgacgacaagagcctgatcatcaacaccaaccccgtggaggtgtacaaggcctgggtgaaccagctggagacccagaccggcgaggccagcaagctgccctacgacgtgaccaccgagcaggccctgacctaccccgaggtgaagaacaagctggaggccagcatcgagaacctgagaagagtgaccgacaaggtgctgaacagcatcatcagcagcctggacctgctgccctacggcctgagatacatcgccaaggtgctgaagaacagcatccacgagaagttccccgacgccaccgaggacgagctgctgaagatcgtgggcaacctgctgtactacagatacatgaaccccgccatcgtggcccccgacggcttcgacatcatcgacatgaccgccggcggccagatcaacagcgaccagagaagaaacctgggcagcgtggccaaggtgctgcagcacgccgccagcaacaagctgttcgagggcgagaacgagcacctgagcagcatgaacaactacctgagcgagacctaccaggagttcagaaagtacttcaaggaggcctgcaacgtgcccgagcccgaggagaagttcaacatggacaagtacaccgacctggtgaccgtgagcaagcccgtgatctacatcagcatcgaggagatcatcagcacccacagcctgctgctggagcaccaggacgccatcgcccccgagaagaacgacctgctgagcgagctgctgggcagcctgggcgaggtgcccaccgtggagagcttcctgggcgagggcgccgtggaccccaacgaccccaacaaggccaacaccctgagccagctgagcaagaccgagatcagcctggtgctgaccagcaagtacgacatcgaggacggcgaggccatcgacagcagaagcctgatgatcaagaccaagaagctgatcatcgacgtgatcagaaaccagcccggcaacaccctgaccgagatcctggagacccccgccaccgcccagcaggaggtggaccacgccaccgacatggtgagcagagccatgatcgacagcagaacccccgaggagatgaagcacagccagagcatgatcgaggacgcccagctgcccctggagcagaagaagagaaagatccagagaaacctgagaaccctggagcagaccggccacgtgagcagcgagaacaagtaccaggacatcctgaacgagatcgccaaggacatcagaaaccagagaatctacagaaagctgagaaaggccgagctggccaagctgcagcagaccctgaacgccctgaacaagaaggccgccttctacgaggagcagatcaactactacgacacctacatcaagacctgcctggacaacctgaagagaaagaacaccagaagaagcatcaagctggacggcaagggcgagcccaagggcgccaagagagccaagcccgtgaagtacaccgccgccaagctgcacgagaagggcgtgctgctggacatcgacgacctgcagaccaaccagttcaagaacgtgaccttcgacatcatcgccaccgaggacgtgggcatcttcgacgtgagaagcaagttcctgggcgtggagatggagaaggtgcagctgaacatccaggacctgctgcagatgcagtacgagggcgtggccgtgatgaagatgttcgacaaggtgaaggtgaacgtgaacctgctgatctacctgctgaacaagaagttctacggcaagtag

SEQ ID NO: 85784 - DNA, 3234 bp, Artificial Sequence
  Description of Artificial Sequence: Synthetic coding sequence
atggtgaacgcccagatccaggaggagaacgacagagtggtggccgtgggctacatcaacgaggccatcgacgagggcaaccccctgagaaccctggagaccctgctgctgcccaccgccaacatcagcgacgtggaccccgcccacgcccagcactaccaggacgtgctgtaccacgccaagagccagaagctgggcgacagcgagagcgtgagcaaggtgctgtggctggacgagatccagcaggccgtggacgacgccaacgtggacaaggacagagccaagcagtgggtgaccctggtggtggacgtgaaccagtgcctggagggcaagaagagcagcgacatcctgagcgtgctgaagagcagcaccagcaacgccaacgacatcatccccgagtgcgccgacaagtactacgacgccctggtgaaggccaaggagctgaagagcgagagagtgagcagcgacggcagctggctgaagctgaacctgcacaagaagtacgactactactacaacaccgacagcaaggagagcagctgggtgacccccgagagctgcctgtacaaggagagctggctgaccggcaaggagatcgaggccttctggaagggctacaagcagagaaaggagtacatgcacagaagacagaccttcatcgacaacaccgacagcatcgtgaagatccagagctggttcagaatggccaccgccagaaagagctacctgagcagactgcagtacttcagagaccacaacaacgagatcgtgaagatccagagcctgctgagagccaacaaggccagagacgactacaagaccctggtgggcagcgagaacccccccctgaccgtgatcagaaagttcgtgtacctgctggaccagagcgacctggacttccaggaggagctggaggtggccagactgagagaggaggtggtgaccaagatcagagccaaccagcagctggagaaggacctgaacctgatggacatcaagatcggcctgctggtgaagaacagaatcaccctggaggacgtgatcagccacagcaagaagctgaacaagaagaagggcggcgagatggagatcctgaacaacaccgacaaccagggcatcaagagcctgagcaaggagagaagaaagaccctggagacctaccagcagctgttctacctgctgcagaccaaccccctgtacctggccaagctgatcttccagatgccccagaacaagagcaccaagttcatggacaccgtgatcttcaccctgtacaactacgccagcaaccagagagaggagtacctgctgctgaagctgttcaagaccgccctggaggaggagatcaagagcaaggtggaccaggtgcaggacatcgtgaccggcaaccccaccgtgatcaagatggtggtgagcttcaacagaggcgccagaggccagaacaccctgagacagctgctggcccccgtggtgaaggagatcatcgacgacaagagcctgatcatcaacaccaaccccgtggaggtgtacaaggcctgggtgaaccagctggagacccagaccggcgaggccagcaagctgccctacgacgtgaccaccgagcaggccctgacctaccccgaggtgaagaacaagctggaggccagcatcgagaacctgagaagagtgaccgacaaggtgctgaacagcatcatcagcagcctggacctgctgccctacggcctgagatacatcgccaaggtgctgaagaacagcatccacgagaagttccccgacgccaccgaggacgagctgctgaagatcgtgggcaacctgctgtactacagatacatgaaccccgccatcgtggcccccgacggcttcgacatcatcgacatgaccgccggcggccagatcaacagcgaccagagaagaaacctgggcagcgtggccaaggtgctgcagcacgccgccagcaacaagctgttcgagggcgagaacgagcacctgagcagcatgaacaactacctgagcgagacctaccaggagttcagaaagtacttcaaggaggcctgcaacgtgcccgagcccgaggagaagttcaacatggacaagtacaccgacctggtgaccgtgagcaagcccgtgatctacatcagcatcgaggagatcatcagcacccacagcctgctgctggagcaccaggacgccatcgcccccgagaagaacgacctgctgagcgagctgctgggcagcctgggcgaggtgcccaccgtggagagcttcctgggcgagggcgccgtggaccccaacgaccccaacaaggccaacaccctgagccagctgagcaagaccgagatcagcctggtgctgaccagcaagtacgacatcgaggacggcgaggccatcgacagcagaagcctgatgatcaagaccaagaagctgatcatcgacgtgatcagaaaccagcccggcaacaccctgaccgagatcctggagacccccgccaccgcccagcaggaggtggaccacgccaccgacatggtgagcagagccatgatcgacagcagaacccccgaggagatgaagcacagccagagcatgatcgaggacgcccagctgcccctggagcagaagaagagaaagatccagagaaacctgagaaccctggagcagaccggccacgtgagcagcgagaacaagtaccaggacatcctgaacgagatcgccaaggacatcagaaaccagagaatctacagaaagctgagaaaggccgagctggccaagctgcagcagaccctgaacgccctgaacaagaaggccgccttctacgaggagcagatcaactactacgacacctacatcaagacctgcctggacaacctgaagagaaagaacaccagaagaagcatcaagctggacggcaagggcgagcccaagggcgccaagagagccaagcccgtgaagtacaccgccgccaagctgcacgagaagggcgtgctgctggacatcgacgacctgcagaccaaccagttcaagaacgtgaccttcgacatcatcgccaccgaggacgtgggcatcttcgacgtgagaagcaagttcctgggcgtggagatggagaaggtgcagctgaacatccaggacctgctgcagatgcagtacgagggcgtggccgtgatgaagatgttcgacaaggtgaaggtgaacgtgaacctgctgatctacctgctgaacaagaagttctacggcaagtag

SEQ ID NO: 85785 - DNA, 3216 bp, Artificial Sequence
  Description of Artificial Sequence: Synthetic coding sequence
atgcacagcctgcccggcgtggtggccgtgggctacatcaacgaggccatcgacgagggcaaccccctgagaaccctggagaccctgctgctgcccaccgccaacatcagcgacgtggaccccgcccacgcccagcactaccaggacgtgctgtaccacgccaagagccagaagctgggcgacagcgagagcgtgagcaaggtgctgtggctggacgagatccagcaggccgtggacgacgccaacgtggacaaggacagagccaagcagtgggtgaccctggtggtggacgtgaaccagtgcctggagggcaagaagagcagcgacatcctgagcgtgctgaagagcagcaccagcaacgccaacgacatcatccccgagtgcgccgacaagtactacgacgccctggtgaaggccaaggagctgaagagcgagagagtgagcagcgacggcagctggctgaagctgaacctgcacaagaagtacgactactactacaacaccgacagcaaggagagcagctgggtgacccccgagagctgcctgtacaaggagagctggctgaccggcaaggagatcgaggccttctggaagggctacaagcagagaaaggagtacatgcacagaagacagaccttcatcgacaacaccgacagcatcgtgaagatccagagctggttcagaatggccaccgccagaaagagctacctgagcagactgcagtacttcagagaccacaacaacgagatcgtgaagatccagagcctgctgagagccaacaaggccagagacgactacaagaccctggtgggcagcgagaacccccccctgaccgtgatcagaaagttcgtgtacctgctggaccagagcgacctggacttccaggaggagctggaggtggccagactgagagaggaggtggtgaccaagatcagagccaaccagcagctggagaaggacctgaacctgatggacatcaagatcggcctgctggtgaagaacagaatcaccctggaggacgtgatcagccacagcaagaagctgaacaagaagaagggcggcgagatggagatcctgaacaacaccgacaaccagggcatcaagagcctgagcaaggagagaagaaagaccctggagacctaccagcagctgttctacctgctgcagaccaaccccctgtacctggccaagctgatcttccagatgccccagaacaagagcaccaagttcatggacaccgtgatcttcaccctgtacaactacgccagcaaccagagagaggagtacctgctgctgaagctgttcaagaccgccctggaggaggagatcaagagcaaggtggaccaggtgcaggacatcgtgaccggcaaccccaccgtgatcaagatggtggtgagcttcaacagaggcgccagaggccagaacaccctgagacagctgctggcccccgtggtgaaggagatcatcgacgacaagagcctgatcatcaacaccaaccccgtggaggtgtacaaggcctgggtgaaccagctggagacccagaccggcgaggccagcaagctgccctacgacgtgaccaccgagcaggccctgacctaccccgaggtgaagaacaagctggaggccagcatcgagaacctgagaagagtgaccgacaaggtgctgaacagcatcatcagcagcctggacctgctgccctacggcctgagatacatcgccaaggtgctgaagaacagcatccacgagaagttccccgacgccaccgaggacgagctgctgaagatcgtgggcaacctgctgtactacagatacatgaaccccgccatcgtggcccccgacggcttcgacatcatcgacatgaccgccggcggccagatcaacagcgaccagagaagaaacctgggcagcgtggccaaggtgctgcagcacgccgccagcaacaagctgttcgagggcgagaacgagcacctgagcagcatgaacaactacctgagcgagacctaccaggagttcagaaagtacttcaaggaggcctgcaacgtgcccgagcccgaggagaagttcaacatggacaagtacaccgacctggtgaccgtgagcaagcccgtgatctacatcagcatcgaggagatcatcagcacccacagcctgctgctggagcaccaggacgccatcgcccccgagaagaacgacctgctgagcgagctgctgggcagcctgggcgaggtgcccaccgtggagagcttcctgggcgagggcgccgtggaccccaacgaccccaacaaggccaacaccctgagccagctgagcaagaccgagatcagcctggtgctgaccagcaagtacgacatcgaggacggcgaggccatcgacagcagaagcctgatgatcaagaccaagaagctgatcatcgacgtgatcagaaaccagcccggcaacaccctgaccgagatcctggagacccccgccaccgcccagcaggaggtggaccacgccaccgacatggtgagcagagccatgatcgacagcagaacccccgaggagatgaagcacagccagagcatgatcgaggacgcccagctgcccctggagcagaagaagagaaagatccagagaaacctgagaaccctggagcagaccggccacgtgagcagcgagaacaagtaccaggacatcctgaacgagatcgccaaggacatcagaaaccagagaatctacagaaagctgagaaaggccgagctggccaagctgcagcagaccctgaacgccctgaacaagaaggccgccttctacgaggagcagatcaactactacgacacctacatcaagacctgcctggacaacctgaagagaaagaacaccagaagaagcatcaagctggacggcaagggcgagcccaagggcgccaagagagccaagcccgtgaagtacaccgccgccaagctgcacgagaagggcgtgctgctggacatcgacgacctgcagaccaaccagttcaagaacgtgaccttcgacatcatcgccaccgaggacgtgggcatcttcgacgtgagaagcaagttcctgggcgtggagatggagaaggtgcagctgaacatccaggacctgctgcagatgcagtacgagggcgtggccgtgatgaagatgttcgacaaggtgaaggtgaacgtgaacctgctgatctacctgctgaacaagaagttctacggcaagtag

SEQ ID NO: 85786 - DNA, 1134 bp, Artificial Sequence
  Description of Artificial Sequence: Synthetic coding sequence
atgggctgcttcaagggcgtggtggccgtgggctacatcaacgaggccatcgacgagggcaaccccctgagaaccctggagaccctgctgctgcccaccgccaacatcagcgacgtggaccccgcccacgcccagcactaccaggacgtgctgtaccacgccaagagccagaagctgggcgacagcgagagcgtgagcaaggtgctgtggctggacgagatccagcaggccgtggacgacgccaacgtggacaaggacagagccaagcagtgggtgaccctggtggtggacgtgaaccagtgcctggagggcaagaagagcagcgacatcctgagcgtgctgaagagcagcaccagcaacgccaacgacatcatccccgagtgcgccgacaagtactacgacgccctggtgaaggccaaggagctgaagagcgagagagtgagcagcgacggcagctggctgaagctgaacctgcacaagaagtacgactactactacaacaccgacagcaaggagagcagctgggtgacccccgagagctgcctgtacaaggagagctggctgaccggcaaggagatcgaggacatcatcgaggaggtgaccgtgggctacatcagagagaacatctggagcgccagcgaggagctgctgctgagattccaggccaccagcagcggccccatcctgagagaggagttcgaggccagaaagagcttcctgcacgagcaggaggagaacgtggtgaagatccaggccttctggaagggctacaagcagagaaaggagtacatgcacagaagacagaccttcatcgacaacaccgacagcatcgtgaagatccagagctggttcagaatggccaccgccagaaagagctacctgagcagactgcagtacttcagagaccacaacaacgagatcgtgaagatccagagcctgctgagagccaacaaggccagagacgactacaagaccctggtgggcagcgagaacccccccctgaccgtgatcagaaagttcgtgtacctgctggaccagagcgacctggacttccaggaggagctggaggtggccagactgagagaggaggtggtgaccaagatcagagccaaccagcagctggagaagacctag

SEQ ID NO: 85787 - DNA, 3084 bp, Artificial Sequence
  Description of Artificial Sequence: Synthetic coding sequence
atggcccagaacaccgagaaccacgaccccgtgggcagcatcctgatccagatccacgaggacctgtaccagctgaaggagaagctgaccaagttcagccccgaggagaagggcgagaccctggacatccagagcctggagaccgccatcaagagaaccgaggtgggcctgagaatccacatcgagaagtacctgaacgtggtgaaccagaacgtgctgaccaccagcgtgaacgacgagagcctgtacaccccccaggccagcaagtggctgctgcccaccgtgatcgaccagaagagcttcatcttcccccaggagagcgagggcaccttctggcagccccagagacagcacagcagcagcctgcccgtgttccccagagccaagatcaaggtgagcaagctgatcaagggcagcaacatcagcagcctgaccgtgctgcccagcagccactgcaccgacccctacttcacccccatccccgtgctgcaggccgacgcccacaagggcatcctgagcatgatcgagagaggcctgatcccccccaccgccagaatcaccttccagaacccccccatcacccccagagccgcccccctgcacagcttcgacgaggccagaaagatccccaccgtggccaccttcaccatccccagagagcccccccccagccccgccgaggtgaagttcttccccaagaagcagagaagcaagggcaagagcagaagaagcagaggccaccacgacagaaaggccatgaaggtgaagacccccctgagagccctgaagagcctgtgggactacgacttcctgatctacgacggcgtgatcgacaacaccgcccccgacttcctggccttcaaggagcacttcagcctggcctggggcggcatcttcagcctgctggagcacgtggagaagttcctgagaaactacgccatccccgaggtgaagatcaagggcaacaacctggtggccctgctgcccgagttcgagctgaccaacaagctgaccagatacgacctgctgagcgtgctggaggaccccgcccacgtgcagatgctgatcaacctgcccggccagagatacaagggccaggacggcaacagcgaggccgccatgaagatccaggccacctggaagtgctacaaggccagaaagttcttcctgttctacagacagcagaagtgggccagcggcgtgatcgccatcgcctggctgctgtactgccacaagaccagactgaagaagatcctgaaggagagcagacagagacacctggagaacttcagaatcagagccaagcacctggccgccaactggaacagaatcagaaccagcagaagaaccatcatccacatccccagcctgggctacagccagcccgtgagagagcacatcgccgacttcaacacccagcagaacatgcagctgggcagactgtgcgacatcctggacgccaacgtgaacgtgatctacatctgcagccaccacatgaacgacgagctggtgctgtactacaagaagatcctgagcctgcacgccgccgtgaagagcggcaacctggaggacagaagcgacctgcaggacagattcaagatcatcacccccgaggccgtgaacatcttccccaagcaccacatgtgcctggccacccacctgatgtacagccccaaggccatcaagagaatcaagaacctgatcagaggcaccgaggcctacatcgtgagcggcctgctgcacagagacgacctggccgtggccgacatgctggacatccccatcctgggcagcgagcccgagctggcccacctgtacagcaccaagagcggcggcaagagagtgttcgacagcgccaacgtggccgtgccccccggcatctacgacatctacagccagcagcagatgatcgagcagctgagccagctgatcaccgaccacctgcagatccagagatggctgttcaagatggacagcgagttcagaggcaacggcaccgccttctgcgacatccccagctacctgaagtgctacaagtgggtgctgaaggagagcagcagatacggcctggaggactggagaaagaagtgggcccaggagcccgccctggtgaagatcagcgaggagctggccggcatcctggcccagcacgcccagcccgtgaacgagaagagattccccacctggagaaagttcctgcagaccttcctgagccagggcggcgtgatcgaggccttcccccccgccgacaacgtgaccaacctgaccgtggacatgctgatcgagcccaacggcaagatcagcgtgctgagcaccggcgaccagctgcacgccgagagccccttcatcagcagcggcaccaccgtgccccagaccagcgtggacccccaggtgctgacctacctgtgcctgcagatcggcaaggcctgcagaatgagagacgtggtgggctacttcagcatcgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccagattcgtgcccaaggagagaaagaagaccaagtgcatgagcgccctgagcatgcccatgctggccaccagcagatacgccgtgatgaccacccagctgagacacagcaacctgagcctggtgttccactacgtgttcctgcagatctgcagagcccacggcatcggctacgacgtggaggagagacagggcaccgtgttcatcctgtacgagcacctgaagagacacaagctgggcatgctgaccatcggcgaggacctgcagggcgtgctgatgaccttcgccagacacctgttcatcatccaccaggagatcagcgcccccaacatgcagggcgagaccaacttcaagaccaccatcgccgacatcgagaccatcctgagagtgaccaaggagaacaagatgagattcgaggaggagcagcagagcaaggacgacaagaacctgagcaagcccaagaagtag

SEQ ID NO: 85788 - DNA, 2091 bp, Artificial Sequence
  Description of Artificial Sequence: Synthetic coding sequence
atgatcgagagaggcctgatcccccccaccgccagaatcaccttccagaacccccccatcacccccagagccgcccccctgcacagcttcgacgaggccagaaagatccccaccgtggccaccttcaccatccccagagagcccccccccagccccgccgaggtgaagttcttccccaagaagcagagaagcaagggcaagagcagaagaagcagaggccaccacgacagaaaggccatgaaggtgaagacccccctgagagccctgaagagcctgtgggactacgacttcctgatctacgacggcgtgatcgacaacaccgcccccgacttcctggccttcaaggagcacttcagcctggcctggggcggcatcttcagcctgctggagcacgtggagaagttcctgagaaactacgccatccccgaggtgaagatcaagggcaacaacctggtggccctgctgcccgagttcgagctgaccaacaagctgaccagatacgacctgctgagcgtgctggaggaccccgcccacgtgcagatgctgatcaacctgcccggccagagatacaagggccaggacggcaacagcgaggccgccatgaagatccaggccacctggaagtgctacaaggccagaaagttcttcctgttctacagacagcagaagtgggccagcggcgtgatcgccatcgcctggctgctgtactgccacaagaccagactgaagaagatcctgaaggagagcagacagagacacctggagaacttcagaatcagagccaagcacctggccgccaactggaacagaatcagaaccagcagaagaaccatcatccacatccccagcctgggctacagccagcccgtgagagagcacatcgccgacttcaacacccagcagaacatgcagctgggcagactgtgcgacatcctggacgccaacgtgaacgtgatctacatctgcagccaccacatgaacgacgagctggtgctgtactacaagaagatcctgagcctgcacgccgccgtgaagagcggcaacctggaggacagaagcgacctgcaggacagattcaagatcatcacccccgaggccgtgaacatcttccccatgatcgagcagctgagccagctgatcaccgaccacctgcagatccagagatggctgttcaagatggacagcgagttcagaggcaacggcaccgccttctgcgacatccccagctacctgaagtgctacaagtgggtgctgaaggagagcagcagatacggcctggaggactggagaaagaagtgggcccaggagcccgccctggtgaagatcagcgaggagctggccggcatcctggcccagcacgcccagcccgtgaacgagaagagattccccacctggagaaagttcctgcagaccttcctgagccagggcggcgtgatcgaggccttcccccccgccgacaacgtgaccaacctgaccgtggacatgctgatcgagcccaacggcaagatcagcgtgctgagcaccggcgaccagctgcacgccgagagccccttcatcagcagcggcaccaccgtgccccagaccagcgtggacccccaggtgctgacctacctgtgcctgcagatcggcaaggcctgcagaatgagagacgtggtgggctacttcagcatcgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccagattcgtgcccaaggagagaaagaagaccaagtgcatgagcgccctgagcatgcccatgctggccaccagcagatacgccgtgatgaccacccagctgagacacagcaacctgagcctggtgttccactacgtgttcctgcagatctgcagagcccacggcatcggctacgacgtggagaacaacagaagaggcagccccggcggcccccacgacctgtgcagccccagcctgcaccaccccagcagaaacatcagcacctag

SEQ ID NO: 85789 - DNA, 1866 bp, Artificial Sequence
  Description of Artificial Sequence: Synthetic coding sequence
atgaccaaggccatgaaggtgaagacccccctgagagccctgaagagcctgtgggactacgacttcctgatctacgacggcgtgatcgacaacaccgcccccgacttcctggccttcaaggagcacttcagcctggcctggggcggcatcttcagcctgctggagcacgtggagaagttcctgagaaactacgccatccccgaggtgaagatcaagggcaacaacctggtggccctgctgcccgagttcgagctgaccaacaagctgaccagatacgacctgctgagcgtgctggaggaccccgcccacgtgcagatgctgatcaacctgcccggccagagatacaagggccaggacggcaacagcgaggccgccatgaagatccaggccacctggaagtgctacaaggccagaaagttcttcctgttctacagacagcagaagtgggccagcggcgtgatcgccatcgcctggctgctgtactgccacaagaccagactgaagaagatcctgaaggagagcagacagagacacctggagaacttcagaatcagagccaagcacctggccgccaactggaacagaatcagaaccagcagaagaaccatcatccacatccccagcctgggctacagccagcccgtgagagagcacatcgccgacttcaacacccagcagaacatgcagctgggcagactgtgcgacatcctggacgccaacgtgaacgtgatctacatctgcagccaccacatgaacgacgagctggtgctgtactacaagaagatcctgagcctgcacgccgccgtgaagagcggcaacctggaggacagaagcgacctgcaggacagattcaagatcatcacccccgaggccgtgaacatcttccccatgatcgagcagctgagccagctgatcaccgaccacctgcagatccagagatggctgttcaagatggacagcgagttcagaggcaacggcaccgccttctgcgacatccccagctacctgaagtgctacaagtgggtgctgaaggagagcagcagatacggcctggaggactggagaaagaagtgggcccaggagcccgccctggtgaagatcagcgaggagctggccggcatcctggcccagcacgcccagcccgtgaacgagaagagattccccacctggagaaagttcctgcagaccttcctgagccagggcggcgtgatcgaggccttcccccccgccgacaacgtgaccaacctgaccgtggacatgctgatcgagcccaacggcaagatcagcgtgctgagcaccggcgaccagctgcacgccgagagccccttcatcagcagcggcaccaccgtgccccagaccagcgtggacccccaggtgctgacctacctgtgcctgcagatcggcaaggcctgcagaatgagagacgtggtgggctacttcagcatcgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccagattcgtgcccaaggagagaaagaagaccaagtgcatgagcgccctgagcatgcccatgctggccaccagcagatacgccgtgatgaccacccagctgagacacagcaacctgagcctggtgttccactacgtgttcctgcagatctgcagagcccacggcatcggctacgacgtggagaacaacagaagaggcagccccggcggcccccacgacctgtgcagccccagcctgcaccaccccagcagaaacatcagcacctag

SEQ ID NO: 85790 - DNA, 2055 bp, Artificial Sequence
  Description of Artificial Sequence: Synthetic coding sequence
atgaaggtgaagacccccctgagagccctgaagagcctgtgggactacgacttcctgatctacgacggcgtgatcgacaacaccgcccccgacttcctggccttcaaggagcacttcagcctggcctggggcggcatcttcagcctgctggagcacgtggagaagttcctgagaaactacgccatccccgaggtgaagatcaagggcaacaacctggtggccctgctgcccgagttcgagctgaccaacaagctgaccagatacgacctgctgagcgtgctggaggaccccgcccacgtgcagatgctgatcaacctgcccggccagagatacaagggccaggacggcaacagcgaggccgccatgaagatccaggccacctggaagtgctacaaggccagaaagttcttcctgttctacagacagcagaagtgggccagcggcgtgatcgccatcgcctggctgctgtactgccacaagaccagactgaagaagatcctgaaggagagcagacagagacacctggagaacttcagaatcagagccaagcacctggccgccaactggaacagaatcagaaccagcagaagaaccatcatccacatccccagcctgggctacagccagcccgtgagagagcacatcgccgacttcaacacccagcagaacatgcagctgggcagactgtgcgacatcctggacgccaacgtgaacgtgatctacatctgcagccaccacatgaacgacgagctggtgctgtactacaagaagatcctgagcctgcacgccgccgtgaagagcggcaacctggaggacagaagcgacctgcaggacagattcaagatcatcacccccgaggccgtgaacatcttccccatgatcgagcagctgagccagctgatcaccgaccacctgcagatccagagatggctgttcaagatggacagcgagttcagaggcaacggcaccgccttctgcgacatccccagctacctgaagtgctacaagtgggtgctgaaggagagcagcagatacggcctggaggactggagaaagaagtgggcccaggagcccgccctggtgaagatcagcgaggagctggccggcatcctggcccagcacgcccagcccgtgaacgagaagagattccccacctggagaaagttcctgcagaccttcctgagccagggcggcgtgatcgaggccttcccccccgccgacaacgtgaccaacctgaccgtggacatgctgatcgagcccaacggcaagatcagcgtgctgagcaccggcgaccagctgcacgccgagagccccttcatcagcagcggcaccaccgtgccccagaccagcgtggacccccaggtgctgacctacctgtgcctgcagatcggcaaggcctgcagaatgagagacgtggtgggctacttcagcatcgacctggtgaccttcatcgaccccagcaccctggagcagcaggtgtgggccaccggcctgaacctggcctacagcgaccagctggccctgacccagctgaccctgtacctgaccaacggccacctggactgcagcctgagcaccctggaggtgcccagattcgtgcccaaggagagaaagaagaccaagtgcatgagcgccctgagcatgcccatgctggccaccagcagatacgccgtgatgaccacccagctgagacacagcaacctgagcctggtgttccactacgtgttcctgcagatctgcagagcccacggcatcggctacgacgtggaggagagacagggcaccgtgttcatcctgtacgagcacctgaagagacacaagctgggcatgctgaccatcggcgaggacctgcagggcgtgctgatgaccttcgccagacacctgttcatcatccaccaggagatcagcgcccccaacatgcagggcgagaccaacttcaagaccaccatcgccgacatcgagaccatcctgagagtgaccaaggagaacaagatgagattcgaggaggagcagcagagcaaggacgacaagaacctgagcaagcccaagaagtag

SEQ ID NO: 85791 - DNA, 507 bp, Artificial Sequence
  Description of Artificial Sequence: Synthetic coding sequence
atggcccagaacaccgagaaccacgaccccgtgggcagcatcctgatccagatccacgaggacctgtaccagctgaaggagaagctgaccaagttcagccccgaggagaagggcgagaccctggacatccagagcctggagaccgccatcaagagaaccgaggtgggcctgagaatccacatcgagaagtacctgaacgtggtgaaccagaacgtgctgaccaccagcgtgaacgacgagagcctgtacaccccccaggccagcaagtggctgctgcccaccgtgatcgaccagaagagcttcatcttcccccaggagagcgagggcaccttctggcagccccagagacagcacagcagcagcctgcccgtgttccccagagccaagagaaagatcggcctgaacgtgaagatcctgcaggaccccgagaacatccaccacagagccgccgtgaacgccaactacggcatcagcctgccctacatcaaccagagaaaggcctgctag

SEQ ID NO: 85792 - DNA, 339 bp, Artificial Sequence
  Description of Artificial Sequence: Synthetic coding sequence
atgagactggaggagctgaagagactgcagaaccccctggagcaggtgaacgacggcaagtacagcttcgagaaccaccagctggccatggacgccgagaacaacatcgagaagtaccccctgaacctgcagcccctggagagcaaggtgaagatcatccagagagcctggagagagtacctgcagagacaggagcccctgggcaagagaagccccagcccccccagcgtgagcagcgagaagctgagcagcagcgtgagcatgaacaccttcagcgacagcagcacccccgtgagcgtgatgttcctgttcctgtgccccgacctgaccttcaactag

SEQ ID NO: 85793 - DNA, 480 bp, Artificial Sequence
  Description of Artificial Sequence: Synthetic coding sequence
atgagactggaggagctgaagagactgcagaaccccctggagcaggtgaacgacggcaagtacagcttcgagaaccaccagctggccatggacgccgagaacaacatcgagaagtaccccctgaacctgcagcccctggagagcaaggtgaagatcatccagagagcctggagagagtacctgcagagacaggagcccctgggcaagagaagccccagcccccccagcgtgagcagcgagaagctgagcagcagcgtgagcatgaacaccttcagcgacagcagcacccccttcgccagagcccccgtgggcaagatccacccctacatcagctggagactgcagagccccggcgacaagctgcccggcggcagaaaggtgatcctgctgtacctggaccagctggccagacccaccggcttcatccacaccctgaaggagccccagatcgagagactgggcttcctgaccctgcagtag

SEQ ID NO: 85794 - DNA, 399 bp, Artificial Sequence
  Description of Artificial Sequence: Synthetic coding sequence
atgagactggaggagctgaagagactgcagaaccccctggagcaggtgaacgacggcaagtacagcttcgagaacatccagagagcctggagagagtacctgcagagacaggagcccctgggcaagagaagccccagcccccccagcgtgagcagcgagaagctgagcagcagcgtgagcatgaacaccttcagcgacagcagcacccccttcgccagagcccccgtgggcaagatccacccctacatcagctggagactgcagagccccggcgacaagctgcccggcggcagaaaggtgatcctgctgtacctggaccagctggccagacccaccggcttcatccacaccctgaaggagccccagatcgagagactgggcttcctgaccctgcagtag

SEQ ID NO: 85795 - DNA, 2892 bp, Artificial Sequence
  Description of Artificial Sequence: Synthetic coding sequence
atggacgcccccaaggccggctacgccttcgagtacctgatcgagaccctgaacgacagcagccacaagaagttcttcgacgtgagcaagctgggcaccaagtacgacgtgctgccctacagcatcagagtgctgctggaggccgccgtgagaaactgcgacggcttcctgatgaagaaggaggacgtgatgaacatcctggactggaagaccaagcagagcaacgtggaggtgcccttcttccccgccagagtgctgctgcaggacttcaccggcatccccgccatggtggacttcgccgccatgagagaggccgtgaagaccctgggcggcgaccccgagaaggtgcaccccgcctgccccaccgacctgaccgtggaccacagcctgcagatcgacttcagcaagtgcgccatccagaacgcccccaaccccggcggcggcgacctgcagaaggccggcaagctgagccccgtgaaggtgcagcccaagaagctgccctgcagaggccagaccacctgcagaggcagctgcgacagcggcgagctgggcagaaacagcggcaccttcagcagccagatcgagaacacccccatcctgtgccccttccacctgcagcccgtgcccgagcccgagaccgtgctgaagaaccaggaggtggagttcggcagaaacagagagagactgcagttcttcaagtggagcagcagagtgttcaagaacgtggccgtgatcccccccggcaccggcatggcccaccagatcaacctggagtacctgagcagagtggtgttcgaggagaaggacctgctgttccccgacagcgtggtgggcaccgacagccacatcaccatggtgaacggcctgggcatcctgggctggggcgtgggcggcatcgagaccgaggccgtgatgctgggcctgcccgtgagcctgaccctgcccgaggtggtgggctgcgagctgaccggcagcagcaaccccttcgtgaccagcatcgacgtggtgctgggcatcaccaagcacctgagacaggtgggcgtggccggcaagttcgtggagttcttcggcagcggcgtgagccagctgagcatcgtggacagaaccaccatcgccaacatgtgccccgagtacggcgccatcctgagcttcttccccgtggacaacgtgaccctgaagcacctggagcacaccggcttcagcaaggccaagctggagagcatggagacctacctgaaggccgtgaagctgttcagaaacgaccagaacagcagcggcgagcccgagtacagccaggtgatccagatcaacctgaacagcatcgtgcccagcgtgagcggccccaagagaccccaggacagagtggccgtgaccgacatgaagagcgacttccaggcctgcctgaacgagaaggtgggcttcaagggcttccagatcgccgccgagaagcagaaggacatcgtgagcatccactacgagggcagcgagtacaagctgagccacggcagcgtggtgatcgccgccgtgatcagctgcaccaacaactgcaaccccagcgtgatgctggccgccggcctgctggccaagaaggccgtggaggccggcctgagagtgaagccctacatcagaaccagcctgagccccggcagcggcatggtgacccactacctgagcagcagcggcgtgctgccctacctgagcaagctgggcttcgagatcgtgggctacggctgcagcatctgcgtgggcaacaccgcccccctgagcgacgccgtgctgaacgccgtgaagcagggcgacctggtgacctgcggcatcctgagcggcaacaagaacttcgagggcagactgtgcgactgcgtgagagccaactacctggccagcccccccctggtggtggcctacgccatcgccggcaccgtgaacatcgacttccagaccgagcccctgggcaccgaccccaccggcaagaacatctacctgcacgacatctggcccagcagagaggaggtgcacagagtggaggaggagcacgtgatcctgagcatgttcaaggccctgaaggacaagatcgagatgggcaacaagagatggaacagcctggaggcccccgacagcgtgctgttcccctgggacctgaagagcacctacatcagatgccccagcttcttcgacaagctgaccaaggagcccatcgccctgcaggccatcgagaacgcccacgtgctgctgtacctgggcgacagcgtgaccaccgaccacatcagccccgccggcagcatcgccagaaacagcgccgccgccaagtacctgaccaacagaggcctgacccccagagagttcaacagctacggcgccagaagaggcaacgacgccgtgatgaccagaggcaccttcgccaacatcaagctgttcaacaagttcatcggcaagcccgcccccaagaccatccacttccccagcggccagaccctggacgtgttcgaggccgccgagctgtaccagaaggagggcatccccctgatcatcctggccggcaagaagtacggcagcggcaacagcagagactgggccgccaagggcccctacctgctgggcgtgaaggccgtgctggccgagagctacgagaagatccacaaggaccacctgatcggcatcggcatcgcccccctgcagttcctgcccggcgagaacgccgacagcctgggcctgagcggcagagagaccttcagcctgaccttccccgaggagctgagccccggcatcaccctgaacatccagaccagcaccggcaaggtgttcagcgtgatcgccagcttcgaggacgacgtggagatcaccctgtacaagcacggcggcctgctgaacttcgtggccagaaagttcagctag

SEQ ID NO: 85796 - DNA, 96 bp, Artificial Sequence
  Description of Artificial Sequence: Synthetic coding sequence
atggactacgtggaggacaagctgagcagcgagttcgtgttcaacaaccccaacatcaagggcacctgcggctgcggcgagagcttcaacatctag

SEQ ID NO: 85797 - DNA, 261 bp, Artificial Sequence
  Description of Artificial Sequence: Synthetic coding sequence
atgagcgccagcctggtgagagccaccgtgagagccgtgagcaagagaaagctgcagcccaccagagccgccctgaccctgacccccagcgccgtgaacaagatcaagcagctgctgaaggacaagcccgagcacgtgggcgtgaaggtgggcgtgagaaccagaggctgcaacggcctgagctacaccctggagtacaccaagaccaagggcgacagcgacgaggaggtgatccaggacggctggagcgccgtggtgtag

SEQ ID NO: 85798 - DNA, 390 bp, Artificial Sequence
  Description of Artificial Sequence: Synthetic coding sequence
atgagcgccagcctggtgagagccaccgtgagagccgtgagcaagagaaagctgcagcccaccagagccgccctgaccctgacccccagcgccgtgaacaagatcaagcagctgctgaaggacaagcccgagcacgtgggcgtgaaggtgggcgtgagaaccagaggctgcaacggcctgagctacaccctggagtacaccaagaccaagggcgacagcgacgaggaggtgatccaggacggcgtgagagtgttcatcgagaagaaggcccagctgaccctgctgggcaccgagatggactacgtggaggacaagctgagcagcgagttcgtgttcaacaaccccaacatcaagggcacctgcggctgcggcgagagcttcaacatctag

SEQ ID NO: 85799 - DNA, 531 bp, Artificial Sequence
  Description of Artificial Sequence: Synthetic coding sequence
atggtggccgccggcggcggcgccagaaccgagggcgccgtgagaagaagcctgtggagacagtgcgccagaagagtgcacggcgagaagctgagaagacccaccttcggccccagacacagaggcgccggcaccgccaagatgagcgccagcctggtgagagccaccgtgagagccgtgagcaagagaaagctgcagcccaccagagccgccctgaccctgacccccagcgccgtgaacaagatcaagcagctgctgaaggacaagcccgagcacgtgggcgtgaaggtgggcgtgagaaccagaggctgcaacggcctgagctacaccctggagtacaccaagaccaagggcgacagcgacgaggaggtgatccaggacggcgtgagagtgttcatcgagaagaaggcccagctgaccctgctgggcaccgagatggactacgtggaggacaagctgagcagcgagttcgtgttcaacaaccccaacatcaagggcacctgcggctgcggcgagagcttcaacatctag

SEQ ID NO: 85800 - DNA, 504 bp, Artificial Sequence
  Description of Artificial Sequence: Synthetic coding sequence
atggccgccgccggcgccttcagactgagaagagccgccagcgccctgctgctgagaagccccagactgcccgccagagagctgagcgcccccgccagactgtaccacaagaaggtggtggaccactacgagaaccccagaaacgtgggcagcctggacaagaccagcaagaacgtgggcaccggcctggtgggcgcccccgcctgcggcgacgtgatgaagctgcagatccaggtggacgagaagggcaagatcgtggacgccagattcaagaccttcggctgcggcagcgccatcgccagcagcagcctggccaccgagtgggtgaagggcaagaccgtggaggaggccctgaccatcaagaacaccgacatcgccaaggagctgtgcctgccccccgtgaagctgcactgcagcatgctggccgaggacgccatcaaggccgccctggccgactacaagctgaagcaggagcccaagaagggcgaggccgagaagaagtag

SEQ ID NO: 85801 - DNA, 390 bp, Artificial Sequence
  Description of Artificial Sequence: Synthetic coding sequence
atggtgctgatcgacatgagcgtggacctgagcacccaggtggtggaccactacgagaaccccagaaacgtgggcagcctggacaagaccagcaagaacgtgggcaccggcctggtgggcgcccccgcctgcggcgacgtgatgaagctgcagatccaggtggacgagaagggcaagatcgtggacgccagattcaagaccttcggctgcggcagcgccatcgccagcagcagcctggccaccgagtgggtgaagggcaagaccgtggaggaggccctgaccatcaagaacaccgacatcgccaaggagctgtgcctgccccccgtgaagctgcactgcagcaagagcgtgctgttccccgccgaggagaagacccagctgagcccctag

SEQ ID NO: 85802 - DNA, 429 bp, Artificial Sequence
  Description of Artificial Sequence: Synthetic coding sequence
atggtgctgatcgacatgagcgtggacctgagcacccaggtggtggaccactacgagaaccccagaaacgtgggcagcctggacaagaccagcaagaacgtgggcaccggcctggtgggcgcccccgcctgcggcgacgtgatgaagctgcagatccaggtggacgagaagggcaagatcgtggacgccagattcaagaccttcggctgcggcagcgccatcgccagcagcagcctggccaccgagtgggtgaagggcaagaccgtggaggaggccctgaccatcaagaacaccgacatcgccaaggagctgtgcctgccccccgtgaagctgcactgcagcatgctggccgaggacgccatcaaggccgccctggccgactacaagctgaagcaggagcccaagaagggcgaggccgagaagaagtag

SEQ ID NO: 85803 - DNA, 1443 bp, Artificial Sequence
  Description of Artificial Sequence: Synthetic coding sequence
atgagcttcccccagctgggctacccccagtacctgagcgccgccggccccggcgcctacggcggcgagagacccggcgtgctggccgccgccgccgccgccgccgccgccgccagcagcggcagacccggcgccgccgagctgggcggcggcgccggcgccgccgccgtgaccagcgtgctgggcatgtacgccgccgccggcccctacgccggcgcccccaactacagcgccttcctgccctacgccgccgacctgagcctgttcagccagatgggcagccagtacgagctgaaggacaaccccggcgtgcaccccgccaccttcgccgcccacaccgcccccgcctactacccctacggccagttccagtacggcgaccccggcagacccaagaacgccaccagagagagcaccagcaccctgaaggcctggctgaacgagcacagaaagaacccctaccccaccaagggcgagaagatcatgctggccatcatcaccaagatgaccctgacccaggtgagcacctggttcgccaacgccagaagaagactgaagaaggagaacaaggtgacctggggcgccagaagcaaggaccaggaggacggcgccctgttcggcagcgacaccgagggcgaccccgagaaggccgaggacgacgaggagatcgacctggagagcatcgacatcgacaagatcgacgagcacgacggcgaccagagcaacgaggacgacgaggacaaggccgaggccccccacgcccccgccgcccccagcgccctggccagagaccagggcagccccctggccgccgccgacgtgctgaagccccaggacagccccctgggcctggccaaggaggcccccgagcccggcagcaccagactgctgagccccggcgccgccgccggcggcctgcagggcgccccccacggcaagcccaagatctggagcctggccgagaccgccaccagccccgacggcgcccccaaggccagcccccccccccccgccggccaccccggcgcccacggccccagcgccggcgcccccctgcagcaccccgccttcctgcccagccacggcctgtacacctgccacatcggcaagttcagcaactggaccaacagcgccttcctggcccagggcagcctgctgaacatgagaagcttcctgggcgtgggcgccccccacgccgccccccacggcccccacctgcccgcccccccccccccccagccccccgtggccatcgcccccggcgccctgaacggcgacaaggccagcgtgagaagcagccccaccctgcccgagagagacctggtgcccagacccgacagccccgcccagcagctgaagagccccttccagcccgtgagagacaacagcctggccccccaggagggcacccccagaatcctggccgccctgcccagcgcctag

SEQ ID NO: 85804 - DNA, 1416 bp, Artificial Sequence
  Description of Artificial Sequence: Synthetic coding sequence
atgagctacccccagggctacctgtaccaggcccccggcagcctggccctgtacagctgccccgcctacggcgccagcgccctggccgcccccagaagcgaggagctggccagaagcgccagcggcagcgccttcagcccctaccccggcagcgccgccttcaccgcccaggccgccaccggcttcggcagccccctgcagtacagcgccgacgccgccgccgccgccgccggcttccccagctacatgggcgccccctacgacgcccacaccaccggcatgaccggcgccatcagctaccacccctacggcagcgccgcctacccctaccagctgaacgaccccgcctacagaaagaacgccaccagagacgccaccgccaccctgaaggcctggctgaacgagcacagaaagaacccctaccccaccaagggcgagaagatcatgctggccatcatcaccaagatgaccctgacccaggtgagcacctggttcgccaacgccagaagaagactgaagaaggagaacaagatgacctgggcccccagaaacaagagcgaggacgaggacgaggacgagggcgacgccaccagaagcaaggacgagagccccgacaaggcccaggagggcaccgagaccagcgccgaggacgagggcatcagcctgcacgtggacagcctgaccgaccacagctgcagcgccgagagcgacggcgagaagctgccctgcagagccggcgaccccctgtgcgagagcggcagcgagtgcaaggacaagtacgacgacctggaggacgacgaggacgacgacgaggagggcgagagaggcctggccccccccaagcccgtgaccagcagccccctgaccggcctggaggcccccctgctgagccccccccccgaggccgcccccagaggcggcagaaagaccccccagggcagcagaaccagccccggcgcccccccccccgccagcaagcccaagctgtggagcctggccgagatcgccaccagcgacctgaagcagcccagcctgggccccggctgcggcccccccggcctgcccgccgccgccgcccccgccagcaccggcgccccccccggcggcagcccctaccccgccagccccctgctgggcagacccctgtactacaccagccccttctacggcaactacaccaactacggcaacctgaacgccgccctgcagggccagggcctgctgagatacaacagcgccgccgccgcccccggcgaggccctgcacaccgcccccaaggccgccagcgacgccggcaaggccggcgcccaccccctggagagccactacagaagccccggcggcggctacgagcccaagaaggacgccagcgagggctgcaccgtggtgggcggcggcgtgcagccctacctgtag

SEQ ID NO: 85805 - DNA, 1416 bp, Artificial Sequence; identical to SEQ ID NO: 85804
  Description of Artificial Sequence: Synthetic coding sequence

SEQ ID NO: 85806 - DNA, 1506 bp, Artificial Sequence
  Description of Artificial Sequence: Synthetic coding sequence
atgagcttcccccagctgggctaccagtacatcagacccctgtaccccagcgagagacccggcgccgccggcggcagcggcggcagcgccggcgccagaggcggcctgggcgccggcgccagcgagctgaacgccagcggcagcctgagcaacgtgctgagcagcgtgtacggcgccccctacgccgccgccgccgccgccgccgccgcccagggctacggcgccttcctgccctacgccgccgagctgcccatcttcccccagctgggcgcccagtacgagctgaaggacagccccggcgtgcagcaccccgccgccgccgccgccttcccccacccccaccccgccttctacccctacggccagtaccagttcggcgaccccagcagacccaagaacgccaccagagagagcaccagcaccctgaaggcctggctgaacgagcacagaaagaacccctaccccaccaagggcgagaagatcatgctggccatcatcaccaagatgaccctgacccaggtgagcacctggttcgccaacgccagaagaagactgaagaaggagaacaagatgacctgggcccccagaagcagaaccgacgaggagggcaacgcctacggcagcgagagagaggaggaggacgaggaggaggacgaggaggacggcaagagagagctggagctggaggaggaggagctgggcggcgaggaggaggacaccggcggcgagggcctggccgacgacgacgaggacgaggagatcgacctggagaacctggacggcgccgccaccgagcccgagctgagcctggccggcgccgccagaagagacggcgacctgggcctgggccccatcagcgacagcaagaacagcgacagcgaggacagcagcgagggcctggaggacagacccctgcccgtgctgagcctggcccccgcccccccccccgtggccgtggccagccccagcctgcccagcccccccgtgagcctggacccctgcgcccccgcccccgcccccgccagcgccctgcagaagcccaagatctggagcctggccgagaccgccaccagccccgacaaccccagaagaagcccccccggcgccggcggcagcccccccggcgccgccgtggcccccagcgccctgcagctgagccccgccgccgccgccgccgccgcccacagactggtgagcgcccccctgggcaagttccccgcctggaccaacagacccttccccggccccccccccggccccagactgcaccccctgagcctgctgggcagcgcccccccccacctgctgggcctgcccggcgccgccggccaccccgccgccgccgccgccttcgccagacccgccgagcccgagggcggcaccgacagatgcagcgccctggaggtggagaagaagctgctgaagaccgccttccagcccgtgcccagaagaccccagaaccacctggacgccgccctggtgctgagcgccctgagcagcagctag

SEQ ID NO: 85807 - DNA, 741 bp, Artificial Sequence
  Description of Artificial Sequence: Synthetic coding sequence
atgctgtggagacagctgatctactggcagctgctggccctgttcttcctgcccttctgcctgtgccaggacgagtacatggagagcccccagaccggcggcctgccccccgactgcagcaagtgctgccacggcgactacagcttcagaggctaccagggcccccccggcccccccggcccccccggcatccccggcaaccacggcaacaacggcaacaacggcgccaccggccacgagggcgccaagggcgagaagggcgacaagggcgacctgggccccagaggcgagagaggccagcacggccccaagggcgagaagggctaccccggcatcccccccgagctgcagatcgccttcatggccagcctggccacccacttcagcaaccagaacagcggcatcatcttcagcagcgtggagaccaacatcggcaacttcttcgacgtgatgaccggcagattcggcgcccccgtgagcggcgtgtacttcttcaccttcagcatgatgaagcacgaggacgtggaggaggtgtacgtgtacctgatgcacaacggcaacaccgtgttcagcatgtacagctacgagatgaagggcaagagcgacaccagcagcaaccacgccgtgctgaagctggccaagggcgacgaggtgtggctgagaatgggcaacggcgccctgcacggcgaccaccagagattcagcaccttcgccggcttcctgctgttcgagaccaagtag

SEQ ID NO: 85808 - DNA, 1560 bp, Artificial Sequence
  Description of Artificial Sequence: Synthetic coding sequence
atgagctacccccagttcggctacccctacagcagcgccccccagttcctgatggccaccaacagcctgagcacctgctgcgagagcggcggcagaaccctggccgacagcggccccgccgccagcgcccaggcccccgtgtactgccccgtgtacgagagcagactgctggccaccgccagacacgagctgaacagcgccgccgccctgggcgtgtacggcggcccctacggcggcagccagggctacggcaactacgtgacctacggcagcgaggccagcgccttctacagcctgaacagcttcgacagcaaggacggcagcggcagcgcccacggcggcctggcccccgccgccgccgcctactacccctacgagcccgccctgggccagtacccctacgacagatacggcaccatggacagcggcaccagaagaaagaacgccaccagagagaccaccagcaccctgaaggcctggctgcaggagcacagaaagaacccctaccccaccaagggcgagaagatcatgctggccatcatcaccaagatgaccctgacccaggtgagcacctggttcgccaacgccagaagaagactgaagaaggagaacaagatgacctggccccccagaaacaagtgcgccgacgagaagagaccctacgccgagggcgaggaggaggagggcggcgaggaggaggccagagaggagcccctgaagagcagcaagaacgccgagcccgtgggcaaggaggagaaggagctggagctgagcgacctggacgacttcgaccccctggaggccgagccccccgcctgcgagctgaagccccccttccacagcctggacggcggcctggagagagtgcccgccgcccccgacggccccgtgaaggaggccagcggcgccctgagaatgagcctggccgccggcggcggcgccgccctggacgaggacctggagagagccagaagctgcctgagaagcgccgccgccggccccgagcccctgcccggcgccgagggcggcccccaggtgtgcgaggccaagctgggcttcgtgcccgccggcgccagcgccggcctggaggccaagcccagaatctggagcctggcccacaccgccaccgccgccgccgccgccgccaccagcctgagccagaccgagttccccagctgcatgctgaagagacagggccccgccgcccccgccgccgtgagcagcgcccccgccaccagccccagcgtggccctgccccacagcggcgccctggacagacaccaggacagccccgtgaccagcctgagaaactgggtggacggcgtgttccacgaccccatcctgagacacagcaccctgaaccaggcctgggccaccgccaagggcgccctgctggaccccggccccctgggcagaagcctgggcgccggcgccaacgtgctgaccgcccccctggccagagccttcccccccgccgtgccccaggacgcccccgccgccggcgccgccagagagctgctggccctgcccaaggccggcggcaagcccttctgcgcctag

SEQ ID NO: 85809 - DNA, 1560 bp, Artificial Sequence; identical to SEQ ID NO: 85808
  Description of Artificial Sequence: Synthetic coding sequence

SEQ ID NO: 85810 - DNA, 1452 bp, Artificial Sequence
  Description of Artificial Sequence: Synthetic coding sequence
atgagctacccccagggctacctgtaccagcccagcgccagcctggccctgtacagctgccccgcctacagcaccagcgtgatcagcggccccagaaccgacgagctgggcagaagcagcagcggcagcgccttcagcccctacgccggcagcaccgccttcaccgcccccagccccggctacaacagccacctgcagtacggcgccgaccccgccgccgccgccgccgccgccttcagcagctacgtgggcagcccctacgaccacacccccggcatggccggcagcctgggctaccacccctacgccgcccccctgggcagctacccctacggcgaccccgcctacagaaagaacgccaccagagacgccaccgccaccctgaaggcctggctgaacgagcacagaaagaacccctaccccaccaagggcgagaagatcatgctggccatcatcaccaagatgaccctgacccaggtgagcacctggttcgccaacgccagaagaagactgaagaaggagaacaagatgacctggacccccagaaacagaagcgaggacgaggaggaggaggagaacatcgacctggagaagaacgacgaggacgagccccagaagcccgaggacaagggcgaccccgagggccccgaggccggcggcgccgagcagaaggccgccagcggctgcgagagactgcagggcccccccacccccgccggcaaggagaccgagggcagcctgagcgacagcgacttcaaggagccccccagcgagggcagactggacgccctgcagggcccccccagaaccggcggccccagccccgccggccccgccgccgccagactggccgaggaccccgccccccactaccccgccggcgcccccgcccccggcccccaccccgccgccggcgaggtgccccccggccccggcggccccagcgtgatccacagccccccccccccccccccccccgccgtgctggccaagcccaagctgtggagcctggccgagatcgccaccagcagcgacaaggtgaaggacggcggcggcggcaacgagggcagcccctgccccccctgccccggccccatcgccggccaggccctgggcggcagcagagccagccccgcccccgcccccagcagaagccccagcgcccagtgccccttccccggcggcaccgtgctgagcagacccctgtactacaccgcccccttctaccccggctacaccaactacggcagcttcggccacctgcacggccaccccggccccggccccggccccaccaccggccccggcagccacttcaacggcctgaaccagaccgtgctgaacagagccgacgccctggccaaggaccccaagatgctgagaagccagagccagctggacctgtgcaaggacagcccctacgagctgaagaagggcatgagcgacatctag

SEQ ID NO: 85811 - DNA, 441 bp, Artificial Sequence
  Description of Artificial Sequence: Synthetic coding sequence
atgagctacccccagggctacctgtaccagcccagcgccagcctggccctgtacagctgccccgcctacagcaccagcgtgatcagcggccccagaaccgacgagctgggcagaagcagcagcggcagcgccttcagcccctacgccggcagcaccgccttcaccgcccccagccccggctacaacagccacctgcagtacggcgccgaccccgccgccgccgccgccgccgccttcagcagctacgtgctgctgaagaaggagaagaagagcctggacttcccctgcttcccccccctgagacccacctgcgtgagaagccccgccgagagaggcgtggccagcgtggcccaggccagcatctgcatggagggcagagccgccgtggccagaagcgcccacggcggcagcccctacgcccacagagtgcccggcccctag

SEQ ID NO: 85812 - DNA, 498 bp, Artificial Sequence
  Description of Artificial Sequence: Synthetic coding sequence
atgggctgggacctgaccgtgaagatgctggccggcaacgagttccaggtgagcctgagcagcagcatgagcgtgagcgagctgaaggcccagatcacccagaagatcggcgtgcacgccttccagcagagactggccgtgcaccccagcggcgtggccctgcaggacagagtgcccctggccagccagggcctgggccccggcagcaccgtgctgctggtggtggacaagtgcgacgagcccctgagcatcctggtgagaaacaacaagggcagaagcagcacctacgaggtgagactgacccagaccgtggcccacctgaagcagcaggtgagcggcctggagggcgtgcaggacgacctgttctggctgaccttcgagggcaagcccctggaggaccagctgcccctgggcgagtacggcctgaagcccctgagcaccgtgttcatgaacctgagactgagaggcggcggcaccgagcccggcggcagaagctag

SEQ ID NO: 85813 - DNA, 3129 bp, Artificial Sequence
  Description of Artificial Sequence: Synthetic coding sequence
atggccgacgccttcggcgacgagctgttcagcgtgttcgagggcgacagcaccaccgccgccggcaccaagaaggacaaggagaaggacaagggcaagtggaagggcccccccggcagcgccgacaaggccggcaagagattcgacggcaagctgcagagcgagagcaccaacaacggcaagaacaagagagacgtggacttcgagggcaccgacgagcccatcttcggcaagaagcccagaatcgaggagagcatcaccgaggacctgagcctggccgacctgatgcccagagtgaaggtgcagagcgtggagaccgtggagggctgcacccacgaggtggccctgcccgccgaggaggactacctgcccctgaagcccagagtgggcaaggccgccaaggagtaccccttcatcctggacgccttccagagagaggccatccagtgcgtggacaacaaccagagcgtgctggtgagcgcccacaccagcgccggcaagaccgtgtgcgccgagtacgccatcgccctggccctgagagagaagcagagagtgatcttcaccagccccatcaaggccctgagcaaccagaagtacagagagatgtacgaggagttccaggacgtgggcctgatgaccggcgacgtgaccatcaaccccaccgccagctgcctggtgatgaccaccgagatcctgagaagcatgctgtacagaggcagcgaggtgatgagagaggtggcctgggtgatcttcgacgagatccactacatgagagacagcgagagaggcgtggtgtgggaggagaccatcatcctgctgcccgacaacgtgcactacgtgttcctgagcgccaccatccccaacgccagacagttcgccgagtggatctgccacctgcacaagcagccctgccacgtgatctacaccgactacagacccacccccctgcagcactacatcttccccgccggcggcgacggcctgcacctggtggtggacgagaacggcgacttcagagaggacaacttcaacaccgccatgcaggtgctgagagacgccggcgacctggccaagggcgaccagaagggcagaaagggcggcaccaagggccccagcaacgtgttcaagatcgtgaagatgatcatggagagaaacttccagcccgtgatcatcttcagcttcagcaagaaggactgcgaggcctacgccctgcagatgaccaagctggacttcaacaccgacgaggagaagaagatggtggaggaggtgttcagcaacgccatcgactgcctgagcgacgaggacaagaagctgccccaggtggagcacgtgctgcccctgctgaagagaggcatcggcatccaccacggcggcctgctgcccatcctgaaggagaccatcgagatcctgttcagcgagggcctgatcaaggccctgttcgccaccgagaccttcgccatgggcatcaacatgcccgccagaaccgtgctgttcaccaacgccagaaagttcgacggcaaggacttcagatggatcagcagcggcgagtacatccagatgagcggcagagccggcagaagaggcatggacgacagaggcatcgtgatcctgatggtggacgagaagatgagccccaccatcggcaagcagctgctgaagggcagcgccgaccccctgaacagcgccttccacctgacctacaacatggtgctgaacctgctgagagtggaggagatcaaccccgagtacatgctggagaagagcttctaccagttccagcactacagagccatccccggcgtggtggagaaggtgaagaacagcgaggagcagtacaacaagatcgtgatccccaacgaggagagcgtggtgatctactacaagatcagacagcagctggccaagctgggcaaggagatcgaggagtacatccacaagcccaagtactgcctgcccttcctgcagcccggcagactggtgaaggtgaagaacgagggcgacgacttcggctggggcgtggtggtgaacttcagcaagaagagcaacgtgaagcccaacagcggcgagctggaccccctgtacgtggtggaggtgctgctgagatgcagcaaggagagcctgaagaacagcgccaccgaggccgccaagcccgccaagcccgacgagaagggcgagatgcaggtggtgcccgtgctggtgcacctgctgagcgccatcagcagcgtgagactgtacatccccaaggacctgagacccgtggacaacagacagagcgtgctgaagagcatccaggaggtgcagaagagattccccgacggcatccccctgctggaccccatcgacgacatgggcatccaggaccagggcctgaagaaggtgatccagaaggtggaggccttcgagcacagaatgtacagccaccccctgcacaacgaccccaacctggagaccgtgtacaccctgtgcgagaagaaggcccagatcgccatcgacatcaagagcgccaagagagagctgaagaaggccagaaccgtgctgcagatggacgagctgaagtgcagaaagagagtgctgagaagactgggcttcgccaccagcagcgacgtgatcgagatgaagggcagagtggcctgcgagatcagcagcgccgacgagctgctgctgaccgagatgatgttcaacggcctgttcaacgacctgagcgccgagcaggccaccgccctgctgagctgcttcgtgttccaggagaacagcagcgagatgcccaagctgaccgagcagctggccggccccctgagacagatgcaggagtgcgccaagagaatcgccaaggtgagcgccgaggccaagctggagatcgacgaggagacctacctgagcagcttcaagccccacctgatggacgtggtgtacacctgggccaccggcgccaccttcgcccacatctgcaagatgaccgacgtgttcgagggcagcatcatcagatgcatgagaagactggaggagctgctgagacagatgtgccaggccgccaaggccatcggcaacaccgagctggagaacaagttcgccgagggcatcaccaagatcaagagagacatcgtgttcgccgccagcctgtacctgtag

SEQ ID NO: 85814 - DNA, 981 bp, Artificial Sequence
  Description of Artificial Sequence: Synthetic coding sequence
atgggcgacatgggcgacccccccaagaagaagagactgatcagcctgtgcgtgggctgcggcaaccagatccacgaccagtacatcctgagagtgagccccgacctggagtggcacgccgcctgcctgaagtgcgccgagtgcaaccagtacctggacgagagctgcacctgcttcgtgagagacggcaagacctactgcaagagagactacatcagactgtacggcatcaagtgcgccaagtgcagcatcggcttcagcaagaacgacttcgtgatgagagccagaagcaaggtgtaccacatcgagtgcttcagatgcgtggcctgcagcagacagctgatccccggcgacgagttcgccctgagagaggacggcctgttctgcagagccgaccacgacgtggtggagagagccagcctgggcgccggcgaccccctgagccccctgcaccccgccagacccctgcagatggccgccgagcccatcagcgccagacagcccgccctgagaccccacgtgcacaagcagcccgagaagaccaccagagtgagaaccgtgctgaacgagaagcagctgcacaccctgagaacctgctacgccgccaaccccagacccgacgccctgatgaaggagcagctggtggagatgaccggcctgagccccagagtgatcagagtgtggttccagaacaagagatgcaaggacaagaagagaagcatcatgatgaagcagctgcagcagcagcagcccaacgacaagaccgccaaccccgtggaggtgcagagctaccagcccccctggaaggtgctgagcgacttcgccctgcagagcgacatcgaccagcccgccttccagcagctggtgaacttcagcgagggcggccccggcagcaacagcaccggcagcgaggtggccagcatgagcagccagctgcccgacacccccaacagcatggtggccagccccatcgaggcctag

SEQ ID NO: 85815 - DNA, 270 bp, Artificial Sequence
  Description of Artificial Sequence: Synthetic coding sequence
atgggcatcctgaagctgcaggtgttcctgatcgtgctgagcgtggccctgaaccacctgaaggccacccccatcgagagccaccaggtggagaagagaaagtgcaacaccgccacctgcgccacccagagactggccaacttcctggtgcacagcagcaacaacttcggcgccatcctgagcagcaccaacgtgggcagcaacacctacggcaagagaaacgccgtggaggtgctgaagagagagcccctgaactacctgcccctgtag

SEQ ID NO: 85816 - DNA, 240 bp, Artificial Sequence
  Description of Artificial Sequence: Synthetic coding sequence
atgggcatcctgaagctgcaggtgttcctgatcgtgctgagcgtggccctgaaccacctgaaggccacccccatcgagagccaccaggtggagaagagaaagtgcaacaccgccacctgcgccacccagagactggccaacttcctggtgcacagcagcaacaacttcggcgccatcctgagcagcaccaacgtgggcagcaacacctacggcaagagaaacgccgtggaggtgctgtag

SEQ ID NO: 85817 - DNA, 270 bp, Artificial Sequence; identical to SEQ ID NO: 85815
  Description of Artificial Sequence: Synthetic coding sequence

SEQ ID NO: 85818 - DNA, 1449 bp, Artificial Sequence
  Description of Artificial Sequence: Synthetic coding sequence
atgagcggccacaagtgctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgcagattccaccaggaggtggagaccttcagacacagagccatcagcgacacctggctgaccgtgaacagaatggagcagtgcagaaccgagtacagaggcgccctgctgtggatgaaggacgtgagccaggagctggaccccgacctgtacaagcagatggagaagttcagaaaggtgcagacccaggtgagactggccaagaagaacttcgacaagctgaagatggacgtgtgccagaaggtggacctgctgggcgccagcagatgcaacctgctgagccacatgctggccacctaccagaccaccctgctgcacttctgggagaagaccagccacaccatggccgccatccacgagagcttcaagggctaccagccctacgagttcaccaccctgaagagcctgcaggaccccatgaagaagctggtggagaaggaggagaagaagaagatcaaccagcaggagagcaccgacgccgccgtgcaggagcccagccagctgatcagcctggaggaggagaaccagagaaaggagagcagcagcttcaagaccgaggacggcaagagcatcctgagcgccctggacaagggcagcacccacaccgcctgcagcggccccatcgacgagctgctggacatgaagagcgaggagggcgcctgcctgggccccgtggccggcacccccgagcccgagggcgccgacaaggacgacctgctgctgctgagcgagatcttcaacgccagcagcctggaggagggcgagttcagcaaggagtgggccgccgtgttcggcgacggccaggtgaaggagcccgtgcccaccatggccctgggcgagcccgaccccaaggcccagaccggcagcggcttcctgcccagccagctgctggaccagaacatgaaggacctgcaggccagcctgcaggagcccgccaaggccgccagcgacctgaccgcctggttcagcctgttcgccgacctggaccccctgagcaaccccgacgccgtgggcaagaccgacaaggagcacgagctgctgaacgcctag

SEQ ID NO: 85819 - DNA, 774 bp, Artificial Sequence
  Description of Artificial Sequence: Synthetic coding sequence
atgagcggccacaagtgcagctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgcagattccaccaggaggtggagaccttcagacacagagccatcagcgacacctggctgaccgtgaacagaatggagcagtgcagaaccgagtacagaggcgccctgctgtggatgaaggacgtgagccaggagctggaccccgacctgtacaagcagatggagaagttcagaaaggtgcagacccaggtgagactggccaagaagaacttcgacaagctgaagatggacgtgtgccagaaggtggacctgctgggcgccagcagatgcaacctgctgagccacatgctggccacctaccagctggcctgggaccagtggcagggccccagaaacctgaaggtgctgaccaagatgacctgctgctgctag

SEQ ID NO: 85820 - DNA, 1452 bp, Artificial Sequence
  Description of Artificial Sequence: Synthetic coding sequence
atgagcggccacaagtgcagctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgcagattccaccaggaggtggagaccttcagacacagagccatcagcgacacctggctgaccgtgaacagaatggagcagtgcagaaccgagtacagaggcgccctgctgtggatgaaggacgtgagccaggagctggaccccgacctgtacaagcagatggagaagttcagaaaggtgcagacccaggtgagactggccaagaagaacttcgacaagctgaagatggacgtgtgccagaaggtggacctgctgggcgccagcagatgcaacctgctgagccacatgctggccacctaccagaccaccctgctgcacttctgggagaagaccagccacaccatggccgccatccacgagagcttcaagggctaccagccctacgagttcaccaccctgaagagcctgcaggaccccatgaagaagctggtggagaaggaggagaagaagaagatcaaccagcaggagagcaccgacgccgccgtgcaggagcccagccagctgatcagcctggaggaggagaaccagagaaaggagagcagcagcttcaagaccgaggacggcaagagcatcctgagcgccctggacaagggcagcacccacaccgcctgcagcggccccatcgacgagctgctggacatgaagagcgaggagggcgcctgcctgggccccgtggccggcacccccgagcccgagggcgccgacaaggacgacctgctgctgctgagcgagatcttcaacgccagcagcctggaggagggcgagttcagcaaggagtgggccgccgtgttcggcgacggccaggtgaaggagcccgtgcccaccatggccctgggcgagcccgaccccaaggcccagaccggcagcggcttcctgcccagccagctgctggaccagaacatgaaggacctgcaggccagcctgcaggagcccgccaaggccgccagcgacctgaccgcctggttcagcctgttcgccgacctggaccccctgagcaaccccgacgccgtgggcaagaccgacaaggagcacgagctgctgaacgcctag

SEQ ID NO: 85821 - DNA, 1452 bp, Artificial Sequence; identical to SEQ ID NO: 85820
  Description of Artificial Sequence: Synthetic coding sequence

SEQ ID NO: 85822 - DNA, 1452 bp, Artificial Sequence; identical to SEQ ID NO: 85820
  Description of Artificial Sequence: Synthetic coding sequence

SEQ ID NO: 85823 - DNA, 1539 bp, Artificial Sequence
  Description of Artificial Sequence: Synthetic coding sequence
atgagcggccacaagtgcagctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgcagattccaccaggaggtggagaccttcagacacagagccatcagcgacacctggctgaccgtgaacagaatggagcagtgcagaaccgagtacagaggcgccctgctgtggatgaaggacgtgagccaggagctggaccccgacctgtacaagcagatggagaagttcagaaaggtgcagacccaggtgagactggccaagaagaacttcgacaagctgaagatggacgtgtgccagaaggtggacctgctgggcgccagcagatgcaacctgctgagccacatgctggccacctaccagaccaccctgctgcacttctgggagaagaccagccacaccatggccgccatccacgagagcttcaagggctaccagccctacgagttcaccaccctgaagagcctgcaggaccccatgaagaagctggtggagaaggaggagaagaagaagatcaaccagcaggagagcaccgacgccgccgtgcaggagcccagccagtacctgcagaacatctgcctggagatgaaggccaacagcgacatcaagatgctgcagaagggcaaggagggccagcagatcggcatcctgatcagcctggaggaggagaaccagagaaaggagagcagcagcttcaagaccgaggacggcaagagcatcctgagcgccctggacaagggcagcacccacaccgcctgcagcggccccatcgacgagctgctggacatgaagagcgaggagggcgcctgcctgggccccgtggccggcacccccgagcccgagggcgccgacaaggacgacctgctgctgctgagcgagatcttcaacgccagcagcctggaggagggcgagttcagcaaggagtgggccgccgtgttcggcgacggccaggtgaaggagcccgtgcccaccatggccctgggcgagcccgaccccaaggcccagaccggcagcggcttcctgcccagccagctgctggaccagaacatgaaggacctgcaggccagcctgcaggagcccgccaaggccgccagcgacctgaccgcctggttcagcctgttcgccgacctggaccccctgagcaaccccgacgccgtgggcaagaccgacaaggagcacgagctgctgaacgcctag

SEQ ID NO: 85824 - DNA, 405 bp, Artificial Sequence
  Description of Artificial Sequence: Synthetic coding sequence
atgagcggccacaagtgctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgctag

SEQ ID NO: 85825 - DNA, 489 bp, Artificial Sequence
  Description of Artificial Sequence: Synthetic coding sequence
atgagcggccacaagtgcagctacccctgggacctgcaggacagatacgcccaggacaagagcgtggtgaacaagatgcagcagaagtactgggagaccaagcaggccttcatcaaggccaccggcaagaaggaggacgagcacgtggtggccagcgacgccgacctggacgccaagctggagctgttccacagcatccagagaacctgcctggacctgagcaaggccatcgtgctgtaccagaagagaatctgcttcctgagccaggaggagaacgagctgggcaagttcctgagaagccagggcttccaggacaagaccagagccggcaagatgatgcaggccaccggcaaggccctgtgcttcagcagccagcagagactggccctgagaaaccccctgtgcagattccaccaggaggtggagaccttcagacacagagccatcagcgacacctggctgaccgtgaacagaatggagcagtgctag

SEQ ID NO: 85826 - DNA, 666 bp, Artificial Sequence
  Description of Artificial Sequence: Synthetic coding sequence
atggccgccgccagacccagcctgggcagagtgctgcccggcagcagcgtgctgttcctgtgcgacatgcaggagaagttcagacacaacatcgcctacttcccccagatcgtgagcgtggccgccagaatgctgaaggtggccagactgctggaggtgcccgtgatgctgaccgagcagtacccccagggcctgggccccaccgtgcccgagctgggcaccgagggcctgagacccctggccaagacctgcttcagcatggtgcccgccctgcagcaggagctggacagcagaccccagctgagaagcgtgctgctgtgcggcatcgaggcccaggcctgcatcctggaccccagaagctaccccggcctggccctgaccagcctgtacccccagaacaccaccctggacctgctggacagaggcctgcaggtgcacgtggtggtggacgcctgcagcagcagaagccaggtggacagactggtggccctggccagaatgagacagagcggcgccttcctgagcaccagcgagggcctgatcctgcagctggtgggcgacgccgtgcacccccagttcaaggagatccagaagctgatcaaggagcccgcccccgacagcggcctgctgggcctgttccagggccagaacagcctgctgcactag

SEQ ID NO: 85827 - DNA, 618 bp, Artificial Sequence
  Description of Artificial Sequence: Synthetic coding sequence
atggccgccgccagacccagcctgggcagagtgctgcccggcagcagcgtgctgttcctgtgcgacatgcaggagaagttcagacacaacatcgcctacttcccccagatcgtgagcgtggccgccagaatgctgaaggtggccagactgctggaggtgcccgtgatgctgaccgagcagtacccccagggcctgggccccaccgtgcccgagctgggcaccgagggcctgagacccctggccaagacctgcttcagcatggtgcccgccctgcagcaggagctggacagcagaccccagctgagaagcgtgctgctgtgcggcatcgaggcccaggcctgcatcctgaacaccaccctggacctgctggacagaggcctgcaggtgcacgtggtggtggacgcctgcagcagcagaagccaggtggacagactggtggccctggccagaatgagacagagcggcgccttcctgagcaccagcgagggcctgatcctgcagctggtgggcgacgccgtgcacccccagttcaaggagatccagaagctgatcaaggagcccgcccccgacagcggcctgctgggcctgttccagggccagaacagcctgctgcactag

SEQ ID NO: 85828 - DNA, 408 bp, Artificial Sequence
  Description of Artificial Sequence: Synthetic coding sequence
atggccgccgccagacccagcctgggcagagtgctgcccggcagcagcgtgctgttcctgtgcgacatgcaggagaagttcagacacaacatcgcctacttcccccagatcgtgagcgtggccgccagaatgctgaagaacaccaccctggacctgctggacagaggcctgcaggtgcacgtggtggtggacgcctgcagcagcagaagccaggtggacagactggtggccctggccagaatgagacagagcggcgccttcctgagcaccagcgagggcctgatcctgcagctggtgggcgacgccgtgcacccccagttcaaggagatccagaagctgatcaaggagcccgcccccgacagcggcctgctgggcctgttccagggccagaacagcctgctgcactag

SEQ ID NO: 85829 - DNA, 1101 bp, Artificial Sequence
  Description of Artificial Sequence: Synthetic coding sequence
atggccggccccgcctggatcagcaaggtgagcagactgctgggcgccttccacaaccccaagcaggtgaccagaggcttcaccggcggcgtgcagaccgtgaccctgatccccggcgacggcatcggccccgagatcagcgccgccgtgatgaagatcttcgacgccgccaaggcccccatccagtgggaggagagaaacgtgaccgccatccagggccccggcggcaagtggatgatccccagcgaggccaaggagagcatggacaagaacaagatgggcctgaagggccccctgaagacccccatcgccgccggccaccccagcatgaacctgctgctgagaaagaccttcgacctgtacgccaacgtgagaccctgcgtgagcatcgagggctacaagaccccctacaccgacgtgaacatcgtgaccatcagagagaacaccgagggcgagtacagcggcatcgagcacgtgatcgtggacggcgtggtgcagagcatcaagctgatcaccgagggcgccagcaagagaatcgccgagttcgccttcgagtacgccagaaacaaccacagaagcaacgtgaccgccgtgcacaaggccaacatcatgagaatgagcgacggcctgttcctgcagaagtgcagagaggtggccgagagctgcaaggacatcaagttcaacgagatgtacctggacaccgtgtgcctgaacatggtgcaggaccccagccagttcgacgtgctggtgatgcccaacctgtacggcgacatcctgagcgacctgtgcgccggcctgatcggcggcctgggcgtgacccccagcggcaacatcggcgccaacggcgtggccatcttcgagagcgtgcacggcaccgcccccgacatcgccggcaaggacatggccaaccccaccgccctgctgctgagcgccgtgatgatgctgagacacatgggcctgttcgaccacgccgccagaatcgaggccgcctgcttcgccaccatcaaggacggcaagagcctgaccaaggacctgggcggcaacgccaagtgcagcgacttcaccgaggagatctgcagaagagtgaaggacctggactag

SEQ ID NO: 85830 - DNA, 774 bp, Artificial Sequence
  Description of Artificial Sequence: Synthetic coding sequence
atgaacctgctgctgagaaagaccttcgacctgtacgccaacgtgagaccctgcgtgagcatcgagggctacaagaccccctacaccgacgtgaacatcgtgaccatcagagagaacaccgagggcgagtacagcggcatcgagcacgtgatcgtggacggcgtggtgcagagcatcaagctgatcaccgagggcgccagcaagagaatcgccgagttcgccttcgagtacgccagaaacaaccacagaagcaacgtgaccgccgtgcacaaggccaacatcatgagaatgagcgacggcctgttcctgcagaagtgcagagaggtggccgagagctgcaaggacatcaagttcaacgagatgtacctggacaccgtgtgcctgaacatggtgcaggaccccagccagttcgacgtgctggtgatgcccaacctgtacggcgacatcctgagcgacctgtgcgccggcctgatcggcggcctgggcgtgacccccagcggcaacatcggcgccaacggcgtggccatcttcgagagcgtgcacggcaccgcccccgacatcgccggcaaggacatggccaaccccaccgccctgctgctgagcgccgtgatgatgctgagacacatgggcctgttcgaccacgccgccagaatcgaggccgcctgcttcgccaccatcaaggacggcaagagcctgaccaaggacctgggcggcaacgccaagtgcagcgacttcaccgaggagatctgcagaagagtgaaggacctggactag

SEQ ID NO: 85831 - DNA, 495 bp, Artificial Sequence
  Description of Artificial Sequence: Synthetic coding sequence
atggccgccctgagcggcgtgagatggctgaccagagccctggtgagcgccggcaaccccggcgcctggagaggcctgagcaccagcgccgccgcccacgccgccagcagaagccaggccgaggacgtgagagtggagggcagcttccccgtgaccatgctgcccggcgacggcgtgggccccgagctgatgcacgccgtgaaggaggtgttcaaggccgccgccgtgcccgtggagttccaggagcaccacctgagcgaggtgcagaacatggccagcgaggagaagctggagcaggtgctgagcagcatgaaggagaacaaggtggccatcatcggcaagatccacacccccatggagtacaagggcgagctggccagctacgacatgagactgagaagaaagctggacctgttcgccaacgtggtgcacgtgaagagcctgcccggctacgacagcgcccagcagagcagacccggcgaccacagcagatag

SEQ ID NO: 85832 - DNA, 1158 bp, Artificial Sequence
  Description of Artificial Sequence: Synthetic coding sequence
atggccgccctgagcggcgtgagatggctgaccagagccctggtgagcgccggcaaccccggcgcctggagaggcctgagcaccagcgccgccgcccacgccgccagcagaagccaggccgaggacgtgagagtggagggcagcttccccgtgaccatgctgcccggcgacggcgtgggccccgagctgatgcacgccgtgaaggaggtgttcaaggccgccgccgtgcccgtggagttccaggagcaccacctgagcgaggtgcagaacatggccagcgaggagaagctggagcaggtgctgagcagcatgaaggagaacaaggtggccatcatcggcaagatccacacccccatggagtacaagggcgagctggccagctacgacatgagactgagaagaaagctggacctgttcgccaacgtggtgcacgtgaagagcctgcccggctacatgaccagacacaacaacctggacctggtgatcatcagagagcagaccgagggcgagtacagcagcctggagcacgagagcgccagaggcgtgatcgagtgcctgaagatcgtgaccagagccaagagccagagaatcgccaagttcgccttcgactacgccaccaagaagggcagaggcaaggtgaccgccgtgcacaaggccaacatcatgaagctgggcgacggcctgttcctgcagtgctgcgaggaggtggccgagctgtaccccaagatcaagttcgagaccatgatcatcgacaactgctgcatgcagctggtgcagaacccctaccagttcgacgtgctggtgatgcccaacctgtacggcaacatcatcgacaacctggccgccggcctggtgggcggcgccggcgtggtgcccggcgagagctacagcgccgagtacgccgtgttcgagaccggcgccagacaccccttcgcccaggccgtgggcagaaacatcgccaaccccaccgccatgctgctgagcgccagcaacatgctgagacacctgaacctggagtaccacagcagcatgatcgccgacgccgtgaagaaggtgatcaaggtgggcaaggtgagaaccagagacatgggcggctacagcaccaccaccgacttcatcaagagcgtgatcggccacctgcagaccaagggcagctag

SEQ ID NO: 85833 - DNA, 1152 bp, Artificial Sequence
  Description of Artificial Sequence: Synthetic coding sequence
atggccgccctgagcggcgtgagatggctgaccagagccctggtgagcgccggcaaccccggcgcctggagaggcctgagcaccagcgccgccgcccacgccgccagcagaagccaggccgaggacgtgagagtggagggcagcttccccgtgaccatgctgcccggcgacggcgtgggccccgagctgatgcacgccgtgaaggaggtgttcaaggccgccgccgtgcccgtggagttccaggagcaccacctgagcgaggtgcagaacatggccagcgaggagaagctggagcaggtgctgagcagcatgaaggagaacaaggtggccatcatcggcaagatccacacccccatggagtacaagggcgagctggccagctacgacatgagactgagaagaaagctggacctgttcgccaacgtggtgcacgtgaagagcctgcccggctacatgaccagacacaacaacctggacctggtgatcatcagagagcagaccgagggcgagtacagcagcctggagcacgagagcgccagaggcgtgatcgagtgcctgaagatcgtgaccagagccaagagccagagaatcgccaagttcgccttcgactacgccaccaagaagggcagaggcaaggtgaccgccgtgcacaaggccaacatcatgaagctgggcgacggcctgttcctgcagtgctgcgaggaggtggccgagctgtaccccaagatcaagttcgagaccatgatcatcgacaactgctgcatgcagctggtgcagaacccctaccagttcgacgtgctggtgatgcccaacctgtacggcaacatcatcgacaacctggccgccggcctggtgggcggcgccggcgtggtgcccggcgagagctacagcgccgagtacgccgtgttcgagaccggcgccagacaccccttcgcccaggccgtgggcagaaacatcgccaaccccaccgccatgctgctgagcgccagcaacatgctgagacacctgaacctggagtaccacagcagcatgatcgccgacgccgtgaagaaggtgatcaaggtgggcaaggtgagaaccagcgacatgggcggctacgccacctgccacgacttcaccgaggccgtgatcgccgccctgccccacccctag

SEQ ID NO: 85834 - DNA, 702 bp, Artificial Sequence
  Description of Artificial Sequence: Synthetic coding sequence
atgaagatgggcgagagatggagcagcctgttccccttccccgtgagccccagctgctgcttcctgctgacccagagcgccagaggcgtgatcgagtgcctgaagatcgtgaccagagccaagagccagagaatcgccaagttcgccttcgactacgccaccaagaagggcagaggcaaggtgaccgccgtgcacaaggccaacatcatgaagctgggcgacggcctgttcctgcagtgctgcgaggaggtggccgagctgtaccccaagatcaagttcgagaccatgatcatcgacaactgctgcatgcagctggtgcagaacccctaccagttcgacgtgctggtgatgcccaacctgtacggcaacatcatcgacaacctggccgccggcctggtgggcggcgccggcgtggtgcccggcgagagctacagcgccgagtacgccgtgttcgagaccggcgccagacaccccttcgcccaggccgtgggcagaaacatcgccaaccccaccgccatgctgctgagcgccagcaacatgctgagacacctgaacctggagtaccacagcagcatgatcgccgacgccgtgaagaaggtgatcaaggtgggcaaggtgagaaccagagacatgggcggctacagcaccaccaccgacttcatcaagagcgtgatcggccacctgcagaccaagggcagctag

SEQ ID NO: 85835 - DNA, 795 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactacagactgaagagcctgcagaagaaggccagcaccagcgccggcagaatcaccgtgcccagactgagcgtgggcagcgtgaccagcagacccagcacccccaccctgggcacccccaccccccagaccatgagcgtgagcaccaaggtgggcacccccatgagcctgaccggccagagattcaccgtgcagatgcccaccagccagagccccgccgtgaaggccagcatccccgccaccagcgccgtgcagaacgtgctgatcaaccccagcctgatcggcagcaagaacatcctgatcaccaccaacatgatgagcagccagaacaccgccaacgagagcagcaacgccctgaagagaaagagagaggacgacgacgacgacgacgacgacgacgacgactacgacaacctgtag

SEQ ID NO: 85836 - DNA, 906 bp, Artificial Sequence
  Description of Artificial Sequence: Synthetic coding sequence
atggccatcagaagaaacagagtggccctgaagggcaacatcgagaccaaccacaacctgccccccagccacaagagcagaaacaacatcctgagaaccagcctggacctgtacgccaacgtgatccactgcaagagcctgcccggcgtggtgaccagacacaaggacatcgacatcctgatcgtgagagagaacaccgagggcgagtacagcagcctggagcacgagagcgtggccggcgtggtggagagcctgaagatcatcaccaaggccaagagcctgagaatcgccgagtacgccttcaagctggcccaggagagcggcagaaagaaggtgaccgccgtgcacaaggccaacatcatgaagctgggcgacggcctgttcctgcagtgctgcagagaggtggccgccagatacccccagatcaccttcgagaacatgatcgtggacaacaccaccatgcagctggtgagcagaccccagcagttcgacgtgatggtgatgcccaacctgtacggcaacatcgtgaacaacgtgtgcgccggcctggtgggcggccccggcctggtggccggcgccaactacggccacgtgtacgccgtgttcgagaccgccaccagaaacaccggcaagagcatcgccaacaagaacatcgccaaccccaccgccaccctgctggccagctgcatgatgctggaccacctgaagctgcacagctacgccaccagcatcagaaaggccgtgctggccagcatggacaacgagaacggcctggtgtgcgccgagcccgcctgcgtgctgcagatgcacacccccgacatcggcggccagggcaccaccagcgaggccatccaggacgtgatcagacacatcagagtgatcaacggcagagccgtggaggcctag

SEQ ID NO: 85837 - DNA, 1143 bp, Artificial Sequence
  Description of Artificial Sequence: Synthetic coding sequence
atggccctgaaggtggccaccgtggccggcagcgccgccaaggccgtgctgggccccgccctgctgtgcagaccctgggaggtgctgggcgcccacgaggtgcccagcagaaacatcttcagcgagcagaccatcccccccagcgccaagtacggcggcagacacaccgtgaccatgatccccggcgacggcatcggccccgagctgatgctgcacgtgaagagcgtgttcagacacgcctgcgtgcccgtggacttcgaggaggtgcacgtgagcagcaacgccgacgaggaggacatcagaaacgccatcatggccatcagaagaaacagagtggccctgaagggcaacatcgagaccaaccacaacctgccccccagccacaagagcagaaacaacatcctgagaaccagcctggacctgtacgccaacgtgatccactgcaagagcctgcccggcgtggtgaccagacacaaggacatcgacatcctgatcgtgagagagaacaccgagggcgagtacagcagcctggagcacgagagcgtggccggcgtggtggagagcctgaagatcatcaccaaggccaagagcctgagaatcgccgagtacgccttcaagctggcccaggagagcggcagaaagaaggtgaccgccgtgcacaaggccaacatcatgaagctgggcgacggcctgttcctgcagtgctgcagagaggtggccgccagatacccccagatcaccttcgagaacatgatcgtggacaacaccaccatgcagctggtgagcagaccccagcagttcgacgtgatggtgatgcccaacctgtacggcaacatcgtgaacaacgtgtgcgccggcctggtgggcggccccggcctggtggccggcgccaactacggccacgtgtacgccgtgttcgagaccgccaccagaaacaccggcaagagcatcgccaacaagaacatcgccaaccccaccgccaccctgctggccagctgcatgatgctggaccacctgaagctgcacagctacgccaccagcatcagaaaggccgtgctggccagcatggacaacgagaacgtgagattccccagccaccccaccctgctgcccagacccgtgagcccctgcagcctgctgtag

SEQ ID NO: 85838 - DNA, 525 bp, Artificial Sequence
  Description of Artificial Sequence: Synthetic coding sequence
atgtacaccttcgaccaggccaccggcggcaccgcccagttcgaggcccacagcgacgcccaggccctggtgctgctggacgtgacccccgaccagagcatggtggacgagggcatggccagagaggtgatcaacagaatccagaagctgagaaagaagtgcaacctggtgcccaccgacgagatcaccgtgtactacaaggccaagagcgagggcacctacctgaacagcgtgatcgagagccacaccgagttcatcttcaccaccatcaaggcccccctgaagccctaccccgtgagccccagcgacaaggtgctgatccaggagaagacccagctgaagggcagcgagctggagatcaccctgaccagaggcagcagcctgcccggccccgcctgcgcctacgtgaacctgaacatctgcgccaacggcagcgagcagggcgagatgcagtggatcatccccgagatctaccacttctggaagcccagatggagcatcgcccccggcaagagcaagagatag

SEQ ID NO: 85839 - DNA, 525 bp, Artificial Sequence; identical to SEQ ID NO: 85838
  Description of Artificial Sequence: Synthetic coding sequence

SEQ ID NO: 85840 - DNA, 3789 bp, Artificial Sequence
  Description of Artificial Sequence: Synthetic coding sequence
atgctgcagcaggtgcccgagaacatcaacttccccgccgaggaggagaagatcctggagttctggaccgagttcaactgcttccaggagtgcctgaagcagagcaagcacaagcccaagttcaccttctacgacggcccccccttcgccaccggcctgccccactacggccacatcctggccggcaccatcaaggacatcgtgaccagatacgcccaccagagcggcttccacgtggacagaagattcggctgggactgccacggcctgcccgtggagtacgagatcgacaagaccctgggcatcagaggccccgaggacgtggccaagatgggcatcaccgagtacaacaaccagtgcagagccatcgtgatgagatacagcgccgagtggaagagcaccgtgagcagactgggcagatggatcgacttcgacaacgactacaagaccctgtacccccagttcatggagagcgtgtggtgggtgttcaagcagctgtacgacaagggcctggtgtacagaggcgtgaaggtgatgcccttcagcaccgcctgcaacacccccctgagcaacttcgagagccaccagaactacaaggacgtgcaggaccccagcgtgttcgtgaccttccccctggaggaggacgagaccgtgagcctggtggcctggaccaccaccccctggaccctgcccagcaacctggccgtgtgcgtgaaccccgagatgcagtacgtgaagatcaaggacgtggccagaggcagactgctgatcctgatggaggccagactgagcgccctgtacaagctggagagcgactacgagatcctggagagattccccggcgcctacctgaagggcaagaagtacagacccctgttcgactacttcctgaagtgcaaggagaacggcgccttcaccgtgctggtggacaactacgtgaaggaggaggagggcaccggcgtggtgcaccaggccccctacttcggcgccgaggactacagagtgtgcatggacttcaacatcatcagaaaggacagcctgcccgtgtgccccgtggacgccagcggctgcttcaccaccgaggtgaccgacttcgccggccagtacgtgaaggacgccgacaagagcatcatcagaaccctgaaggagcagggcagactgctggtggccaccaccttcacccacagctaccccttctgctggagaagcgacacccccctgatctacaaggccgtgcccagctggttcgtgagagtggagaacatggtggaccagctgctgagaaacaacgacctgtgctactgggtgcccgagctggtgagagagaagagattcggcaactggctgaaggacgccagagactggaccatcagcagaaacagatactggggcacccccatccccctgtgggtgagcgacgacttcgaggaggtggtgtgcatcggcagcgtggccgagctggaggagctgagcggcgccaagatcagcgacctgcacagagagagcgtggaccacctgaccatccccagcagatgcggcaagggcagcctgcacagaatcagcgaggtgttcgactgctggttcgagagcggcagcatgccctacgcccaggtgcactaccccttcgagaacaagagagagttcgaggacgccttccccgccgacttcatcgccgagggcatcgaccagaccagaggctggttctacaccctgctggtgctggccaccgccctgttcggccagccccccttcaagaacgtgatcgtgaacggcctggtgctggccagcgacggccagaagatgagcaagagaaagaagaactaccccgaccccgtgagcatcatccagaagtacggcgccgacgccctgagactgtacctgatcaacagccccgtggtgagagccgagaacctgagattcaaggaggagggcgtgagagacgtgctgaaggacgtgctgctgccctggtacaacgcctacagattcctgatccagaacgtgctgagactgcagaaggaggaggagatcgagttcctgtacaacgagaacaccgtgagagagagccccaacatcaccgacagatggatcctgagcttcatgcagagcctgatcggcttcttcgagaccgagatggccgcctacagactgtacaccgtggtgcccagactggtgaagttcgtggacatcctgaccaactggtacgtgagaatgaacagaagaagactgaagggcgagaacggcatggaggactgcgtgatggccctggagaccctgttcagcgtgctgctgagcctgtgcagactgatggccccctacacccccttcctgaccgagctgatgtaccagaacctgaaggtgctgatcgaccccgtgagcgtgcaggacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagtaccccctgaaggagatcgtggtgatccaccaggaccccgaggccctgaaggacatcaagagcctggagaagtacatcatcgaggagctgaacgtgagaaaggtgaccctgagcaccgacaagaacaagtacggcatcagactgagagccgagcccgaccacatggtgctgggcaagagactgaagggcgccttcaaggccgtgatgaccagcatcaagcagctgagcagcgaggagctggagcagttccagaagaccggcaccatcgtggtggagggccacgagctgcacgacgaggacatcagactgatgtacaccttcgaccaggccaccggcggcaccgcccagttcgaggcccacagcgacgcccaggccctggtgctgctggacgtgacccccgaccagagcatggtggacgagggcatggccagagaggtgatcaacagaatccagaagctgagaaagaagtgcaacctggtgcccaccgacgagatcaccgtgtactacaaggccaagagcgagggcacctacctgaacagcgtgatcgagagccacaccgagttcatcttcaccaccatcaaggcccccctgaagccctaccccgtgagccccagcgacaaggtgctgatccaggagaagacccagctgaagggcagcgagctggagatcaccctgaccagaggcagcagcctgcccggccccgcctgcgcctacgtgaacctgaacatctgcgccaacggcagcgagcagggcggcgtgctgctgctggagaaccccaagggcgacaacagactggacctgctgaagctgaagagcgtggtgaccagcatcttcggcgtgaagaacaccgagctggccgtgttccacgacgagaccgagatccagaaccagaccgacctgctgagcctgagcggcaagaccctgtgcgtgaccgccggcagcgcccccagcctgatcaacagcagcagcaccctgctgtgccagtacatcaacctgcagctgctgaacgccaagccccaggagtgcctgatgggcaccgtgggcaccctgctgctggagaaccccctgggccagaacggcctgacccaccagggcctgctgtacgaggccgccaaggtgttcggcctgagaagcagaaagctgaagctgttcctgaacgagacccagacccaggagatcaccgaggacatccccgtgaagaccctgaacatgaagaccgtgtacgtgagcgtgctgcccaccaccgccgacttctag

SEQ ID NO: 85841 - DNA, 3729 bp, Artificial Sequence
  Description of Artificial Sequence: Synthetic coding sequence
atgctgcagcaggtgcccgagaacatcaacttccccgccgaggaggagaagatcctggagttctggaccgagttcaactgcttccaggagtgcctgaagcagagcaagcacaagcccaagttcaccttctacgacggcccccccttcgccaccggcctgccccactacggccacatcctggccggcaccatcaaggacatcgtgaccagatacgcccaccagagcggcttccacgtggacagaagattcggctgggactgccacggcctgcccgtggagtacgagatcgacaagaccctgggcatcagaggccccgaggacgtggccaagatgggcatcaccgagtacaacaaccagtgcagagccatcgtgatgagatacagcgccgagtggaagagcaccgtgagcagactgggcagatggatcgacttcgacaacgactacaagaccctgtacccccagttcatggagagcgtgtggtgggtgttcaagcagctgtacgacaagggcctggtgtacagaggcgtgaaggtgatgcccttcagcaccgcctgcaacacccccctgagcaacttcgagagccaccagaactacaaggacgtgcaggaccccagcgtgttcgtgaccttccccctggaggaggacgagaccgtgagcctggtggcctggaccaccaccccctggaccctgcccagcaacctggccgtgtgcgtgaaccccgagatgcagtacgtgaagatcaaggacgtggccagaggcagactgctgatcctgatggaggccagactgagcgccctgtacaagctggagagcgactacgagatcctggagagattccccggcgcctacctgaagggcaagaagtacagacccctgttcgactacttcctgaagtgcaaggagaacggcgccttcaccgtgctggtggacaactacgtgaaggaggaggagggcaccggcgtggtgcaccaggccccctacttcggcgccgaggactacagagtgtgcatggacttcaacatcatcagaaaggacagcctgcccgtgtgccccgtggacgccagcggctgcttcaccaccgaggtgaccgacttcgccggccagtacgtgaaggacgccgacaagagcatcatcagaaccctgaaggagcagggcagactgctggtggccaccaccttcacccacagctaccccttctgctggagaagcgacacccccctgatctacaaggccgtgcccagctggttcgtgagagtggagaacatggtggaccagctgctgagaaacaacgacctgtgctactgggtgcccgagctggtgagagagaagagattcggcaactggctgaaggacgccagagactggaccatcagcagaaacagatactggggcacccccatccccctgtgggtgagcgacgacttcgaggaggtggtgtgcatcggcagcgtggccgagctggaggagctgagcggcgccaagatcagcgacctgcacagagagagcgtggaccacctgaccatccccagcagatgcggcaagggcagcctgcacagaatcagcgaggtgttcgactgctggttcgagagcggcagcatgccctacgcccaggtgcactaccccttcgagaacaagagagagttcgaggacgccttccccgccgacttcatcgccgagggcatcgaccagaccagaggctggttctacaccctgctggtgctggccaccgccctgttcggccagccccccttcaagaacgtgatcgtgaacggcctggtgctggccagcgacggccagaagatgagcaagagaaagaagaactaccccgaccccgtgagcatcatccagaagtacggcgccgacgccctgagactgtacctgatcaacagccccgtggtgagagccgagaacctgagattcaaggaggagggcgtgagagacgtgctgaaggacgtgctgctgccctggtacaacgcctacagattcctgatccagaacgtgctgagactgcagaaggaggaggagatcgagttcctgtacaacgagaacaccgtgagagagagccccaacatcaccgacagatggatcctgagcttcatgcagagcctgatcggcttcttcgagaccgagatggccgcctacagactgtacaccgtggtgcccagactggtgaagttcgtggacatcctgaccaactggtacgtgagaatgaacagaagaagactgaagggcgagaacggcatggaggactgcgtgatggccctggagaccctgttcagcgtgctgctgagcctgtgcagactgatggccccctacacccccttcctgaccgagctgatgtaccagaacctgaaggtgctgatcgaccccgtgagcgtgcaggacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagtaccccctgaaggagatcgtggtgatccaccaggaccccgaggccctgaaggacatcaagagcctggagaagtacatcatcgaggagctgaacgtgagaaaggtgaccctgagcaccgacaagaacaagtacggcatcagactgagagccgagcccgaccacatggtgctgggcaagagactgaagggcgccttcaaggccgtgatgaccagcatcaagcagctgagcagcgaggagctggagcagttccagaagaccggcaccatcgtggtggagggccacgagctgcacgacgaggacatcagactgatgtacaccttcgaccaggccaccggcggcaccgcccagttcgaggcccacagcgacgcccaggccctggtgctgctggacgtgacccccgaccagagcatggtggacgagggcatggccagagaggtgatcaacagaatccagaagctgagaaagaagtgcaacctggtgcccaccgacgagatcaccgtgtactacaaggccaagagcgagggcacctacctgaacagcgtgatcgagagccacaccgagttcatcttcaccaccatcaaggcccccctgaagccctaccccgtgagccccagcgacaaggtgctgatccaggagaagacccagctgaagggcagcgagctggagatcaccctgaccagaggcagcagcctgcccggccccgcctgcgcctacgtgaacctgaacatctgcgccaacggcagcgagcagggcggcgtgctgctgctggagaaccccaagggcgacaacagactggacctgctgaagctgaagagcgtggtgaccagcatcttcggcgtgaagaacaccgagctggccgtgttccacgacgagaccgagatccagaaccagaccgacctgctgagcctgagcggcaagaccctgtgcgtgaccgccggcagcgcccccagcctgatcaacagcagcagcaccctgctgtgccagtacatcaacctgcagctgctgaacgccaagccccaggagtgcctgatgggcaccgtgggcaccctgctgctggagaaccccctgggccagaacggcctgacccaccagggcctgctgtacgaggccgccaaggtgttcggcctgagaagcagaaagctgaagctgttcctgaacgagacccagacccaggagatcaccgaggacatcccctag

SEQ ID NO: 85842 - DNA, 993 bp, Artificial Sequence
  Description of Artificial Sequence: Synthetic coding sequence
atgctgcagcaggtgcccgagaacatcaacttccccgccgaggaggagaagatcctggagttctggaccgagttcaactgcttccaggagtgcctgaagcagagcaagcacaagcccaagttcaccttctacgacggcccccccttcgccaccggcctgccccactacggccacatcctggccggcaccatcaaggacatcgtgaccagatacgcccaccagagcggcttccacgtggacagaagattcggctgggactgccacggcctgcccgtggagtacgagatcgacaagaccctgggcatcagaggccccgaggacgtggccaagatgggcatcaccgagtacaacaaccagtgcagagccatcgtgatgagatacagcgccgagtggaagagcaccgtgagcagactgggcagatggatcgacttcgacaacgactacaagaccctgtacccccagttcatggagagcgtgtggtgggtgttcaagcagctgtacgacaagggcctggtgtacagaggcgtgaaggtgatgcccttcagcaccgcctgcaacacccccctgagcaacttcgagagccaccagaactacaaggacgtgcaggaccccagcgtgttcgtgaccttccccctggaggaggacgagaccgtgagcctggtggcctggaccaccaccccctggaccctgcccagcaacctggccgtgtgcgtgaaccccgagatgcagtacgtgaagatcaaggacgtggccagaggcagactgctgatcctgatggaggccagactgagcgccctgtacaagctggagagcgactacgagatcctggagagattccccggcgcctacctgaagggcaagaagtacagacccctgttcgactacttcctgaagtgcaaggagaacggcgccttcaccgtgctggtggacaactacgtgaaggaggaggagggcaccggcgtggtgcaccaggccccctacttcggcgcctag

SEQ ID NO: 85843 - DNA, 513 bp, Artificial Sequence
  Description of Artificial Sequence: Synthetic coding sequence
atggccccctacacccccttcctgaccgagctgatgtaccagaacctgaaggtgctgatcgaccccgtgagcgtgcaggacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagctgaagggcagcgagctggagatcaccctgaccagaggcagcagcctgcccggccccgcctgcgcctacgtgaacctgaacatctgcgccaacggcagcgagcagggcggcgtgctgctgctggagaaccccaagggcgacaacagactggacctgctgaagctgaagagcgtggtgaccagcatcttcggcgtgaagaacaccgagctggccgtgttccacgacgagaccgagatccagaaccagaccgacctgctgagcctgagcggcaagaccctgtgctag

SEQ ID NO: 85844 - DNA, 3789 bp, Artificial Sequence; identical to SEQ ID NO: 85840
  Description of Artificial Sequence: Synthetic coding sequence

SEQ ID NO: 85845 - DNA, 3459 bp, Artificial Sequence
  Description of Artificial Sequence: Synthetic coding sequence
atgggcatcaccgagtacaacaaccagtgcagagccatcgtgatgagatacagcgccgagtggaagagcaccgtgagcagactgggcagatggatcgacttcgacaacgactacaagaccctgtacccccagttcatggagagcgtgtggtgggtgttcaagcagctgtacgacaagggcctggtgtacagaggcgtgaaggtgatgcccttcagcaccgcctgcaacacccccctgagcaacttcgagagccaccagaactacaaggacgtgcaggaccccagcgtgttcgtgaccttccccctggaggaggacgagaccgtgagcctggtggcctggaccaccaccccctggaccctgcccagcaacctggccgtgtgcgtgaaccccgagatgcagtacgtgaagatcaaggacgtggccagaggcagactgctgatcctgatggaggccagactgagcgccctgtacaagctggagagcgactacgagatcctggagagattccccggcgcctacctgaagggcaagaagtacagacccctgttcgactacttcctgaagtgcaaggagaacggcgccttcaccgtgctggtggacaactacgtgaaggaggaggagggcaccggcgtggtgcaccaggccccctacttcggcgccgaggactacagagtgtgcatggacttcaacatcatcagaaaggacagcctgcccgtgtgccccgtggacgccagcggctgcttcaccaccgaggtgaccgacttcgccggccagtacgtgaaggacgccgacaagagcatcatcagaaccctgaaggagcagggcagactgctggtggccaccaccttcacccacagctaccccttctgctggagaagcgacacccccctgatctacaaggccgtgcccagctggttcgtgagagtggagaacatggtggaccagctgctgagaaacaacgacctgtgctactgggtgcccgagctggtgagagagaagagattcggcaactggctgaaggacgccagagactggaccatcagcagaaacagatactggggcacccccatccccctgtgggtgagcgacgacttcgaggaggtggtgtgcatcggcagcgtggccgagctggaggagctgagcggcgccaagatcagcgacctgcacagagagagcgtggaccacctgaccatccccagcagatgcggcaagggcagcctgcacagaatcagcgaggtgttcgactgctggttcgagagcggcagcatgccctacgcccaggtgcactaccccttcgagaacaagagagagttcgaggacgccttccccgccgacttcatcgccgagggcatcgaccagaccagaggctggttctacaccctgctggtgctggccaccgccctgttcggccagccccccttcaagaacgtgatcgtgaacggcctggtgctggccagcgacggccagaagatgagcaagagaaagaagaactaccccgaccccgtgagcatcatccagaagtacggcgccgacgccctgagactgtacctgatcaacagccccgtggtgagagccgagaacctgagattcaaggaggagggcgtgagagacgtgctgaaggacgtgctgctgccctggtacaacgcctacagattcctgatccagaacgtgctgagactgcagaaggaggaggagatcgagttcctgtacaacgagaacaccgtgagagagagccccaacatcaccgacagatggatcctgagcttcatgcagagcctgatcggcttcttcgagaccgagatggccgcctacagactgtacaccgtggtgcccagactggtgaagttcgtggacatcctgaccaactggtacgtgagaatgaacagaagaagactgaagggcgagaacggcatggaggactgcgtgatggccctggagaccctgttcagcgtgctgctgagcctgtgcagactgatggccccctacacccccttcctgaccgagctgatgtaccagaacctgaaggtgctgatcgaccccgtgagcgtgcaggacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagtaccccctgaaggagatcgtggtgatccaccaggaccccgaggccctgaaggacatcaagagcctggagaagtacatcatcgaggagctgaacgtgagaaaggtgaccctgagcaccgacaagaacaagtacggcatcagactgagagccgagcccgaccacatggtgctgggcaagagactgaagggcgccttcaaggccgtgatgaccagcatcaagcagctgagcagcgaggagctggagcagttccagaagaccggcaccatcgtggtggagggccacgagctgcacgacgaggacatcagactgatgtacaccttcgaccaggccaccggcggcaccgcccagttcgaggcccacagcgacgcccaggccctggtgctgctggacgtgacccccgaccagagcatggtggacgagggcatggccagagaggtgatcaacagaatccagaagctgagaaagaagtgcaacctggtgcccaccgacgagatcaccgtgtactacaaggccaagagcgagggcacctacctgaacagcgtgatcgagagccacaccgagttcatcttcaccaccatcaaggcccccctgaagccctaccccgtgagccccagcgacaaggtgctgatccaggagaagacccagctgaagggcagcgagctggagatcaccctgaccagaggcagcagcctgcccggccccgcctgcgcctacgtgaacctgaacatctgcgccaacggcagcgagcagggcggcgtgctgctgctggagaaccccaagggcgacaacagactggacctgctgaagctgaagagcgtggtgaccagcatcttcggcgtgaagaacaccgagctggccgtgttccacgacgagaccgagatccagaaccagaccgacctgctgagcctgagcggcaagaccctgtgcgtgaccgccggcagcgcccccagcctgatcaacagcagcagcaccctgctgtgccagtacatcaacctgcagctgctgaacgccaagccccaggagtgcctgatgggcaccgtgggcaccctgctgctggagaaccccctgggccagaacggcctgacccaccagggcctgctgtacgaggccgccaaggtgttcggcctgagaagcagaaagctgaagctgttcctgaacgagacccagacccaggagatcaccgaggacatccccgtgaagaccctgaacatgaagaccgtgtacgtgagcgtgctgcccaccaccgccgacttctag

SEQ ID NO: 85846 - DNA, 750 bp, Artificial Sequence
  Description of Artificial Sequence: Synthetic coding sequence
atggccccctacacccccttcctgaccgagctgatgtaccagaacctgaaggtgctgatcgaccccgtgagcgtgcaggacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagtaccccctgaaggagatcgtggtgatccaccaggaccccgaggccctgaaggacatcaagagcctggagaagtacatcatcgaggagctgaacgtgagaaaggtgaccctgagcaccgacaagaacaagtacggcatcagactgagagccgagcccgaccacatggtgctgggcaagagactgaagggcgccttcaaggccgtgatgaccagcatcaagcagctgagcagcgaggagctggagcagttccagaagaccggcaccatcgtggtggagggccacgagctgcacgacgaggacatcagactgatgtacaccttcgaccaggccaccggcggcaccgcccagttcgaggcccacagcgacgcccaggccctggtgctgctggacgtgacccccgaccagagcatggtggacgagggcatggccagagaggtgatcaacagaatccagaagctgagaaagaagtgcaacctggtgcccaccgacgagatcaccgtgtactacaaggccaagagctag

SEQ ID NO: 85847 - DNA, 513 bp, Artificial Sequence; identical to SEQ ID NO: 85843
  Description of Artificial Sequence: Synthetic coding sequence

SEQ ID NO: 85848 - DNA, 816 bp, Artificial Sequence
  Description of Artificial Sequence: Synthetic coding sequence
atgatggtgctgctgctgcagctggactgcctgaccatggacatctacctgagagacaaggacaccctgagcatccactacctgatgctgcccagagtgagagaggagctgatcgacaagaagaccgagagcgccgtgagccagatgcagagcgtgatcgagctgggcagagtgatcagagacagaaagaccatccccatcaagctgaagggcagcgagctggagatcaccctgaccagaggcagcagcctgcccggccccgcctgcgcctacgtgaacctgaacatctgcgccaacggcagcgagcagggcggcgtgctgctgctggagaaccccaagggcgacaacagactggacctgctgaagctgaagagcgtggtgaccagcatcttcggcgtgaagaacaccgagctggccgtgttccacgacgagaccgagatccagaaccagaccgacctgctgagcctgagcggcaagaccctgtgcgtgaccgccggcagcgcccccagcctgatcaacagcagcagcaccctgctgtgccagtacatcaacctgcagctgctgaacgccaagccccaggagtgcctgatgggcaccgtgggcaccctgctgctggagaaccccctgggccagaacggcctgacccaccagggcctgctgtacgaggccgccaaggtgttcggcctgagaagcagaaagctgaagctgttcctgaacgagacccagacccaggagatcaccgaggacatccccgtgaagaccctgaacatgaagaccgtgtacgtgagcgtgctgcccaccaccgccgacttctag

SEQ ID NO: 85849 - DNA, 3039 bp, Artificial Sequence
  Description of Artificial Sequence: Synthetic coding sequence
atgagatggggcctgagacccagaggccccggcgccgccgccctggccaccgccagaagcctgtggggcacccccagactgccctgcagccccggctggcagggcgccaccaagagactgctggtgagaagcgtgagcggcgccagcaaccaccagcccaacagcaacagcggcagatacagagacaccgtgctgctgccccagaccagcttccccatgaagctgctgggcagacagcagcccgacaccgagctggagatccagcagaagtgcggcttcagcgagctgtacagctggcagagagagagaaaggtgaagaccgagttctgcctgcacgacggccccccctacgccaacggcgacccccacgtgggccacgccctgaacaagatcctgaaggacatcgccaacagattccacatgatgaacggcagcaagatccacttcgtgcccggctgggactgccacggcctgcccatcgagatcaaggtgctgagcgagctgggcagagaggcccagaacctgagcgccatggagatcagaaagaaggccagaagcttcgccaaggccgccatcgagaagcagaagagcgccttcatcagatggggcatcatggccgactggaacaactgctactacaccttcgacggcaagtacgaggccaagcagctgagaaccttctaccagatgtacgacaagggcctggtgtacagaagctacaagcccgtgttctggagccccagcagcagaaccgccctggccgaggccgagctggagtacaaccccgagcacgtgagcagaagcatctacgtgaagttccccctgctgaagcccagccccaagctggccagcctgatcgacggcagcagccccgtgagcatcctggtgtggaccacccagccctggaccatccccgccaacgaggccgtgtgctacatgcccgagagcaagtacgccgtggtgaagtgcagcaagagcggcgacctgtacgtgctggccgccgacaaggtggccagcgtggccagcaccctggagaccaccttcgagaccatcagcaccctgagcggcgtggacctggagaacggcacctgcagccaccccctgatccccgacaaggccagccccctgctgcccgccaaccacgtgaccatggccaagggcaccggcctggtgcacaccgcccccgcccacggcatggaggactacggcgtggccagccagcacaacctgcccatggactgcctggtggacgaggacggcgtgttcaccgacgtggccggccccgagctgcagaacaaggccgtgctggaggagggcaccgacgtggtgatcaagatgctgcagaccgccaagaacctgctgaaggaggagaagctggtgcacagctacccctacgactggagaaccaagaagcccgtggtgatcagagccagcaagcagtggttcatcaacatcaccgacatcaagaccgccgccaaggagctgctgaagaaggtgaagttcatccccggcagcgccctgaacggcatggtggagatgatggacagaagaccctactggtgcatcagcagacagagagtgtggggcgtgcccatccccgtgttccaccacaagaccaaggacgagtacctgatcaacagccagaccaccgagcacatcgtgaagctggtggagcagcacggcagcgacatctggtggaccctgccccccgagcagctgctgcccaaggaggtgctgagcgaggtgggcggccccgacgccctggagtacgtgcccggccaggacatcctggacatctggttcgacagcggcaccagctggagctacgtgctgcccggccccgaccagagagccgacctgtacctggagggcaaggaccagctgggcggctggttccagagcagcctgctgaccagcgtggccgccagaaagagagccccctacaagaccgtgatcgtgcacggcttcaccctgggcgagaagggcgagaagatgagcaagagcctgggcaacgtgatccaccccgacgtggtggtgaacggcggccaggaccagagcaaggagcccccctacggcgccgacgtgctgagatggtgggtggccgacagcaacgtgttcaccgaggtggccatcggccccagcgtgctgaacgccgccagagacgacatcagcaagctgagaaacaccctgagattcctgctgggcaacgtggccgacttcaaccccgagaccgacagcatccccgtgaacgacatgtacgtgatcgaccagtacatgctgcacctgctgcaggacctggccaacaagatcaccgagctgtacaagcagtacgacttcggcaaggtggtgagactgctgagaaccttctacaccagagagctgagcaacttctacttcagcatcatcaaggacagactgtactgcgagaaggagaacgaccccaagagaagaagctgccagaccgccctggtggagatcctggacgtgatcgtgagaagcttcgcccccatcctgccccacctggccgaggaggtgttccagcacatcccctacatcaaggagcccaagagcgtgttcagaaccggctggatcagcaccagcagcatctggaagaagcccggcctggaggaggccgtggagagcgcctgcgccatgagagacagcttcctgggcagcatccccggcaagaacgccgccgagtacaaggtgatcaccgtgatcgagcccggcctgctgttcgagatcatcgagatgctgcagagcgaggagaccagcagcaccagccagctgaacgagctgatgatggccagcgagagcaccctgctggcccaggagcccagagagatgaccgccgacgtgatcgagctgaagggcaagttcctgatcaacctggagggcggcgacatcagagaggagagcagctacaaggtgatcgtgatgcccaccaccaaggagaagtgccccagatgctggaagtacaccgccgagagcagcgacaccctgtgccccagatgcgccgaggtggtgagcggcaagtag

SEQ ID NO: 85850 - DNA, 2823 bp, Artificial Sequence
  Description of Artificial Sequence: Synthetic coding sequence
atgaagctgctgggcagacagcagcccgacaccgagctggagatccagcagaagtgcggcttcagcgagctgtacagctggcagagagagagaaaggtgaagaccgagttctgcctgcacgacggccccccctacgccaacggcgacccccacgtgggccacgccctgaacaagatcctgaaggacatcgccaacagattccacatgatgaacggcagcaagatccacttcgtgcccggctgggactgccacggcctgcccatcgagatcaaggtgctgagcgagctgggcagagaggcccagaacctgagcgccatggagatcagaaagaaggccagaagcttcgccaaggccgccatcgagaagcagaagagcgccttcatcagatggggcatcatggccgactggaacaactgctactacaccttcgacggcaagtacgaggccaagcagctgagaaccttctaccagatgtacgacaagggcctggtgtacagaagctacaagcccgtgttctggagccccagcagcagaaccgccctggccgaggccgagctggagtacaaccccgagcacgtgagcagaagcatctacgtgaagttccccctgctgaagcccagccccaagctggccagcctgatcgacggcagcagccccgtgagcatcctggtgtggaccacccagccctggaccatccccgccaacgaggccgtgtgctacatgcccgagagcaagtacgccgtggtgaagtgcagcaagagcggcgacctgtacgtgctggccgccgacaaggtggccagcgtggccagcaccctggagaccaccttcgagaccatcagcaccctgagcggcgtggacctggagaacggcacctgcagccaccccctgatccccgacaaggccagccccctgctgcccgccaaccacgtgaccatggccaagggcaccggcctggtgcacaccgcccccgcccacggcatggaggactacggcgtggccagccagcacaacctgcccatggactgcctggtggacgaggacggcgtgttcaccgacgtggccggccccgagctgcagaacaaggccgtgctggaggagggcaccgacgtggtgatcaagatgctgcagaccgccaagaacctgctgaaggaggagaagctggtgcacagctacccctacgactggagaaccaagaagcccgtggtgatcagagccagcaagcagtggttcatcaacatcaccgacatcaagaccgccgccaaggagctgctgaagaaggtgaagttcatccccggcagcgccctgaacggcatggtggagatgatggacagaagaccctactggtgcatcagcagacagagagtgtggggcgtgcccatccccgtgttccaccacaagaccaaggacgagtacctgatcaacagccagaccaccgagcacatcgtgaagctggtggagcagcacggcagcgacatctggtggaccctgccccccgagcagctgctgcccaaggaggtgctgagcgaggtgggcggccccgacgccctggagtacgtgcccggccaggacatcctggacatctggttcgacagcggcaccagctggagctacgtgctgcccggccccgaccagagagccgacctgtacctggagggcaaggaccagctgggcggctggttccagagcagcctgctgaccagcgtggccgccagaaagagagccccctacaagaccgtgatcgtgcacggcttcaccctgggcgagaagggcgagaagatgagcaagagcctgggcaacgtgatccaccccgacgtggtggtgaacggcggccaggaccagagcaaggagcccccctacggcgccgacgtgctgagatggtgggtggccgacagcaacgtgttcaccgaggtggccatcggccccagcgtgctgaacgccgccagagacgacatcagcaagctgagaaacaccctgagattcctgctgggcaacgtggccgacttcaaccccgagaccgacagcatccccgtgaacgacatgtacgtgatcgaccagtacatgctgcacctgctgcaggacctggccaacaagatcaccgagctgtacaagcagtacgacttcggcaaggtggtgagactgctgagaaccttctacaccagagagctgagcaacttctacttcagcatcatcaaggacagactgtactgcgagaaggagaacgaccccaagagaagaagctgccagaccgccctggtggagatcctggacgtgatcgtgagaagcttcgcccccatcctgccccacctggccgaggaggtgttccagcacatcccctacatcaaggagcccaagagcgtgttcagaaccggctggatcagcaccagcagcatctggaagaagcccggcctggaggaggccgtggagagcgcctgcgccatgagagacagcttcctgggcagcatccccggcaagaacgccgccgagtacaaggtgatcaccgtgatcgagcccggcctgctgttcgagatcatcgagatgctgcagagcgaggagaccagcagcaccagccagctgaacgagctgatgatggccagcgagagcaccctgctggcccaggagcccagagagatgaccgccgacgtgatcgagctgaagggcaagttcctgatcaacctggagggcggcgacatcagagaggagagcagctacaaggtgatcgtgatgcccaccaccaaggagaagtgccccagatgctggaagtacaccgccgagagcagcgacaccctgtgccccagatgcgccgaggtggtgagcggcaagtag

SEQ ID NO: 85851 - DNA, 855 bp, Artificial Sequence
  Description of Artificial Sequence: Synthetic coding sequence
atggccggctgcgccgccagagccccccccggcagcgaggccagactgagcctggccaccttcctgctgggcgccagcgtgctggccctgcccctgctgaccagagccggcctgcagggcagaaccggcctggccctgtacgtggccggcctgaacgccctgctgctgctgctgtacagaccccccagataccagatcgccatcagagcctgcttcctgggcttcgtgttcggctgcggcaccctgctgagcttcagccagagcagctggagccacttcggctggtacatgtgcagcctgagcctgttccactacagcgagtacctggtgaccgccgtgaacaaccccaagagcctgagcctggacagcttcctgctgaaccacagcctggagtacaccgtggccgccctgagcagctggctggagttcaccctggagaacatcttctggcccgagctgaagcagatcacctggctgagcgtgaccggcctgctgatggtggtgttcggcgagtgcctgagaaaggccgccatgttcaccgccggcagcaacttcaaccacgtggtgcagaacgagaagagcgacacccacaccctggtgaccagcggcgtgtacgcctggttcagacaccccagctacgtgggctggttctactggagcatcggcacccaggtgatgctgtgcaaccccatctgcggcgtgagctacgccctgaccgtgtggagattcttcagagacagaaccgaggaggaggagatcagcctgatccacttcttcggcgaggagtacctggagtacaagaagagagtgcccaccggcctgcccttcatcaagggcgtgaaggtggacctgtag

SEQ ID NO: 85852 - DNA, 351 bp, Artificial Sequence
  Description of Artificial Sequence: Synthetic coding sequence
atggccggctgcgccgccagagccccccccggcagcgaggccagactgagcctggccaccttcctgctgggcgccagcgtgctggccctgcccctgctgaccagagccggcctgcagggcagaaccggcctggccctgtacgtggccggcctgaacgccctgctgctgctgctgtacagaccccccagataccagatcgccatcagagcctgcttcctgggcttcgtgttcggctgcggcaccctgctgagcttcagccagagcagctggagccacttcggctggagccacctggtgcacccccacagccactgcagaatcttcccctacaccatgatcagcgtgccctag

SEQ ID NO: 85853 - DNA, 567 bp, Artificial Sequence
  Description of Artificial Sequence: Synthetic coding sequence
atgtgcagcctgagcctgttccactacagcgagtacctggtgaccgccgtgaacaaccccaagagcctgagcctggacagcttcctgctgaaccacagcctggagtacaccgtggccgccctgagcagctggctggagttcaccctggagaacatcttctggcccgagctgaagcagatcacctggctgagcgtgaccggcctgctgatggtggtgttcggcgagtgcctgagaaaggccgccatgttcaccgccggcagcaacttcaaccacgtggtgcagaacgagaagagcgacacccacaccctggtgaccagcggcgtgtacgcctggttcagacaccccagctacgtgggctggttctactggagcatcggcacccaggtgatgctgtgcaaccccatctgcggcgtgagctacgccctgaccgtgtggagattcttcagagacagaaccgaggaggaggagatcagcctgatccacttcttcggcgaggagtacctggagtacaagaagagagtgcccaccggcctgcccttcatcaagggcgtgaaggtggacctgtag

SEQ ID NO: 85854 - DNA, 1272 bp, Artificial Sequence
  Description of Artificial Sequence: Synthetic coding sequence
atggccaccgccaccagactgctgggctggagagtggccagctggagactgagaccccccctggccggcttcgtgagccagagagcccacagcctgctgcccgtggacgacgccatcaacggcctgagcgaggagcagagacagctgagacagaccatggccaagttcctgcaggagcacctggcccccaaggcccaggagatcgacagaagcaacgagttcaagaacctgagagagttctggaagcagctgggcaacctgggcgtgctgggcatcaccgcccccgtgcagtacggcggcagcggcctgggctacctggagcacgtgctggtgatggaggagatcagcagagccagcggcgccgtgggcctgagctacggcgcccacagcaacctgtgcatcaaccagctggtgagaaacggcaacgaggcccagaaggagaagtacctgcccaagctgatcagcggcgagtacatcggcgccctggccatgagcgagcccaacgccggcagcgacgtggtgagcatgaagctgaaggccgagaagaagggcaaccactacatcctgaacggcaacaagttctggatcaccaacggccccgacgccgacgtgctgatcgtgtacgccaagaccgacctggccgccgtgcccgccagcagaggcatcaccgccttcatcgtggagaagggcatgcccggcttcagcaccagcaagaagctggacaagctgggcatgagaggcagcaacacctgcgagctgatcttcgaggactgcaagatccccgccgccaacatcctgggccacgagaacaagggcgtgtacgtgctgatgagcggcctggacctggagagactggtgctggccggcggccccctgggcctgatgcaggccgtgctggaccacaccatcccctacctgcacgtgagagaggccttcggccagaagatcggccacttccagctgatgcagggcaagatggccgacatgtacaccagactgatggcctgcagacagtacgtgtacaacgtggccaaggcctgcgacgagggccactgcaccgccaaggactgcgccggcgtgatcctgtacagcgccgagtgcgccacccaggtggccctggacggcatccagtgcttcggcggcaacggctacatcaacgacttccccatgggcagattcctgagagacgccaagctgtacgagatcggcgccggcaccagcgaggtgagaagactggtgatcggcagagccttcaacgccgacttccactag

SEQ ID NO: 85855 - DNA, 1191 bp, Artificial Sequence
  Description of Artificial Sequence: Synthetic coding sequence
atggccgagatggccaccgccaccagactgctgggctggagagtggccagctggagactgagaccccccctggccggcttcgtgagccagagagcccacagcctgctgcccgtggacgacgccatcaacggcctgagcgaggagcagagacaggagttctggaagcagctgggcaacctgggcgtgctgggcatcaccgcccccgtgcagtacggcggcagcggcctgggctacctggagcacgtgctggtgatggaggagatcagcagagccagcggcgccgtgggcctgagctacggcgcccacagcaacctgtgcatcaaccagctggtgagaaacggcaacgaggcccagaaggagaagtacctgcccaagctgatcagcggcgagtacatcggcgccctggccatgagcgagcccaacgccggcagcgacgtggtgagcatgaagctgaaggccgagaagaagggcaaccactacatcctgaacggcaacaagttctggatcaccaacggccccgacgccgacgtgctgatcgtgtacgccaagaccgacctggccgccgtgcccgccagcagaggcatcaccgccttcatcgtggagaagggcatgcccggcttcagcaccagcaagaagctggacaagctgggcatgagaggcagcaacacctgcgagctgatcttcgaggactgcaagatccccgccgccaacatcctgggccacgagaacaagggcgtgtacgtgctgatgagcggcctggacctggagagactggtgctggccggcggccccctgggcctgatgcaggccgtgctggaccacaccatcccctacctgcacgtgagagaggccttcggccagaagatcggccacttccagctgatgcagggcaagatggccgacatgtacaccagactgatggcctgcagacagtacgtgtacaacgtggccaaggcctgcgacgagggccactgcaccgccaaggactgcgccggcgtgatcctgtacagcgccgagtgcgccacccaggtggccctggacggcatccagtgcttcggcggcaacggctacatcaacgacttccccatgggcagattcctgagagacgccaagctgtacgagatcggcgccggcaccagcgaggtgagaagactggtgatcggcagagccttcaacgccgacttccactag

SEQ ID NO: 85856 - DNA, 1281 bp, Artificial Sequence
  Description of Artificial Sequence: Synthetic coding sequence
atggccgagatggccaccgccaccagactgctgggctggagagtggccagctggagactgagaccccccctggccggcttcgtgagccagagagcccacagcctgctgcccgtggacgacgccatcaacggcctgagcgaggagcagagacagctgagacagaccatggccaagttcctgcaggagcacctggcccccaaggcccaggagatcgacagaagcaacgagttcaagaacctgagagagttctggaagcagctgggcaacctgggcgtgctgggcatcaccgcccccgtgcagtacggcggcagcggcctgggctacctggagcacgtgctggtgatggaggagatcagcagagccagcggcgccgtgggcctgagctacggcgcccacagcaacctgtgcatcaaccagctggtgagaaacggcaacgaggcccagaaggagaagtacctgcccaagctgatcagcggcgagtacatcggcgccctggccatgagcgagcccaacgccggcagcgacgtggtgagcatgaagctgaaggccgagaagaagggcaaccactacatcctgaacggcaacaagttctggatcaccaacggccccgacgccgacgtgctgatcgtgtacgccaagaccgacctggccgccgtgcccgccagcagaggcatcaccgccttcatcgtggagaagggcatgcccggcttcagcaccagcaagaagctggacaagctgggcatgagaggcagcaacacctgcgagctgatcttcgaggactgcaagatccccgccgccaacatcctgggccacgagaacaagggcgtgtacgtgctgatgagcggcctggacctggagagactggtgctggccggcggccccctgggcctgatgcaggccgtgctggaccacaccatcccctacctgcacgtgagagaggccttcggccagaagatcggccacttccagctgatgcagggcaagatggccgacatgtacaccagactgatggcctgcagacagtacgtgtacaacgtggccaaggcctgcgacgagggccactgcaccgccaaggactgcgccggcgtgatcctgtacagcgccgagtgcgccacccaggtggccctggacggcatccagtgcttcggcggcaacggctacatcaacgacttccccatgggcagattcctgagagacgccaagctgtacgagatcggcgccggcaccagcgaggtgagaagactggtgatcggcagagccttcaacgccgacttccactag

SEQ ID NO: 85857 - DNA, 1716 bp, Artificial Sequence
  Description of Artificial Sequence: Synthetic coding sequence
atgagagccctgagagacagagccggcctgctgctgtgcgtgctgctgctggccgccctgctggaggccgccctgggcctgcccgtgaagaagcccagactgagaggccccagacccggcagcctgaccagactggccgaggtgagcgccagccccgaccccagacccctgaaggaggaggaggaggcccccctgctgcccagaacccacctgcaggccgagccccaccagcacggctgctggaccgtgaccgagcccgccgccatgacccccggcaacgccaccccccccagaacccccgaggtgacccccctgagactggagctgcagaagctgcccggcctggccaacaccaccctgagcacccccaaccccgacacccaggccagcgccagccccgaccccagacccctgagagaggaggaggaggccagactgctgcccagaacccacctgcaggccgagctgcaccagcacggctgctggaccgtgaccgagcccgccgccctgacccccggcaacgccaccccccccagaacccaggaggtgacccccctgctgctggagctgcagaagctgcccgagctggtgcacgccaccctgagcacccccaaccccgacaaccaggtgaccatcaaggtggtggaggacccccaggccgaggtgagcatcgacctgctggccgagcccagcaacccccccccccaggacaccctgagctggctgcccgccctgtggagcttcctgtggggcgactacaagggcgaggagaaggacagagcccccggcgagaagggcgaggagaaggaggaggacgaggactaccccagcgaggacatcgagggcgaggaccaggaggacaaggaggaggacgaggaggagcaggccctgtggttcaacggcaccaccgacaactgggaccagggctggctggcccccggcgactgggtgttcaaggacagcgtgagctacgactacgagccccagaaggagtggagcccctggagcccctgcagcggcaactgcagcaccggcaagcagcagagaaccagaccctgcggctacggctgcaccgccaccgagaccagaacctgcgacctgcccagctgccccggcaccgaggacaaggacaccctgggcctgcccagcgaggagtggaagctgctggccagaaacgccaccgacatgcacgaccaggacgtggacagctgcgagaagtggctgaactgcaagagcgacttcctgatcaagtacctgagccagatgctgagagacctgcccagctgcccctgcgcctaccccctggaggccatggacagccccgtgagcctgcaggacgagcaccagggcagaagcttcagatggagagacgccagcggccccagagagagactggacatctaccagcccaccgccagattctgcctgagaagcatgctgagcggcgagagcagcaccctggccgcccagcactgctgctacgacgaggacagcagactgctgaccagaggcaagggcgccggcatgcccaacctgatcagcaccgacttcagccccaagctgcacttcaagttcgacaccaccccctggatcctgtgcaagggcgactggagcagactgcacgccgtgctgccccccaacaacggcagagcctgcaccgacaaccccctggaggaggagtacctggcccagctgcaggaggccaaggagtactag

SEQ ID NO: 85858 - DNA, 1452 bp, Artificial Sequence
  Description of Artificial Sequence: Synthetic coding sequence
atgacccccggcaacgccaccccccccagaacccccgaggtgacccccctgagactggagctgcagaagctgcccggcctggccaacaccaccctgagcacccccaaccccgacacccaggccagcgccagccccgaccccagacccctgagagaggaggaggaggccagactgctgcccagaacccacctgcaggccgagctgcaccagcacggctgctggaccgtgaccgagcccgccgccctgacccccggcaacgccaccccccccagaacccaggaggtgacccccctgctgctggagctgcagaagctgcccgagctggtgcacgccaccctgagcacccccaaccccgacaaccaggtgaccatcaaggtggtggaggacccccaggccgaggtgagcatcgacctgctggccgagcccagcaacccccccccccaggacaccctgagctggctgcccgccctgtggagcttcctgtggggcgactacaagggcgaggagaaggacagagcccccggcgagaagggcgaggagaaggaggaggacgaggactaccccagcgaggacatcgagggcgaggaccaggaggacaaggaggaggacgaggaggagcaggccctgtggttcaacggcaccaccgacaactgggaccagggctggctggcccccggcgactgggtgttcaaggacagcgtgagctacgactacgagccccagaaggagtggagcccctggagcccctgcagcggcaactgcagcaccggcaagcagcagagaaccagaccctgcggctacggctgcaccgccaccgagaccagaacctgcgacctgcccagctgccccggcaccgaggacaaggacaccctgggcctgcccagcgaggagtggaagctgctggccagaaacgccaccgacatgcacgaccaggacgtggacagctgcgagaagtggctgaactgcaagagcgacttcctgatcaagtacctgagccagatgctgagagacctgcccagctgcccctgcgcctaccccctggaggccatggacagccccgtgagcctgcaggacgagcaccagggcagaagcttcagatggagagacgccagcggccccagagagagactggacatctaccagcccaccgccagattctgcctgagaagcatgctgagcggcgagagcagcaccctggccgcccagcactgctgctacgacgaggacagcagactgctgaccagaggcaagggcgccggcatgcccaacctgatcagcaccgacttcagccccaagctgcacttcaagttcgacaccaccccctggatcctgtgcaagggcgactggagcagactgcacgccgtgctgccccccaacaacggcagagcctgcaccgacaaccccctggaggaggagtacctggcccagctgcaggaggccaaggagtactag

SEQ ID NO: 85859 - DNA, 1473 bp, Artificial Sequence
  Description of Artificial Sequence: Synthetic coding sequence
atgagagccctgagagacagagccggcctgctgctgtgcgtgctgctgctggccgccctgctggaggccgccctgggcctgcccgtgaagaagcccagactgagaggccccagacccggcagcctgaccagactggccgaggtgagcgccagccccgaccccagacccctgaaggaggaggaggaggcccccctgctgcccagaacccacctgcaggccgagccccaccagcacggctgctggaccgtgaccgagcccgccgccatgacccccggcaacgccaccccccccagaacccccgaggtgacccccctgagactggagctgcagaagctgcccggcctggccaacaccaccctgagcacccccaaccccgacacccaggtgaccatcaaggtggtggaggacccccaggccgaggtgagcatcgacctgctggccgagcccagcaacccccccccccaggacaccctgagctggctgcccgccctgtggagcttcctgtggggcgactacaagggcgaggagaaggacagagcccccggcgagaagggcgaggagaaggaggaggacgaggactaccccagcgaggacatcgagggcgaggaccaggaggacaaggaggaggacgaggaggagcaggccctgtggttcaacggcaccaccgacaactgggaccagggctggctggcccccggcgactgggtgttcaaggacagcgtgagctacgactacgagccccagaaggagtggagcccctggagcccctgcagcggcaactgcagcaccggcaagcagcagagaaccagaccctgcggctacggctgcaccgccaccgagaccagaacctgcgacctgcccagctgccccggcaccgaggacaaggacaccctgggcctgcccagcgaggagtggaagctgctggccagaaacgccaccgacatgcacgaccaggacgtggacagctgcgagaagtggctgaactgcaagagcgacttcctgatcaagtacctgagccagatgctgagagacctgcccagctgcccctgcgcctaccccctggaggccatggacagccccgtgagcctgcaggacgagcaccagggcagaagcttcagatggagagacgccagcggccccagagagagactggacatctaccagcccaccgccagattctgcctgagaagcatgctgagcggcgagagcagcaccctggccgcccagcactgctgctacgacgaggacagcagactgctgaccagaggcaagggcgccggcatgcccaacctgatcagcaccgacttcagccccaagctgcacttcaagttcgacaccaccccctggatcctgtgcaagggcgactggagcagactgcacgccgtgctgccccccaacaacggcagagcctgcaccgacaaccccctggaggaggagtacctggcccagctgcaggaggccaaggagtactag

SEQ ID NO: 85860 - DNA, 1473 bp, Artificial Sequence
  Description of Artificial Sequence: Synthetic coding sequence
atgagagccctgagagacagagccggcctgctgctgtgcgtgctgctgctggccgccctgctggaggccgccctgggcctgcccgtgaagaagcccagactgagaggccccagacccggcagcctgaccagactggccgaggccagcgccagccccgaccccagacccctgagagaggaggaggaggccagactgctgcccagaacccacctgcaggccgagctgcaccagcacggctgctggaccgtgaccgagcccgccgccctgacccccggcaacgccaccccccccagaacccaggaggtgacccccctgctgctggagctgcagaagctgcccgagctggtgcacgccaccctgagcacccccaaccccgacaaccaggtgaccatcaaggtggtggaggacccccaggccgaggtgagcatcgacctgctggccgagcccagcaacccccccccccaggacaccctgagctggctgcccgccctgtggagcttcctgtggggcgactacaagggcgaggagaaggacagagcccccggcgagaagggcgaggagaaggaggaggacgaggactaccccagcgaggacatcgagggcgaggaccaggaggacaaggaggaggacgaggaggagcaggccctgtggttcaacggcaccaccgacaactgggaccagggctggctggcccccggcgactgggtgttcaaggacagcgtgagctacgactacgagccccagaaggagtggagcccctggagcccctgcagcggcaactgcagcaccggcaagcagcagagaaccagaccctgcggctacggctgcaccgccaccgagaccagaacctgcgacctgcccagctgccccggcaccgaggacaaggacaccctgggcctgcccagcgaggagtggaagctgctggccagaaacgccaccgacatgcacgaccaggacgtggacagctgcgagaagtggctgaactgcaagagcgacttcctgatcaagtacctgagccagatgctgagagacctgcccagctgcccctgcgcctaccccctggaggccatggacagccccgtgagcctgcaggacgagcaccagggcagaagcttcagatggagagacgccagcggccccagagagagactggacatctaccagcccaccgccagattctgcctgagaagcatgctgagcggcgagagcagcaccctggccgcccagcactgctgctacgacgaggacagcagactgctgaccagaggcaagggcgccggcatgcccaacctgatcagcaccgacttcagccccaagctgcacttcaagttcgacaccaccccctggatcctgtgcaagggcgactggagcagactgcacgccgtgctgccccccaacaacggcagagcctgcaccgacaaccccctggaggaggagtacctggcccagctgcaggaggccaaggagtactag

SEQ ID NO: 85861 - DNA, 879 bp, Artificial Sequence
  Description of Artificial Sequence: Synthetic coding sequence
atgagagccctgagagacagagccggcctgctgctgtgcgtgctgctgctggccgccctgctggaggccgccctgggcctgcccgtgaagaagcccagactgagaggccccagacccggcagcctgaccagactggccgaggtgagcgccagccccgaccccagacccctgaaggaggaggaggaggcccccctgctgcccagaacccacctgcaggccgagccccaccagcacggctgctggaccgtgaccgagcccgccgccatgacccccggcaacgccaccccccccagaacccccgaggtgacccccctgagactggagctgcagaagctgcccggcctggccaacaccaccctgagcacccccaaccccgacacccaggccagcgccagccccgaccccagacccctgagagaggaggaggaggccagactgctgcccagaacccacctgcaggccgagctgcaccagcacggctgctggaccgtgaccgagcccgccgccctgacccccggcaacgccaccccccccagaacccaggaggtgacccccctgctgctggagctgcagaagctgcccgagctggtgcacgccaccctgagcacccccaaccccgacaaccagaccatgagcctgagaagaagcggcgtgcccggcctgcccgccgtgggcaccgccgccctggccagcagcagaggcctgggccccgtggccatggccgccctgccccccagacccgtgcccgtgacctgcccccccgtgctggccctgagaaccagaaccccctgggccagccccgtgagaagcggcagcagctggcccgccatgctgagaacctgcatgatcaagatgtggaccgccgtgagaagcggctag

SEQ ID NO: 85862 - DNA, 924 bp, Artificial Sequence
  Description of Artificial Sequence: Synthetic coding sequence
atggccagaaacgccgagaaggccatgaccgccctggccagattcagacaggcccagctggaggagggcaaggtgaaggagagaagacccttcctggccagcgagtgcaccgagctgcccaaggccgagaagtggagaagacagatcatcggcgagatcagcaagaaggtggcccagatccagaacgccggcctgggcgagttcagaatcagagacctgaacgacgagatcaacaagctgctgagagagaagggccactgggaggtgagaatcaaggagctgggcggccccgactacggcaaggtgggccccaagatgctggaccacgagggcaaggaggtgcccggcaacagaggctacaagtacttcggcgccgccaaggacctgcccggcgtgagagagctgttcgagaaggagagacaggtgagatggctgatgcccgtgatccccgccctgtgggaggccgaggccggcggcagccaggccctgcccccccccagaaagaccagagccgagctgatgaaggccatcgacttcgagtactacggctacctggacgaggacgacggcgtgatcgtgcccctggagcaggagtacgagaagaagctgagagccgagctggtggagaagtggaaggccgagagagaggccagactggccagaggcgagaaggaggaggaggaggaggaggaggaggagatcaacatctacgccgtgaccgaggaggagagcgacgaggagggcagccaggagaagggcggcgacgacagccagcagaagttcatcgcccacgtgcccgtgcccagccagcaggagatcgaggaggccctggtgagaagaaagaagatggagctgctgcagaagtacgccagcgagaccctgcaggcccagagcgaggaggccagaagactgctgggctactag

SEQ ID NO: 85863 - DNA, 858 bp, Artificial Sequence
  Description of Artificial Sequence: Synthetic coding sequence
atggccagaaacgccgagaaggccatgaccgccctggccagattcagacaggcccagctggaggagggcaaggtgaaggagagaagacccttcctggccagcgagtgcaccgagctgcccaaggccgagaagtggagaagacagatcatcggcgagatcagcaagaaggtggcccagatccagaacgccggcctgggcgagttcagaatcagagacctgaacgacgagatcaacaagctgctgagagagaagggccactgggaggtgagaatcaaggagctgggcggccccgactacggcaaggtgggccccaagatgctggaccacgagggcaaggaggtgcccggcaacagaggctacaagtacttcggcgccgccaaggacctgcccggcgtgagagagctgttcgagaaggagcccctgcccccccccagaaagaccagagccgagctgatgaaggccatcgacttcgagtactacggctacctggacgaggacgacggcgtgatcgtgcccctggagcaggagtacgagaagaagctgagagccgagctggtggagaagtggaaggccgagagagaggccagactggccagaggcgagaaggaggaggaggaggaggaggaggaggagatcaacatctacgccgtgaccgaggaggagagcgacgaggagggcagccaggagaagggcggcgacgacagccagcagaagttcatcgcccacgtgcccgtgcccagccagcaggagatcgaggaggccctggtgagaagaaagaagatggagctgctgcagaagtacgccagcgagaccctgcaggcccagagcgaggaggccagaagactgctgggctactag

SEQ ID NO: 85864 - DNA, 2712 bp, Artificial Sequence
  Description of Artificial Sequence: Synthetic coding sequence
atgagcgacagcggcagccagctgggcagcatgggcagcctgaccatgaagagccagctgcagatcaccgtgatcagcgccaagctgaaggagaacaagaagaactggttcggccccagcccctacgtggaggtgaccgtggacggccagagcaagaagaccgagaagtgcaacaacaccaacagccccaagtggaagcagcccctgaccgtgatcgtgacccccgtgagcaagctgcacttcagagtgtggagccaccagaccctgaagagcgacgtgctgctgggcaccgccgccctggacatctacgagaccctgaagagcaacaacatgaagctggaggaggtggtggtgaccctgcagctgggcggcgacaaggagcccaccgagaccatcggcgacctgagcatctgcctggacggcctgcagctggagagcgaggtggtgaccaacggcgagaccacctgcagcgagaacggcgtgagcctgtgcctgcccagactggagtgcaacagcgccatcagcgcccactgcaacctgtgcctgcccggcctgagcgacagccccatcagcgccagcagagtggccggcttcaccggcgccagccagaacgacgacggcagcagaagcaaggacgagaccagagtgagcaccaacggcagcgacgaccccgaggacgccggcgccggcgagaacagaagagtgagcggcaacaacagccccagcctgagcaacggcggcttcaagcccagcagaccccccagacccagcagaccccccccccccacccccagaagacccgccagcgtgaacggcagccccagcgccaccagcgagagcgacggcagcagcaccggcagcctgccccccaccaacaccaacaccaacaccagcgagggcgccaccagcggcctgatcatccccctgaccatcagcggcggcagcggccccagacccctgaaccccgtgacccaggcccccctgccccccggctgggagcagagagtggaccagcacggcagagtgtactacgtggaccacgtggagaagagaaccacctgggacagacccgagcccctgccccccggctgggagagaagagtggacaacatgggcagaatctactacgtggaccacttcaccagaaccaccacctggcagagacccaccctggagagcgtgagaaactacgagcagtggcagctgcagagaagccagctgcagggcgccatgcagcagttcaaccagagattcatctacggcaaccaggacctgttcgccaccagccagagcaaggagttcgaccccctgggccccctgccccccggctgggagaagagaaccgacagcaacggcagagtgtacttcgtgaaccacaacaccagaatcacccagtgggaggaccccagaagccagggccagctgaacgagaagcccctgcccgagggctgggagatgagattcaccgtggacggcatcccctacttcgtggaccacaacagaagaaccaccacctacatcgaccccagaaccggcaagagcgccctggacaacggcccccagatcgcctacgtgagagacttcaaggccaaggtgcagtacttcagattctggtgccagcagctggccatgccccagcacatcaagatcaccgtgaccagaaagaccctgttcgaggacagcttccagcagatcatgagcttcagcccccaggacctgagaagaagactgtgggtgatcttccccggcgaggagggcctggactacggcggcgtggccagagagtggttcttcctgctgagccacgaggtgctgaaccccatgtactgcctgttcgagtacgccggcaaggacaactactgcctgcagatcaaccccgccagctacatcaaccccgaccacctgaagtacttcagattcatcggcagattcatcgccatggccctgttccacggcaagttcatcgacaccggcttcagcctgcccttctacaagagaatcctgaacaagcccgtgggcctgaaggacctggagagcatcgaccccgagttctacaacagcctgatctgggtgaaggagaacaacatcgaggagtgcgacctggagatgtacttcagcgtggacaaggagatcctgggcgagatcaagagccacgacctgaagcccaacggcggcaacatcctggtgaccgaggagaacaaggaggagtacatcagaatggtggccgagtggagactgagcagaggcgtggaggagcagacccaggccttcttcgagggcttcaacgagatcctgccccagcagtacctgcagtacttcgacgccaaggagctggaggtgctgctgtgcggcatgcaggagatcgacctgaacgactggcagagacacgccatctacagacactacgccagaaccagcaagcagatcatgtggttctggcagttcgtgaaggagatcgacaacgagaagagaatgagactgctgcagttcgtgaccggcacctgcagactgcccgtgggcggcttcgccgacctgatgggcagcaacggcccccagaagttctgcatcgagaaggtgggcaaggagaactggctgcccagaagccacacctgcttcaacagactggacctgcccccctacaagagctacgagcagctgaaggagaagctgctgttcgccatcgaggagaccgagggcttcggccaggagtag

SEQ ID NO: 85865 - DNA, 2589 bp, Artificial Sequence
  Description of Artificial Sequence: Synthetic coding sequence
atgagcgacagcggcagccagctgggcagcatgggcagcctgaccatgaagagccagctgcagatcaccgtgatcagcgccaagctgaaggagaacaagaagaactggttcggccccagcccctacgtggaggtgaccgtggacggccagagcaagaagaccgagaagtgcaacaacaccaacagccccaagtggaagcagcccctgaccgtgatcgtgacccccgtgagcaagctgcacttcagagtgtggagccaccagaccctgaagagcgacgtgctgctgggcaccgccgccctggacatctacgagaccctgaagagcaacaacatgaagctggaggaggtggtggtgaccctgcagctgggcggcgacaaggagcccaccgagaccatcggcgacctgagcatctgcctggacggcctgcagctggagagcgaggtggtgaccaacggcgagaccacctgcagcgagagcgccagccagaacgacgacggcagcagaagcaaggacgagaccagagtgagcaccaacggcagcgacgaccccgaggacgccggcgccggcgagaacagaagagtgagcggcaacaacagccccagcctgagcaacggcggcttcaagcccagcagaccccccagacccagcagaccccccccccccacccccagaagacccgccagcgtgaacggcagccccagcgccaccagcgagagcgacggcagcagcaccggcagcctgccccccaccaacaccaacaccaacaccagcgagggcgccaccagcggcctgatcatccccctgaccatcagcggcggcagcggccccagacccctgaaccccgtgacccaggcccccctgccccccggctgggagcagagagtggaccagcacggcagagtgtactacgtggaccacgtggagaagagaaccacctgggacagacccgagcccctgccccccggctgggagagaagagtggacaacatgggcagaatctactacgtggaccacttcaccagaaccaccacctggcagagacccaccctggagagcgtgagaaactacgagcagtggcagctgcagagaagccagctgcagggcgccatgcagcagttcaaccagagattcatctacggcaaccaggacctgttcgccaccagccagagcaaggagttcgaccccctgggccccctgccccccggctgggagaagagaaccgacagcaacggcagagtgtacttcgtgaaccacaacaccagaatcacccagtgggaggaccccagaagccagggccagctgaacgagaagcccctgcccgagggctgggagatgagattcaccgtggacggcatcccctacttcgtggaccacaacagaagaaccaccacctacatcgaccccagaaccggcaagagcgccctggacaacggcccccagatcgcctacgtgagagacttcaaggccaaggtgcagtacttcagattctggtgccagcagctggccatgccccagcacatcaagatcaccgtgaccagaaagaccctgttcgaggacagcttccagcagatcatgagcttcagcccccaggacctgagaagaagactgtgggtgatcttccccggcgaggagggcctggactacggcggcgtggccagagagtggttcttcctgctgagccacgaggtgctgaaccccatgtactgcctgttcgagtacgccggcaaggacaactactgcctgcagatcaaccccgccagctacatcaaccccgaccacctgaagtacttcagattcatcggcagattcatcgccatggccctgttccacggcaagttcatcgacaccggcttcagcctgcccttctacaagagaatcctgaacaagcccgtgggcctgaaggacctggagagcatcgaccccgagttctacaacagcctgatctgggtgaaggagaacaacatcgaggagtgcgacctggagatgtacttcagcgtggacaaggagatcctgggcgagatcaagagccacgacctgaagcccaacggcggcaacatcctggtgaccgaggagaacaaggaggagtacatcagaatggtggccgagtggagactgagcagaggcgtggaggagcagacccaggccttcttcgagggcttcaacgagatcctgccccagcagtacctgcagtacttcgacgccaaggagctggaggtgctgctgtgcggcatgcaggagatcgacctgaacgactggcagagacacgccatctacagacactacgccagaaccagcaagcagatcatgtggttctggcagttcgtgaaggagatcgacaacgagaagagaatgagactgctgcagttcgtgaccggcacctgcagactgcccgtgggcggcttcgccgacctgatgggcagcaacggcccccagaagttctgcatcgagaaggtgggcaaggagaactggctgcccagaagccacacctgcttcaacagactggacctgcccccctacaagagctacgagcagctgaaggagaagctgctgttcgccatcgaggagaccgagggcttcggccaggagtag

SEQ ID NO: 85866 - DNA, 2259 bp, Artificial Sequence
  Description of Artificial Sequence: Synthetic coding sequence
atgaagctggaggaggtggtggtgaccctgcagctgggcggcgacaaggagcccaccgagaccatcggcgacctgagcatctgcctggacggcctgcagctggagagcgaggtggtgaccaacggcgagaccacctgcagcgagagcgccagccagaacgacgacggcagcagaagcaaggacgagaccagagtgagcaccaacggcagcgacgaccccgaggacgccggcgccggcgagaacagaagagtgagcggcaacaacagccccagcctgagcaacggcggcttcaagcccagcagaccccccagacccagcagaccccccccccccacccccagaagacccgccagcgtgaacggcagccccagcgccaccagcgagagcgacggcagcagcaccggcagcctgccccccaccaacaccaacaccaacaccagcgagggcgccaccagcggcctgatcatccccctgaccatcagcggcggcagcggccccagacccctgaaccccgtgacccaggcccccctgccccccggctgggagcagagagtggaccagcacggcagagtgtactacgtggaccacgtggagaagagaaccacctgggacagacccgagcccctgccccccggctgggagagaagagtggacaacatgggcagaatctactacgtggaccacttcaccagaaccaccacctggcagagacccaccctggagagcgtgagaaactacgagcagtggcagctgcagagaagccagctgcagggcgccatgcagcagttcaaccagagattcatctacggcaaccaggacctgttcgccaccagccagagcaaggagttcgaccccctgggccccctgccccccggctgggagaagagaaccgacagcaacggcagagtgtacttcgtgaaccacaacaccagaatcacccagtgggaggaccccagaagccagggccagctgaacgagaagcccctgcccgagggctgggagatgagattcaccgtggacggcatcccctacttcgtggaccacaacagaagaaccaccacctacatcgaccccagaaccggcaagagcgccctggacaacggcccccagatcgcctacgtgagagacttcaaggccaaggtgcagtacttcagattctggtgccagcagctggccatgccccagcacatcaagatcaccgtgaccagaaagaccctgttcgaggacagcttccagcagatcatgagcttcagcccccaggacctgagaagaagactgtgggtgatcttccccggcgaggagggcctggactacggcggcgtggccagagagtggttcttcctgctgagccacgaggtgctgaaccccatgtactgcctgttcgagtacgccggcaaggacaactactgcctgcagatcaaccccgccagctacatcaaccccgaccacctgaagtacttcagattcatcggcagattcatcgccatggccctgttccacggcaagttcatcgacaccggcttcagcctgcccttctacaagagaatcctgaacaagcccgtgggcctgaaggacctggagagcatcgaccccgagttctacaacagcctgatctgggtgaaggagaacaacatcgaggagtgcgacctggagatgtacttcagcgtggacaaggagatcctgggcgagatcaagagccacgacctgaagcccaacggcggcaacatcctggtgaccgaggagaacaaggaggagtacatcagaatggtggccgagtggagactgagcagaggcgtggaggagcagacccaggccttcttcgagggcttcaacgagatcctgccccagcagtacctgcagtacttcgacgccaaggagctggaggtgctgctgtgcggcatgcaggagatcgacctgaacgactggcagagacacgccatctacagacactacgccagaaccagcaagcagatcatgtggttctggcagttcgtgaaggagatcgacaacgagaagagaatgagactgctgcagttcgtgaccggcacctgcagactgcccgtgggcggcttcgccgacctgatgggcagcaacggcccccagaagttctgcatcgagaaggtgggcaaggagaactggctgcccagaagccacacctgcttcaacagactggacctgcccccctacaagagctacgagcagctgaaggagaagctgctgttcgccatcgaggagaccgagggcttcggccaggagtag

SEQ ID NO: 85867 - DNA, 3717 bp, Artificial Sequence
  Description of Artificial Sequence: Synthetic coding sequence
atgagagcccagggcagaggcagactgcccagaagactgctgctgctgctggccctgtgggtgcaggccgccagacccatgggctacttcgagctgcagctgagcgccctgagaaacgtgaacggcgagctgctgagcggcgcctgctgcgacggcgacggcagaaccaccagagccggcggctgcggccacgacgagtgcgacacctacgtgagagtgtgcctgaaggagtaccaggccaaggtgacccccaccggcccctgcagctacggccacggcgccacccccgtgctgggcggcaacagcttctacctgccccccgccggcgccgccggcgacagagccagagccagagccagagccggcggcgaccaggaccccggcctggtggtgatccccttccagttcgcctggcccagaagcttcaccctgatcgtggaggcctgggactgggacaacgacaccacccccaacgaggagctgctgatcgagagagtgagccacgccggcatgatcaaccccgaggacagatggaagagcctgcacttcagcggccacgtggcccacctggagctgcagatcagagtgagatgcgacgagaactactacagcgccacctgcaacaagttctgcagacccagaaacgacttcttcggccactacacctgcgaccagtacggcaacaaggcctgcatggacggctggatgggcaaggagtgcaaggaggccgtgtgcaagcagggctgcaacctgctgcacggcggctgcaccgtgcccggcgagtgcagatgcagctacggctggcagggcagattctgcgacgagtgcgtgccctaccccggctgcgtgcacggcagctgcgtggagccctggcagtgcaactgcgagaccaactggggcggcctgctgtgcgacaaggacctgaactactgcggcagccaccacccctgcaccaacggcggcacctgcatcaacgccgagcccgaccagtacagatgcacctgccccgacggctacagcggcagaaactgcgagaaggccgagcacgcctgcaccagcaacccctgcgccaacggcggcagctgccacgaggtgcccagcggcttcgagtgccactgccccagcggctggagcggccccacctgcgccctggacatcgacgagtgcgccagcaacccctgcgccgccggcggcacctgcgtggaccaggtggacggcttcgagtgcatctgccccgagcagtgggtgggcgccacctgccagctggacgccaacgagtgcgagggcaagccctgcctgaacgccttcagctgcaagaacctgatcggcggctactactgcgactgcatccccggctggaagggcatcaactgccacatcaacgtgaacgactgcagaggccagtgccagcacggcggcacctgcaaggacctggtgaacggctaccagtgcgtgtgccccagaggcttcggcggcagacactgcgagctggagagagacgagtgcgccagcagcccctgccacagcggcggcctgtgcgaggacctggccgacggcttccactgccactgcccccagggcttcagcggccccctgtgcgaggtggacgtggacctgtgcgagcccagcccctgcagaaacggcgccagatgctacaacctggagggcgactactactgcgcctgccccgacgacttcggcggcaagaactgcagcgtgcccagagagccctgccccggcggcgcctgcagagtgatcgacggctgcggcagcgacgccggccccggcatgcccggcaccgccgccagcggcgtgtgcggcccccacggcagatgcgtgagccagcccggcggcaacttcagctgcatctgcgacagcggcttcaccggcacctactgccacgagaacatcgacgactgcctgggccagccctgcagaaacggcggcacctgcatcgacgaggtggacgccttcagatgcttctgccccagcggctgggagggcgagctgtgcgacaccaaccccaacgactgcctgcccgacccctgccacagcagaggcagatgctacgacctggtgaacgacttctactgcgcctgcgacgacggctggaagggcaagacctgccacagcagagagttccagtgcgacgcctacacctgcagcaacggcggcacctgctacgacagcggcgacaccttcagatgcgcctgcccccccggctggaagggcagcacctgcgccgtggccaagaacagcagctgcctgcccaacccctgcgtgaacggcggcacctgcgtgggcagcggcgccagcttcagctgcatctgcagagacggctgggagggcagaacctgcacccacaacaccaacgactgcaaccccctgccctgctacaacggcggcatctgcgtggacggcgtgaactggttcagatgcgagtgcgcccccggcttcgccggccccgactgcagaatcaacatcgacgagtgccagagcagcccctgcgcctacggcgccacctgcgtggacgagatcaacggctacagatgcagctgcccccccggcagagccggccccagatgccaggaggtgatcggcttcggcagaagctgctggagcagaggcacccccttcccccacggcagcagctgggtggaggactgcaacagctgcagatgcctggacggcagaagagactgcagcaaggtgtggtgcggctggaagccctgcctgctggccggccagcccgaggccctgagcgcccagtgccccctgggccagagatgcctggagaaggcccccggccagtgcctgagacccccctgcgaggcctggggcgagtgcggcgccgaggagccccccagcaccccctgcctgcccagaagcggccacctggacaacaactgcgccagactgaccctgcacttcaacagagaccacgtgccccagggcaccaccgtgggcgccatctgcagcggcatcagaagcctgcccgccaccagagccgtggccagagacagactgctggtgctgctgtgcgacagagccagcagcggcgccagcgccgtggaggtggccgtgagcttcagccccgccagagacctgcccgacagcagcctgatccagggcgccgcccacgccatcgtggccgccatcacccagagaggcaacagcagcctgctgctggccgtgaccgaggtgaaggtggagaccgtggtgaccggcggcagcagcaccggcctgctggtgcccgtgctgtgcggcgccttcagcgtgctgtggctggcctgcgtggtgctgtgcgtgtggtggaccagaaagagaagaaaggagagagagagaagcagactgcccagagaggagagcgccaacaaccagtgggcccccctgaaccccatcagaaaccccatcgagagacccggcggccacaaggacgtgctgtaccagtgcaagaacttcacccccccccccagaagagccgacgaggccctgcccggccccgccggccacgccgccgtgagagaggacgaggaggacgaggacctgggcagaggcgaggaggacagcctggaggccgagaagttcctgagccacaagttcaccaaggaccccggcagaagccccggcagacccgcccactgggccagcggccccaaggtggacaacagagccgtgagaagcatcaacgaggccagatacgccggcaaggagtag

SEQ ID NO: 85868 - DNA, 3603 bp, Artificial Sequence
  Description of Artificial Sequence: Synthetic coding sequence
atgagagcccagggcagaggcagactgcccagaagactgctgctgctgctggccctgtgggtgcaggccgccagacccatgggctacttcgagctgcagctgagcgccctgagaaacgtgaacggcgagctgctgagcggcgcctgctgcgacggcgacggcagaaccaccagagccggcggctgcggccacgacgagtgcgacacctacgtgagagtgtgcctgaaggagtaccaggccaaggtgacccccaccggcccctgcagctacggccacggcgccacccccgtgctgggcggcaacagcttctacctgccccccgccggcgccgccggcgacagagccagagccagagccagagccggcggcgaccaggaccccggcctggtggtgatccccttccagttcgcctggcccagaagcttcaccctgatcgtggaggcctgggactgggacaacgacaccacccccaacgaggagctgctgatcgagagagtgagccacgccggcatgatcaaccccgaggacagatggaagagcctgcacttcagcggccacgtggcccacctggagctgcagatcagagtgagatgcgacgagaactactacagcgccacctgcaacaagttctgcagacccagaaacgacttcttcggccactacacctgcgaccagtacggcaacaaggcctgcatggacggctggatgggcaaggagtgcaaggaggccgtgtgcaagcagggctgcaacctgctgcacggcggctgcaccgtgcccggcgagtgcagatgcagctacggctggcagggcagattctgcgacgagtgcgtgccctaccccggctgcgtgcacggcagctgcgtggagccctggcagtgcaactgcgagaccaactggggcggcctgctgtgcgacaaggacctgaactactgcggcagccaccacccctgcaccaacggcggcacctgcatcaacgccgagcccgaccagtacagatgcacctgccccgacggctacagcggcagaaactgcgagaaggccgagcacgcctgcaccagcaacccctgcgccaacggcggcagctgccacgaggtgcccagcggcttcgagtgccactgccccagcggctggagcggccccacctgcgccctggacatcgacgagtgcgccagcaacccctgcgccgccggcggcacctgcgtggaccaggtggacggcttcgagtgcatctgccccgagcagtgggtgggcgccacctgccagctggacgtgaacgactgcagaggccagtgccagcacggcggcacctgcaaggacctggtgaacggctaccagtgcgtgtgccccagaggcttcggcggcagacactgcgagctggagagagacgagtgcgccagcagcccctgccacagcggcggcctgtgcgaggacctggccgacggcttccactgccactgcccccagggcttcagcggccccctgtgcgaggtggacgtggacctgtgcgagcccagcccctgcagaaacggcgccagatgctacaacctggagggcgactactactgcgcctgccccgacgacttcggcggcaagaactgcagcgtgcccagagagccctgccccggcggcgcctgcagagtgatcgacggctgcggcagcgacgccggccccggcatgcccggcaccgccgccagcggcgtgtgcggcccccacggcagatgcgtgagccagcccggcggcaacttcagctgcatctgcgacagcggcttcaccggcacctactgccacgagaacatcgacgactgcctgggccagccctgcagaaacggcggcacctgcatcgacgaggtggacgccttcagatgcttctgccccagcggctgggagggcgagctgtgcgacaccaaccccaacgactgcctgcccgacccctgccacagcagaggcagatgctacgacctggtgaacgacttctactgcgcctgcgacgacggctggaagggcaagacctgccacagcagagagttccagtgcgacgcctacacctgcagcaacggcggcacctgctacgacagcggcgacaccttcagatgcgcctgcccccccggctggaagggcagcacctgcgccgtggccaagaacagcagctgcctgcccaacccctgcgtgaacggcggcacctgcgtgggcagcggcgccagcttcagctgcatctgcagagacggctgggagggcagaacctgcacccacaacaccaacgactgcaaccccctgccctgctacaacggcggcatctgcgtggacggcgtgaactggttcagatgcgagtgcgcccccggcttcgccggccccgactgcagaatcaacatcgacgagtgccagagcagcccctgcgcctacggcgccacctgcgtggacgagatcaacggctacagatgcagctgcccccccggcagagccggccccagatgccaggaggtgatcggcttcggcagaagctgctggagcagaggcacccccttcccccacggcagcagctgggtggaggactgcaacagctgcagatgcctggacggcagaagagactgcagcaaggtgtggtgcggctggaagccctgcctgctggccggccagcccgaggccctgagcgcccagtgccccctgggccagagatgcctggagaaggcccccggccagtgcctgagacccccctgcgaggcctggggcgagtgcggcgccgaggagccccccagcaccccctgcctgcccagaagcggccacctggacaacaactgcgccagactgaccctgcacttcaacagagaccacgtgccccagggcaccaccgtgggcgccatctgcagcggcatcagaagcctgcccgccaccagagccgtggccagagacagactgctggtgctgctgtgcgacagagccagcagcggcgccagcgccgtggaggtggccgtgagcttcagccccgccagagacctgcccgacagcagcctgatccagggcgccgcccacgccatcgtggccgccatcacccagagaggcaacagcagcctgctgctggccgtgaccgaggtgaaggtggagaccgtggtgaccggcggcagcagcaccggcctgctggtgcccgtgctgtgcggcgccttcagcgtgctgtggctggcctgcgtggtgctgtgcgtgtggtggaccagaaagagaagaaaggagagagagagaagcagactgcccagagaggagagcgccaacaaccagtgggcccccctgaaccccatcagaaaccccatcgagagacccggcggccacaaggacgtgctgtaccagtgcaagaacttcacccccccccccagaagagccgacgaggccctgcccggccccgccggccacgccgccgtgagagaggacgaggaggacgaggacctgggcagaggcgaggaggacagcctggaggccgagaagttcctgagccacaagttcaccaaggaccccggcagaagccccggcagacccgcccactgggccagcggccccaaggtggacaacagagccgtgagaagcatcaacgaggccagatacgccggcaaggagtag

SEQ ID NO: 85869 - DNA, 3465 bp, Artificial Sequence
  Description of Artificial Sequence: Synthetic coding sequence
atgcagtacctgaacatcaaggaggactgcaacgccatggccttctgcgccaagatgagaagcagcaagaagaccgaggtgaacctggaggcccccgagcccggcgtggaggtgatcttctacctgagcgacagagagcccctgagactgggcagcggcgagtacaccgccgaggagctgtgcatcagagccgcccaggcctgcagaatcagccccctgtgccacaacctgttcgccctgtacgacgagaacaccaagctgtggtacgcccccaacagaaccatcaccgtggacgacaagatgagcctgagactgcactacagaatgagattctacttcaccaactggcacggcaccaacgacaacgagcagagcgtgtggagacacagccccaagaagcagaagaacggctacgagaagaagaagatccccgacgccacccccctgctggacgccagcagcctggagtacctgttcgcccagggccagtacgacctggtgaagtgcctggcccccatcagagaccccaagaccgagcaggacggccacgacatcgagaacgagtgcctgggcatggccgtgctggccatcagccactacgccatgatgaagaagatgcagctgcccgagctgcccaaggacatcagctacaagagatacatccccgagaccctgaacaagagcatcagacagagaaacctgctgaccagaatgagaatcaacaacgtgttcaaggacttcctgaaggagttcaacaacaagaccatctgcgacagcagcgtgagcacccacgacctgaaggtgaagtacctggccaccctggagaccctgaccaagcactacggcgccgagatcttcgagaccagcatgctgctgatcagcagcgagaacgagatgaactggttccacagcaacgacggcggcaacgtgctgtactacgaggtgatggtgaccggcaacctgggcatccagtggagacacaagcccaacgtggtgagcgtggagaaggagaagaacaagctgaagagaaagaagctggagaacaagcacaagaaggacgaggagaagaacaagatcagagaggagtggaacaacttcagctacttccccgagatcacccacatcgtgatcaaggagagcgtggtgagcatcaacaagcaggacaacaagaagatggagctgaagctgagcagccacgaggaggccctgagcttcgtgagcctggtggacggctacttcagactgaccgccgacgcccaccactacctgtgcaccgacgtggccccccccctgatcgtgcacaacatccagaacggctgccacggccccatctgcaccgagtacgccatcaacaagctgagacaggagggcagcgaggagggcatgtacgtgctgagatggagctgcaccgacttcgacaacatcctgatgaccgtgacctgcttcgagaagagcgagcaggtgcagggcgcccagaagcagttcaagaacttccagatcgaggtgcagaagggcagatacagcctgcacggcagcgacagaagcttccccagcctgggcgacctgatgagccacctgaagaagcagatcctgagaaccgacaacatcagcttcatgctgaagagatgctgccagcccaagcccagagagatcagcaacctgctggtggccaccaagaaggcccaggagtggcagcccgtgtaccccatgagccagctgagcttcgacagaatcctgaagaaggacctggtgcagggcgagcacctgggcagaggcaccagaacccacatctacagcggcaccctgatggactacaaggacgacgagggcaccagcgaggagaagaagatcaaggtgatcctgaaggtgctggaccccagccacagagacatcagcctggccttcttcgaggccgccagcatgatgagacaggtgagccacaagcacatcgtgtacctgtacggcgtgtgcgtgagagacgtggagaacatcatggtggaggagttcgtggagggcggccccctggacctgttcatgcacagaaagagcgacgtgctgaccaccccctggaagttcaaggtggccaagcagctggccagcgccctgagctacctggaggacaaggacctggtgcacggcaacgtgtgcaccaagaacctgctgctggccagagagggcatcgacagcgagtgcggccccttcatcaagctgagcgaccccggcatccccatcaccgtgctgagcagacaggagtgcatcgagagaatcccctggatcgcccccgagtgcgtggaggacagcaagaacctgagcgtggccgccgacaagtggagcttcggcaccaccctgtgggagatctgctacaacggcgagatccccctgaaggacaagaccctgatcgagaaggagagattctacgagagcagatgcagacccgtgacccccagctgcaaggagctggccgacctgatgaccagatgcatgaactacgaccccaaccagagacccttcttcagagccatcatgagagacatcaacaagctggaggagcagaaccccgacatcgtgagcgagaagaagcccgccaccgaggtggaccccacccacttcgagaagagattcctgaagagaatcagagacctgggcgagggccacttcggcaaggtggagctgtgcagatacgaccccgagggcgacaacaccggcgagcaggtggccgtgaagagcctgaagcccgagagcggcggcaaccacatcgccgacctgaagaaggagatcgagatcctgagaaacctgtaccacgagaacatcgtgaagtacaagggcatctgcaccgaggacggcggcaacggcatcaagctgatcatggagttcctgcccagcggcagcctgaaggagtacctgcccaagaacaagaacaagatcaacctgaagcagcagctgaagtacgccgtgcagatctgcaagggcatggactacctgggcagcagacagtacgtgcacagagacctggccgccagaaacgtgctggtggagagcgagcaccaggtgaagatcggcgacttcggcctgaccaaggccatcgagaccgacaaggagtactacaccgtgaaggacgacagagacagccccgtgttctggtacgcccccgagtgcctgatgcagagcaagttctacatcgccagcgacgtgtggagcttcggcgtgaccctgcacgagctgctgacctactgcgacagcgacagcagccccatggccctgttcctgaagatgatcggccccacccacggccagatgaccgtgaccagactggtgaacaccctgaaggagggcaagagactgccctgcccccccaactgccccgacgaggtgtaccagctgatgagaaagtgctgggagttccagcccagcaacagaaccagcttccagaacctgatcgagggcttcgaggccctgctgaagtag

SEQ ID NO: 85870 - DNA, 1860 bp, Artificial Sequence
  Description of Artificial Sequence: Synthetic coding sequence
atggccccccccagcgaggagacccccctgatcccccagagaagctgcagcctgctgagcaccgaggccggcgccctgcacgtgctgctgcccgccagaggccccggccccccccagagactgagcttcagcttcggcgaccacctggccgaggacctgtgcgtgcaggccgccaaggccagcggcatcctgcccgtgtaccacagcctgttcgccctggccaccgaggacctgagctgctggttcccccccagccacatcttcagcgtggaggacgccagcacccaggtgctgctgtacagaatcagattctacttccccaactggttcggcctggagaagtgccacagattcggcctgagaaaggacctggccagcgccatcctggacctgcccgtgctggagcacctgttcgcccagcacagaagcgacctggtgagcggcagactgcccgtgggcctgagcctgaaggagcagggcgagtgcctgagcctggccgtgctggacctggccagaatggccagagagcaggcccagagacccggcgagctgctgaagaccgtgagctacaaggcctgcctgccccccagcctgagagacctgatccagggcctgagcttcgtgaccagaagaagaatcagaagaaccgtgagaagagccctgagaagagtggccgcctgccaggccgacagacacagcctgatggccaagtacatcatggacctggagagactggaccccgccggcgccgccgagaccttccacgtgggcctgcccggcgccctgggcggccacgacggcctgggcctgctgagagtggccggcgacggcggcatcgcctggacccagggcgagcaggaggtgctgcagcccttctgcgacttccccgagatcgtggacatcagcatcaagcaggcccccagagtgggccccgccggcgagcacagactggtgaccgtgaccagaaccgacaaccagatcctggaggccgagttccccggcctgcccgaggccctgagcttcgtggccctggtggacggctacttcagactgaccaccgacagccagcacttcttctgcaaggaggtggccccccccagactgctggaggaggtggccgagcagtgccacggccccatcaccctggacttcgccatcaacaagctgaagaccggcggcagcagacccggcagctacgtgctgagaagaagcccccaggacttcgacagcttcctgctgaccgtgtgcgtgcagaaccccctgggccccgactacaagggctgcctgatcagaagaagccccaccggcaccttcctgctggtgggcctgagcagaccccacagcagcctgagagagctgctggccacctgctgggacggcggcctgcacgtggacggcgtggccgtgaccctgaccagctgctgcatccccagacccaaggagaagagcaacctgatcgtggtgcagagaggccacagcccccccaccagcagcctggtgcagccccagagccagtaccagctgagccagatgaccttccacaagatccccgccgacagcctggagtggcacgagaacctgggccacggcagcttcaccaagatctacagaggctgcagacacgaggtggtggacggcgaggccagaaagaccgaggtgctgctgaaggtgatggacgccaagcacaagaactgcatggagagcttcctggaggccgccagcctgatgagccaggtgagctacagacacctggtgctgctgcacggcgtgtgcatggccggcgacagcgagagccccccccccacccaccccacccccgccagccccaagagcagactgttcttcccccccctgttctag

SEQ ID NO: 85871 - DNA, 3375 bp, Artificial Sequence
  Description of Artificial Sequence: Synthetic coding sequence
atggccccccccagcgaggagacccccctgatcccccagagaagctgcagcctgctgagcaccgaggccggcgccctgcacgtgctgctgcccgccagaggccccggccccccccagagactgagcttcagcttcggcgaccacctggccgaggacctgtgcgtgcaggccgccaaggccagcggcatcctgcccgtgtaccacagcctgttcgccctggccaccgaggacctgagctgctggttcccccccagccacatcttcagcgtggaggacgccagcacccaggtgctgctgtacagaatcagattctacttccccaactggttcggcctggagaagtgccacagattcggcctgagaaaggacctggccagcgccatcctggacctgcccgtgctggagcacctgttcgcccagcacagaagcgacctggtgagcggcagactgcccgtgggcctgagcctgaaggagcagggcgagtgcctgagcctggccgtgctggacctggccagaatggccagagagcaggcccagagacccggcgagctgctgaagaccgtgagctacaaggcctgcctgccccccagcctgagagacctgatccagggcctgagcttcgtgaccagaagaagaatcagaagaaccgtgagaagagccctgagaagagtggccgcctgccaggccgacagacacagcctgatggccaagtacatcatggacctggagagactggaccccgccggcgccgccgagaccttccacgtgggcctgcccggcgccctgggcggccacgacggcctgggcctgctgagagtggccggcgacggcggcatcgcctggacccagggcgagcaggaggtgctgcagcccttctgcgacttccccgagatcgtggacatcagcatcaagcaggcccccagagtgggccccgccggcgagcacagactggtgaccgtgaccagaaccgacaaccagatcctggaggccgagttccccggcctgcccgaggccctgagcttcgtggccctggtggacggctacttcagactgaccaccgacagccagcacttcttctgcaaggaggtggccccccccagactgctggaggaggtggccgagcagtgccacggccccatcaccctggacttcgccatcaacaagctgaagaccggcggcagcagacccggcagctacgtgctgagaagaagcccccaggacttcgacagcttcctgctgaccgtgtgcgtgcagaaccccctgggccccgactacaagggctgcctgatcagaagaagccccaccggcaccttcctgctggtgggcctgagcagaccccacagcagcctgagagagctgctggccacctgctgggacggcggcctgcacgtggacggcgtggccgtgaccctgaccagctgctgcatccccagacccaaggagaagagcaacctgatcgtggtgcagagaggccacagcccccccaccagcagcctggtgcagccccagagccagtaccagctgagccagatgaccttccacaagatccccgccgacagcctggagtggcacgagaacctgggccacggcagcttcaccaagatctacagaggctgcagacacgaggtggtggacggcgaggccagaaagaccgaggtgctgctgaaggtgatggacgccaagcacaagaactgcatggagagcttcctggaggccgccagcctgatgagccaggtgagctacagacacctggtgctgctgcacggcgtgtgcatggccggcgacagcaccatggtgcaggagttcgtgcacctgggcgccatcgacatgtacctgagaaagagaggccacctggtgcccgccagctggaagctgcaggtggtgaagcagctggcctacgccctgaactacctggaggacaagggcctgccccacggcaacgtgagcgccagaaaggtgctgctggccagagagggcgccgacggcagcccccccttcatcaagctgagcgaccccggcgtgagccccgccgtgctgagcctggagatgctgaccgacagaatcccctgggtggcccccgagtgcctgagagaggcccagaccctgagcctggaggccgacaagtggggcttcggcgccaccgtgtgggaggtgttcagcggcgtgaccatgcccatcagcgccctggaccccgccaagaagctgcagttctacgaggacagacagcagctgcccgcccccaagtggaccgagctggccctgctgatccagcagtgcatggcctacgagcccgtgcagagacccagcttcagagccgtgatcagagacctgaacagcctgatcagcagcgactacgagctgctgagcgaccccacccccggcgccctggcccccagagacggcctgtggaacggcgcccagctgtacgcctgccaggaccccaccatcttcgaggagagacacctgaagtacatcagccagctgggcaagggcaacttcggcagcgtggagctgtgcagatacgaccccctgggcgacaacaccggcgccctggtggccgtgaagcagctgcagcacagcggccccgaccagcagagagacttccagagagagatccagatcctgaaggccctgcacagcgacttcatcgtgaagtacagaggcgtgagctacggccccggcagacagagcctgagactggtgatggagtacctgcccagcggctgcctgagagacttcctgcagagacacagagccagactggacgccagcagactgctgctgtacagcagccagatctgcaagggcatggagtacctgggcagcagaagatgcgtgcacagagacctggccgccagaaacatcctggtggagagcgaggcccacgtgaagatcgccgacttcggcctggccaagctgctgcccctggacaaggactactacgtggtgagagagcccggccagagccccatcttctggtacgcccccgagagcctgagcgacaacatcttcagcagacagagcgacgtgtggagcttcggcgtggtgctgtacgagctgttcacctactgcgacaagagctgcagccccagcgccgagttcctgagaatgatgggctgcgagagagacgtgcccgccctgtgcagactgctggagctgctggaggagggccagagactgcccgccccccccgcctgccccgccgaggtgcacgagctgatgaagctgtgctgggcccccagcccccaggacagacccagcttcagcgccctgggcccccagctggacatgctgtggagcggcagcagaggctgcgagacccacgccttcaccgcccaccccgagggcaagcaccacagcctgagcttcagctag

SEQ ID NO: 85872 - DNA, 3375 bp, Artificial Sequence; identical to SEQ ID NO: 85871
  Description of Artificial Sequence: Synthetic coding sequence

SEQ ID NO: 85873 - DNA, 3285 bp, Artificial Sequence
  Description of Artificial Sequence: Synthetic coding sequence
atggccccccccagcgaggagacccccctgatcccccagagaagctgcagcctgctgagcaccgaggccggcgccctgcacgtgctgctgcccgccagaggccccggccccccccagagactgagcttcagcttcggcgaccacctggccgaggacctgtgcgtgcaggccgccaaggccagcggcatcctgcccgtgtaccacagcctgttcgccctggccaccgaggacctgagctgctggttcccccccagccacatcttcagcgtggaggacgccagcacccaggtgctgctgtacagaatcagattctacttccccaactggttcggcctggagaagtgccacagattcggcctgagaaaggacctggccagcgccatcctggacctgcccgtgctggagcacctgttcgcccagcacagaagcgacctggtgagcggcagactgcccgtgggcctgagcctgaaggagcagggcgagtgcctgagcctggccgtgctggacctggccagaatggccagagagcaggcccagagacccggcgagctgctgaagaccgtgagctacaaggcctgcctgccccccagcctgagagacctgatccagggcctgagcttcgtgaccagaagaagaatcagaagaaccgtgagaagagccctgagaagagtggccgcctgccaggccgacagacacagcctgatggccaagtacatcatggacctggagagactggaccccgccggcgccgccgagaccttccacgtgggcctgcccggcgccctgggcggccacgacggcctgggcctgctgagagtggccggcgacggcggcatcgcctggacccagggcgagcaggaggtgctgcagcccttctgcgacttccccgagatcgtggacatcagcatcaagcaggcccccagagtgggccccgccggcgagcacagactggtgaccgtgaccagaaccgacaaccagatcctggaggccgagttccccggcctgcccgaggccctgagcttcgtggccctggtggacggctacttcagactgaccaccgacagccagcacttcttctgcaaggaggtggccccccccagactgctggaggaggtggccgagcagtgccacggccccatcaccctggacttcgccatcaacaagctgaagaccggcggcagcagacccggcagctacgtgctgagaagaagcccccaggacttcgacagcttcctgctgaccgtgtgcgtgcagaaccccctgggccccgactacaagggctgcctgatcagaagaagccccaccggcaccttcctgctggtgggcctgagcagaccccacagcagcctgagagagctgctggccacctgctgggacggcggcctgcacgtggacggcgtggccgtgaccctgaccagctgctgcatccccagacccaaggagaagagcaacctgatcgtggtgcagagaggccacagcccccccaccagcagcctggtgcagccccagagccagtaccagctgagccagatgaccttccacaagatccccgccgacagcctggagtggcacgagaacctgggccacggcagcttcaccaagatctacagaggctgcagacacgaggtggtggacggcgaggccagaaagaccgaggtgctgctgaaggtgatggacgccaagcacaagaactgcatggagagcttcctggaggccgccagcctgatgagccaggtgagctacagacacctggtgctgctgcacggcgtgtgcatggccggcgacagcaccatggtgcaggagttcgtgcacctgggcgccatcgacatgtacctgagaaagagaggccacctggtgcccgccagctggaagctgcaggtggtgaagcagctggcctacgccctgaactacctggaggacaagggcctgccccacggcaacgtgagcgccagaaaggtgctgctggccagagagggcgccgacggcagcccccccttcatcaagctgagcgaccccggcgtgagccccgccgtgctgagcctggagatgctgaccgacagaatcccctgggtggcccccgagtgcctgagagaggcccagaccctgagcctggaggccgacaagtggggcttcggcgccaccgtgtgggaggtgttcagcggcgtgaccatgcccatcagcgccctggaccccgccaagaagctgcagttctacgaggacagacagcagctgcccgcccccaagtggaccgagctggccctgctgatccagcagtgcatggcctacgagcccgtgcagagacccagcttcagagccgtgatcagagacctgaacagcctgatcagcagcgactacgagctgctgagcgaccccacccccggcgccctggcccccagagacggcctgtggaacggcgcccagctgtacgcctgccaggaccccaccatcttcgaggagagacacctgaagtacatcagccagctgggcaagggcaacttcggcagcgtggagctgtgcagatacgaccccctgggcgacaacaccggcgccctggtggccgtgaagcagctgcagcacagcggccccgaccagcagagagacttccagagagagatccagatcctgaaggccctgcacagcgacttcatcgtgaagtacagaggcgtgagctacggccccggcagacagagcctgagactggtgatggagtacctgcccagcggctgcctgagagacttcctgcagagacacagagccagactggacgccagcagactgctgctgtacagcagccagatctgcaagggcatggagtacctgggcagcagaagatgcgtgcacagagacctggccgccagaaacatcctggtggagagcgaggcccacgtgaagatcgccgacttcggcctggccaagctgctgcccctggacaaggactactacgtggtgagagagcccggccagagccccatcttctggtacgcccccgagagcctgagcgacaacatcttcagcagacagagcgacgtgtggagcttcggcgtggtgctgtacgagctgttcacctactgcgacaagagctgcagccccagcgccgagttcctgagaatgatgggctgcgagagagacgtgcccgccctgtgcagactgctggagctgctggaggagggccagagactgcccgccccccccgcctgccccgccgaggtgagcgccgccggcctggccagcgtgagccagagcgtggactgggccggcgtgagcggcaagcccgccggcgcctag

SEQ ID NO: 85874 - DNA, 1575 bp, Artificial Sequence
  Description of Artificial Sequence: Synthetic coding sequence
atgagcggcaagagaaagagagtggtgctgaccatcaaggacaagctggacatcatcaagaagctggaggacggcggcagcagcaagcagctggccgtgatctacggcatcggcgagaccaccgtgagagacatcagaaagaacaaggagaagatcatcacctacgccagcagcagcgacagcaccagcctgctggccaagagaaagagcatgaagcccagcatgtacgaggagctggacagagccatgctggagtggttcaaccagcagagagccaagggcaaccccatcagcggccccatctgcgccaagagagccgagttcttcttctacgccctgggcatggacggcgacttcaaccccagcgccggctggctgaccagattcaagcagagacacagcatcagagagatcaacatcagaaacgagagactgaacggcgacgagaccgccgtggaggacttctgcaacaacttcagagacttcatcgagagagagaacctgcagcccgagcagatctacaacgccgacgagaccggcctgttctggaagtgcctgcccagcagaatcagcgtgatcaagggcaagtgcaccgtgcccggccacaagagcatcgaggagagagtgaccatcatgtgctgcgccaacgccaccggcctgcacaagctgaagctgtgcgtggtgggcaaggccaagaagcccagaagcttcaagagcaccgacaccctgaacctgcccgtgagctacttcagccagaagggcgcctggatggacctgagcatcttcagacagtggttcgacaagatcttcgtgccccaggtgagagagtacctgagaagcaagggcctgcaggagaaggccgtgctgctgctggacaacagccccacccaccccaacgagaacgtgctgagaagcgacgacggccagatcttcgccaagtacctgccccccaacgtggccagcctgatccagcccagcgaccagggcgtgatcgccaccatgaagagaaactacagagccggcctgctgcagaacaacctggaggagggcaacgacctgaagagcttctggaagaagctgaccctgctggacgccctgtacgagatcgccatggcctggaacctggtgaagcccgtgaccatcagcagagcctggaagaagatcctgcccatggtggaggagaaggagagcctggacttcgacgtggaggacatcagcgtggccaccgtggccgccatcctgcagcacaccaagggcctggagaacgtgaccaccgagaacctggagaagtggctggaggtggacagcaccgagcccggctacgaggtgctgaccgacagcgagatcatcagaagagcccagggccaggccgacgagagcagcgagaacgaggaggaggagatcgagctgatccccgagaagcacatcaaccacgccgccgccctgcagtggaccgagaacctgctggactacctggagcagcagggcgacatgatcctgcccgacagactggtgatcagaaagctgagagccaccatcagaaacaagcagaagatgaccaagagcagccagtag

SEQ ID NO: 85875 - DNA, 1575 bp, Artificial Sequence; identical to SEQ ID NO: 85874
  Description of Artificial Sequence: Synthetic coding sequence

SEQ ID NO: 85876 - DNA, 1251 bp, Artificial Sequence
  Description of Artificial Sequence: Synthetic coding sequence
atggccggcgacacccactgccccgccgagcccctggccagagagggcaccctgtgggaggccctgagagccctgctgccccacagcaaggaggacctgaagctggacctgggcgagaaggtggagagaagcgtggtgaccctgctgcagagagccaccgagctgttctacgagggcagaagagacgagtgcctgcagagcagcgaggtgatcctggactacagctgggagaagctgaacaccggcacctggcaggacgtggacaaggactggagaagagtgtacgccatcggctgcctgctgaaggccctgtgcctgtgccaggcccccgaggacgccaacaccgtggccgccgccctgagagtgtgcgacatgggcctgctgatgggcgccgccatcctgggcgacatcctgctgaaggtggccgccatcctgcagacccacctgcccggcaagagacccgccagaggcagcctgcccgagcagccctgcaccaagaaggccagagccgaccacggcctgatccccgacgtgaagctggagaagaccgtgcccagactgcacagacccagcctgcagcacttcagagagcagttcctggtgcccggcagacccgtgatcctgaagggcgtggccgaccactggccctgcatgcagaagtggagcctggagtacatccaggagatcgccggctgcagaaccgtgcccgtggaggtgggcagcagatacaccgacgaggagtggagccagaccctgatgaccgtgaacgagttcatcagcaagtacatcgtgaacgagcccagagacgtgggctacctggcccagcaccagctgttcgaccagatccccgagctgaagcaggacatcagcatccccgactactgcagcctgggcgacggcgaggaggaggagatcaccatcaacgcctggttcggcccccagggcaccatcagccccctgcaccaggacccccagcagaacttcctggtgcaggtgatgggcagaaagtacatcagactgtacagcccccaggagagcggcgccctgtacccccacgacacccacctgctgcacaacaccagccaggtggacgtggagaaccccgacctggagaagttccccaagttcgccaaggcccccttcctgagctgcatcctgagccccggcgagatcctgttcatccccgtgaagtactggcactacgtgagagccctggacctgagcttcagcgtgagcttctggtggagctag

SEQ ID NO: 85877 - DNA, 663 bp, Artificial Sequence
  Description of Artificial Sequence: Synthetic coding sequence
atggccggcgacacccactgccccgccgagcccctggccagagagggcaccctgtgggaggccctgagagccctgctgccccacagcaaggaggacctgaagctggacctgggcgagaaggtggagagaagcgtggtgaccctgctgcagagagccaccgagctgttctacgagggcagaagagacgagtgcctgcagagcagcgaggtgatcctggactacagctgggagaagctgaacaccggcacctggcaggacgtggacaaggactggagaagagtgtacgccatcggctgcctgctgaaggccctgtgcctgtgccaggcccccgaggacgccaacaccgtggccgccgccctgagagtgtgcgacatgggcctgctgatgggcgccgccatcctgggcgacatcctgctgaaggtggccgccatcctgcagacccacctgcccggcaagagacccgccagaggcagcctgcccgagcagccctgcaccaaggtggacgtggagaaccccgacctggagaagttccccaagttcgccaaggcccccttcctgagctgcatcctgagccccggcgagatcctgttcatccccgtgaagtactggcactacgtgagagccctggacctgagcttcagcgtgagcttctggtggagctag

SEQ ID NO: 85878 - DNA, 1365 bp, Artificial Sequence
  Description of Artificial Sequence: Synthetic coding sequence
atgagcagagagaagtgcagccccggcgagggcgccgaggagggcagaggcagcgaggccagcggcctgaaggccagcgccggccacggcaccgagcccgccggcggcggccccatggccggcgacacccactgccccgccgagcccctggccagagagggcaccctgtgggaggccctgagagccctgctgccccacagcaaggaggacctgaagctggacctgggcgagaaggtggagagaagcgtggtgaccctgctgcagagagccaccgagctgttctacgagggcagaagagacgagtgcctgcagagcagcgaggtgatcctggactacagctgggagaagctgaacaccggcacctggcaggacgtggacaaggactggagaagagtgtacgccatcggctgcctgctgaaggccctgtgcctgtgccaggcccccgaggacgccaacaccgtggccgccgccctgagagtgtgcgacatgggcctgctgatgggcgccgccatcctgggcgacatcctgctgaaggtggccgccatcctgcagacccacctgcccggcaagagacccgccagaggcagcctgcccgagcagccctgcaccaagaaggccagagccgaccacggcctgatccccgacgtgaagctggagaagaccgtgcccagactgcacagacccagcctgcagcacttcagagagcagttcctggtgcccggcagacccgtgatcctgaagggcgtggccgaccactggccctgcatgcagaagtggagcctggagtacatccaggagatcgccggctgcagaaccgtgcccgtggaggtgggcagcagatacaccgacgaggagtggagccagaccctgatgaccgtgaacgagttcatcagcaagtacatcgtgaacgagcccagagacgtgggctacctggcccagcaccagctgttcgaccagatccccgagctgaagcaggacatcagcatccccgactactgcagcctgggcgacggcgaggaggaggagatcaccatcaacgcctggttcggcccccagggcaccatcagccccctgcaccaggacccccagcagaacttcctggtgcaggtgatgggcagaaagtacatcagactgtacagcccccaggagagcggcgccctgtacccccacgacacccacctgctgcacaacaccagccaggtggacgtggagaaccccgacctggagaagttccccaagttcgccaaggcccccttcctgagctgcatcctgagccccggcgagatcctgttcatccccgtgaagtactggcactacgtgagagccctggacctgagcttcagcgtgagcttctggtggagctag

SEQ ID NO: 85879 - DNA, 441 bp, Artificial Sequence
  Description of Artificial Sequence: Synthetic coding sequence
atgaccgtgaacgagttcatcagcaagtacatcgtgaacgagcccagagacgtgggctacctggcccagcaccagctgttcgaccagatccccgagctgaagcaggacatcagcatccccgactactgcagcctgggcgacggcgaggaggaggagatcaccatcaacgcctggttcggcccccagggcaccatcagccccctgcaccaggacccccagcagaacttcctggtgcaggtgatgggcagaaagtacatcagactgtacagcccccaggagagcggcgccctgtacccccacgacacccacctgctgcacaacaccagccaggtggacgtggagaaccccgacctggagaagttccccaagttcgccaaggcccccttcctgagctgcatcctgagccccggcgagatcctgttcatccccgtgaagtactag

SEQ ID NO: 85880 - DNA, 1119 bp, Artificial Sequence
  Description of Artificial Sequence: Synthetic coding sequence
atgaaccacaagagcaagaagagaatcagagaggccaagagaagcgccagacccgagctgaaggacagcctggactggaccagacacaactactacgagagcttcagcctgagccccgccgccgtggccgacaacgtggagagagccgacgccctgcagctgagcgtggaggagttcgtggagagatacgagagaccctacaagcccgtggtgctgctgaacgcccaggagggctggagcgcccaggagaagtggaccctggagagactgaagagaaagtacagaaaccagaagttcaagtgcggcgaggacaacgacggctacagcgtgaagatgaagatgaagtactacatcgagtacatggagagcaccagagacgacagccccctgtacatcttcgacagcagctacggcgagcaccccaagagaagaaagctgctggaggactacaaggtgcccaagttcttcaccgacgacctgttccagtacgccggcgagaagagaagacccccctacagatggttcgtgatgggcccccccagaagcggcaccggcatccacatcgaccccctgggcaccagcgcctggaacgccctggtgcagggccacaagagatggtgcctgttccccaccagcacccccagagagctgatcaaggtgaccagagacgagggcggcaaccagcaggacgaggccatcacctggttcaacgtgatctaccccagaacccagctgcccacctggccccccgagttcaagcccctggagatcctgcagaagcccggcgagaccgtgttcgtgcccggcggctggtggcacgtggtgctgaacctggacaccaccatcgccatcacccagaacttcgccagcagcaccaacttccccgtggtgtggcacaagaccgtgagaggcagacccaagctgagcagaaagtggtacagaatcctgaagcaggagcaccccgagctggccgtgctggccgacagcgtggacctgcaggagagcaccggcatcgccagcgacagcagcagcgacagcagcagcagcagcagcagcagcagcagcgacagcgacagcgagagaatcagagacacctgcggcggcagagcccacccctag

SEQ ID NO: 85881 - DNA, 1212 bp, Artificial Sequence
  Description of Artificial Sequence: Synthetic coding sequence
atgaaccacaagagcaagaagagaatcagagaggccaagagaagcgccagacccgagctgaaggacagcctggactggaccagacacaactactacgagagcttcagcctgagccccgccgccgtggccgacaacgtggagagagccgacgccctgcagctgagcgtggaggagttcgtggagagatacgagagaccctacaagcccgtggtgctgctgaacgcccaggagggctggagcgcccaggagaagtggaccctggagagactgaagagaaagtacagaaaccagaagttcaagtgcggcgaggacaacgacggctacagcgtgaagatgaagatgaagtactacatcgagtacatggagagcaccagagacgacagccccctgtacatcttcgacagcagctacggcgagcaccccaagagaagaaagctgctggaggactacaaggtgcccaagttcttcaccgacgacctgttccagtacgccggcgagaagagaagacccccctacagatggttcgtgatgggcccccccagaagcggcaccggcatccacatcgaccccctgggcaccagcgcctggaacgccctggtgcagggccacaagagatggtgcctgttccccaccagcacccccagagagctgatcaaggtgaccagagacgagggcggcaaccagcaggacgaggccatcacctggttcaacgtgatctaccccagaacccagctgcccacctggccccccgagttcaagcccctggagatcctgcagaagcccggcgagaccgtgttcgtgcccggcggctggtggcacgtggtgctgaacctggacaccaccatcgccatcacccagaacttcgccagcagcaccaacttccccgtggtgtggcacaagaccgtgagaggcagacccaagctgagcagaaagtggtacagaatcctgaagcaggagcaccccgagctggccgtgctggccgacagcgtggacctgcaggagagcaccggcatcgccagcgacagcagcagcgacagcagcagcagcagcagcagcagcagcagcgacagcgacagcgagtgcgagagcggcagcgagggcgacggcaccgtgcacagaagaaagaagagaagaacctgcagcatggtgggcaacggcgacaccaccagccaggacgactgcgtgagcaaggagagaagcagcagcagatag

SEQ ID NO: 85882 - DNA, 1245 bp, Artificial Sequence
  Description of Artificial Sequence: Synthetic coding sequence
atgaaccacaagagcaagaagagaatcagagaggccaagagaagcgccagacccgagctgaaggacagcctggactggaccagacacaactactacgagagcttcagcctgagccccgccgccgtggccgacaacgtggagagagccgacgccctgcagctgagcgtggaggagttcgtggagagatacgagagaccctacaagcccgtggtgctgctgaacgcccaggagggctggagcgcccaggagaagtggaccctggagagactgaagagaaagtacagaaaccagaagttcaagtgcggcgaggacaacgacggctacagcgtgaagatgaagatgaagtactacatcgagtacatggagagcaccagagacgacagccccctgtacatcttcgacagcagctacggcgagcaccccaagagaagaaagctgctggaggactacaaggtgcccaagttcttcaccgacgacctgttccagtacgccggcgagaagagaagacccccctacagatggttcgtgatgggcccccccagaagcggcaccggcatccacatcgaccccctgggcaccagcgcctggaacgccctggtgcagggccacaagagatggtgcctgttccccaccagcacccccagagagctgatcaaggtgaccagagacgagggcggcaaccagcaggacgaggccatcacctggttcaacgtgatctaccccagaacccagctgcccacctggccccccgagttcaagcccctggagatcctgcagaagcccggcgagaccgtgttcgtgcccggcggctggtggcacgtggtgctgaacctggacaccaccatcgccatcacccagaacttcgccagcagcaccaacttccccgtggtgtggcacaagaccgtgagaggcagacccaagctgagcagaaagtggtacagaatcctgaagcaggagcaccccgagctggccgtgctggccgacagcgtggacctgcaggagagcaccggcatcgccagcgacagcagcagcgacagcagcagcagcagcagcagcagcagcagcgacagcgacagcgagtgcgagagcggcagcgagggcgacggcaccgtgcacagaagaaagaagagaagaacctgcagcatggtgggcaacggcgacaccaccagccaggacgactgcgtgagcaaggagagaagcagcagcagaatcagagacacctgcggcggcagagcccacccctag

SEQ ID NO: 85883 - DNA, 441 bp, Artificial Sequence
  Description of Artificial Sequence: Synthetic coding sequence
atgctggccggcgccggcagacccggcctgccccagggcagacacctgtgctggctgctgtgcgccttcaccctgaagctgtgccaggccgaggcccccgtgcaggaggagaagctgagcgccagcaccagcaacctgccctgctggctggtggaggagttcgtggtggccgaggagtgcagcccctgcagcaacttcagagccaagaccacccccgagtgcggccccaccggctacgtggagaagatcacctgcagcagcagcaagagaaacgagttcaagagctgcagaagcgccctgatggagcagagactgttctggaagttcgagggcgccgtggtgtgcgtggccctgatcttcgcctgcctggtgatcatcagacagagacagctggacagaaaggccctggagaaggtgagaaagcagatcgagagcatctag

SEQ ID NO: 85884 - DNA, 354 bp, Artificial Sequence
  Description of Artificial Sequence: Synthetic coding sequence
atggcctggggctggcacctgagcttcctgagcgccagcaccagcaacctgccctgctggctggtggaggagttcgtggtggccgaggagtgcagcccctgcagcaacttcagagccaagaccacccccgagtgcggccccaccggctacgtggagaagatcacctgcagcagcagcaagagaaacgagttcaagagctgcagaagcgccctgatggagcagagactgttctggaagttcgagggcgccgtggtgtgcgtggccctgatcttcgcctgcctggtgatcatcagacagagacagctggacagaaaggccctggagaaggtgagaaagcagatcgagagcatctag

SEQ ID NO: 85885 - DNA, 354 bp, Artificial Sequence; identical to SEQ ID NO: 85884
  Description of Artificial Sequence: Synthetic coding sequence

SEQ ID NO: 85886 - DNA, 354 bp, Artificial Sequence; identical to SEQ ID NO: 85884
  Description of Artificial Sequence: Synthetic coding sequence

SEQ ID NO: 85887 - DNA, 1044 bp, Artificial Sequence
  Description of Artificial Sequence: Synthetic coding sequence
atggagacccccttctacggcgacgaggccctgagcggcctgggcggcggcgccagcggcagcggcggcagcttcgccagccccggcagactgttccccggcgccccccccaccgccgccgccggcagcatgatgaagaaggacgccctgaccctgagcctgagcgagcaggtggccgccgccctgaagcccgccgccgcccccccccccacccccctgagagccgacggcgcccccagcgccgccccccccgacggcctgctggccagccccgacctgggcctgctgaagctggccagccccgagctggagagactgatcatccagagcaacggcctggtgaccaccacccccaccagcagccagttcctgtaccccaaggtggccgccagcgaggagcaggagttcgccgagggcttcgtgaaggccctggaggacctgcacaagcagaaccagctgggcgccggcgccgccgccgccgccgccgccgccgccgccggcggccccagcggcaccgccaccggcagcgccccccccggcgagctggcccccgccgccgccgcccccgaggcccccgtgtacgccaacctgagcagctacgccggcggcgccggcggcgccggcggcgccgccaccgtggccttcgccgccgagcccgtgcccttcccccccccccccccccccggcgccctgggcccccccagactggccgccctgaaggacgagccccagaccgtgcccgacgtgcccagcttcggcgagagcccccccctgagccccatcgacatggacacccaggagagaatcaaggccgagagaaagagactgagaaacagaatcgccgccagcaagtgcagaaagagaaagctggagagaatcagcagactggaggagaaggtgaagaccctgaagagccagaacaccgagctggccagcaccgccagcctgctgagagagcaggtggcccagctgaagcagaaggtgctgagccacgtgaacagcggctgccagctgctgccccagcaccaggtgcccgcctactag

SEQ ID NO: 85888 - DNA, 2934 bp, Artificial Sequence
  Description of Artificial Sequence: Synthetic coding sequence
atgagcttcgccctggaggagaccctggagagcgactgggtggccgtgagaccccacgtgttcgacgagagagagaagcacaagttcgtgttcatcgtggcctggaacgagatcgagggcaagttcgccatcacctgccacaacagaaccgcccagagacagagaagcggcagcagagagcaggccggcgccagaggcggcgccgaggccggcggcgccgccagcgacggcagcagaggccccggcagccccgccggcagaggcagacccgaggccaccgccagcgccaccctggtgagaagccccggccccagaagaagcagcgcctgggccgagggcggcagccccagaagcaccagaagcctgctgggcgaccccagactgagaagccccggcagcaagggcgccgagagcagactgagaagccccgtgagagccaagcccatccccggccagaagaccagcgaggccgacgacgccgccggcgccgccgccgccgccgccagacccgcccccagagaggcccaggtgagcagcgtgagaatcgtgagcgccagcggcaccgtgagcgaggagatcgaggtgctggagatggtgaaggaggacgaggcccccctggccctgagcgacgccgagcagcccccccccgccaccgagctggagagccccgccgaggagtgcagctgggccggcctgttcagcttccaggacctgagagccgtgcaccagcagctgtgcagcgtgaacagccagctggagccctgcctgcccgtgttccccgaggagcccagcggcatgtggaccgtgctgttcggcggcgcccccgagatgaccgagcaggagatcgacaccctgtgctaccagctgcaggtgtacctgggccacggcctggacacctgcggctggaagatcctgagccaggtgctgttcaccgagaccgacgaccccgaggagtactacgagagcctgagcgagctgagacagaagggctacgaggaggtgctgcagagagccagaaagagaatccaggagctgctggacaagcacaagaacaccgagagcatggtggagctgctggacctgtaccagatggaggacgaggcctacagcagcctggccgaggccaccaccgagctgtaccagtacctgctgcagcccttcagagacatgagagagctggccatgctgagaagacagcagatcaagatcagcatggagaacgactacctgggccccagaagaatcgagagcctgcagaaggaggacgccgactggcagagaaaggcccacatggccgtgctgagcatccaggacctgaccgtgaagtacttcgagatcaccgccaaggcccagaaggccgtgtacgacagaatgagagccgaccagaagaagttcggcaaggccagctgggccgccgccgccgagagaatggagaagctgcagtacgccgtgagcaaggagaccctgcagatgatgagagccaaggagatctgcctggagcagagaaagcacgccctgaaggaggagatgcagagcctgagaggcggcaccgaggccatcgccagactggaccagctggaggccgactactacgacctgcagctgcagctgtacgaggtgcagttcgagatcctgaagtgcgaggagctgctgctgaccgcccagctggagagcatcaagagactgatcagcgagaagagagacgaggtggtgtactacgacacctacgagagcatggaggccatgctggagaaggaggagatggccgccagcgcctacctgcagagagaggagctgcagaagctgcagcagaaggccagacagctggaggccagaagaggcagagtgagcgccaagaagagctacctgagaaacaagaaggagatctgcatcgccaagcacaacgagaagatccagcagagaaccagaatcgaggacgagtacagaacccaccacaccgtgcagctgaagagagagaagctgcacgacgaggaggagagaaagagcgcctgggtgagccaggagagacagagaaccctggacagactgagaaccttcaagcagagataccccggccaggtgatcctgaagagcaccagactgagactggcccacgccagaagaaagggcgccgccagccccgtgctgcaggaggaccactgcgacagcctgcccagcgtgctgcaggtggaggagaagaccgaggaggtgggcgagggcagagtgaagagaggccccagccagaccaccgagccccagagcctggtgcagctggaggacaccagcctgacccagctggaggccaccagcctgcccctgagcggcgtgaccagcgagctgccccccaccatcagcctgcccctgctgaacaacaacctggagccctgcagcgtgaccatcaaccccctgcccagccccctgccccccaccccccccccccccctgcccgtggccaaggacagcggccccgagaccctggagaaggacctgcccagaaaggagggcaacgagaagagaatccccaagagcgccagcgcccccagcgcccacctgttcgacagcagccagctggtgagcgccagaaagaagctgagaaagaccgccgagggcctgcagagaagaagagtgagcagccccatggacgaggtgctggccagcctgaagagaggcagcttccacctgaagaaggtggagcagagaaccctgccccccttccccgacgaggacgacagcaacaacatcctggcccagatcagaaagggcgtgaagctgaagaaggtgcagaaggacgtgctgagagagagcttcaccctgctgcccgacaccgaccccctgaccagaagcatccacgaggccctgagaagaatcaaggaggccagccccgagagcgaggacgaggaggaggccctgccctgcaccgactgggagaactag

SEQ ID NO: 85889 - DNA, 2967 bp, Artificial Sequence
  Description of Artificial Sequence: Synthetic coding sequence
atgagcttcgccctggaggagaccctggagagcgactgggtggccgtgagaccccacgtgttcgacgagagagagaagcacaagttcgtgttcatcgtggcctggaacgagatcgagggcaagttcgccatcacctgccacaacagaaccgcccagagacagagaagcggcagcagagagcaggccggcgccagaggcggcgccgaggccggcggcgccgccagcgacggcagcagaggccccggcagccccgccggcagaggcagacccgaggccaccgccagcgccaccctggtgagaagccccggccccagaagaagcagcgcctgggccgagggcggcagccccagaagcaccagaagcctgctgggcgaccccagactgagaagccccggcagcaagggcgccgagagcagactgagaagccccgtgagagccaagcccatccccggccagaagaccagcgaggccgacgacgccgccggcgccgccgccgccgccgccagacccgcccccagagaggcccaggtgagcagcgtgagaatcgtgagcgccagcggcaccgtgagcgaggagatcgaggtgctggagatggtgaaggaggacgaggcccccctggccctgagcgacgccgagcagcccccccccgccaccgagctggagagccccgccgaggagtgcagctgggccggcctgttcagcttccaggacctgagagccgtgcaccagcagctgtgcagcgtgaacagccagctggagccctgcctgcccgtgttccccgaggagcccagcggcatgtggaccgtgctgttcggcggcgcccccgagatgaccgagcaggagatcgacaccctgtgctaccagctgcaggtgtacctgggccacggcctggacacctgcggctggaagatcctgagccaggtgctgttcaccgagaccgacgaccccgaggagtactacgagagcctgagcgagctgagacagaagggctacgaggaggtgctgcagagagccagaaagagaatccaggagctgctggacaagcacaagaacaccgagagcatggtggagctgctggacctgtaccagatggaggacgaggcctacagcagcctggccgaggccaccaccgagctgtaccagtacctgctgcagcccttcagagacatgagagagctggccatgctgagaagacagcagatcaagatcagcatggagaacgactacctgggccccagaagaatcgagagcctgcagaaggaggacgccgactggcagagaaaggcccacatggccgtgctgagcatccaggacctgaccgtgaagtacttcgagatcaccgccaaggcccagaaggccgtgtacgacagaatgagagccgaccagaagaagttcggcaaggccagctgggccgccgccgccgagagaatggagaagctgcagtacgccgtgagcaaggagaccctgcagatgatgagagccaaggagatctgcctggagcagagaaagcacgccctgaaggaggagatgcagagcctgagaggcggcaccgaggccatcgccagactggaccagctggaggccgactactacgacctgcagctgcagctgtacgaggtgcagttcgagatcctgaagtgcgaggagctgctgctgaccgcccagctggagagcatcaagagactgatcagcgagaagagagacgaggtggtgtactacgacacctacgagagcatggaggccatgctggagaaggaggagatggccgccagcgcctacctgcagagagaggagctgcagaagctgcagcagaaggccagacagctggaggccagaagaggcagagtgagcgccaagaagagctacctgagaaacaagaaggagatctgcatcgccaagcacaacgagaagatccagcagagaaccagaatcgaggacgagtacagaacccaccacaccgtgcagctgaagagagagaagctgcacgacgaggaggagagaaagagcgcctgggtgagccaggagagacagagaaccctggacagactgagaaccttcaagcagagataccccggccaggtgatcctgaagagcaccagactgagactggcccacgccagaagaaagggcgccgccagccccgtgctgcaggaggaccactgcgacagcctgcccagcgtgctgcaggtggaggagaagaccgaggaggtgggcgagggcagagtgaagagaggccccagccagaccaccgagccccagagcctggtgcagctggaggacaccagcctgacccagctggaggccaccagcctgcccctgagcggcgtgaccagcgagctgccccccaccatcagcctgcccctgctgaacaacaacctggagccctgcagcgtgaccatcaaccccctgcccagccccctgccccccacccccccccccccccccccccccccccccccccccccccccccccccctgcccgtggccaaggacagcggccccgagaccctggagaaggacctgcccagaaaggagggcaacgagaagagaatccccaagagcgccagcgcccccagcgcccacctgttcgacagcagccagctggtgagcgccagaaagaagctgagaaagaccgccgagggcctgcagagaagaagagtgagcagccccatggacgaggtgctggccagcctgaagagaggcagcttccacctgaagaaggtggagcagagaaccctgccccccttccccgacgaggacgacagcaacaacatcctggcccagatcagaaagggcgtgaagctgaagaaggtgcagaaggacgtgctgagagagagcttcaccctgctgcccgacaccgaccccctgaccagaagcatccacgaggccctgagaagaatcaaggaggccagccccgagagcgaggacgaggaggaggccctgccctgcaccgactgggagaactag

SEQ ID NO: 85890 - DNA, 2238 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgaacaagaacaaccccaagttcctggccatcaccaccgactgcctgcagctgctggcctacggcaaccaggagagcaagctgatcatcctggccaacggcggcccccaggccctggtgcagatcatgagaaactacagctacgagaagctgctgtggaccaccagcagagtgctgaaggtgctgagcgtgtgccccagcaacaagcccgccatcgtggaggccggcggcatgcaggccctgggcaagcacctgaccagcaacagccccagactggtgcagaactgcctgtggaccctgagaaacctgagcgacgtggccaccaagcaggagggcctggagagcgtgctgaagatcctggtgaaccagctgagcgtggacgacgtgaacgtgctgacctgcgccaccggcaccctgagcaacctgacctgcaacaacagcaagaacaagaccctggtgacccagaacagcggcgtggaggccctgatccacgccatcctgagagccggcgacaaggacgacatcaccgagcccgccgtgtgcgccctgagacacctgaccagcagacaccccgaggccgagatggcccagaacagcgtgagactgaactacggcatccccgccatcgtgaagctgctgaaccagcccaaccagtggcccctggtgaaggccaccatcggcctgatcagaaacctggccctgtgccccgccaaccacgcccccctgcaggaggccgccgtgatccccagactggtgcagctgctggtgaaggcccaccaggacgcccagagacacgtggccgccggcacccagcagccctacaccgacggcgtgagaatggaggagatcgtggagggctgcaccggcgccctgcacatcctggccagagaccccatgaacagaatggagatcttcagactgaacaccatccccctgttcgtgcagctgctgtacagcagcgtggagaacatccagagagtggccgccggcgtgctgtgcgagctggcccaggacaaggaggccgccgacgccatcgacgccgagggcgccagcgcccccctgatggagctgctgcacagcagaaacgagggcaccgccacctacgccgccgccgtgctgttcagaatcagcgaggacaagaaccccgactacagaaagagagtgagcgtggagctgaccaacagcctgttcaagcacgaccccgccgcctgggaggccgcccagagcatgatccccatcaacgagccctacggcgacgacatggacgccacctacagacccatgtacagcagcgacgtgcccctggaccccctggagatgcacatggacatggacggcgactaccccatcgacacctacagcgacggcctgagacccccctaccccaccgccgaccacatgctggcctag

SEQ ID NO: 85891 - DNA, 2238 bp, Artificial Sequence; identical to SEQ ID NO: 85890
  Description of Artificial Sequence: Synthetic coding sequence

SEQ ID NO: 85892 - DNA, 2238 bp, Artificial Sequence; identical to SEQ ID NO: 85890
  Description of Artificial Sequence: Synthetic coding sequence

SEQ ID NO: 85893 - DNA, 834 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgtag

SEQ ID NO: 85894 - DNA, 708 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgtag

SEQ ID NO: 85895 - DNA, 891 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgaacaagaacaaccccaagttcctggccatcaccaccgactgcctgcagctgctggcctag

SEQ ID NO: 85896 - DNA, 261 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagatag

SEQ ID NO: 85897 - DNA, 897 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgaacaagaacaaccccaagttcctggccatcaccaccgactgcctgcagctgctggcctacggctag

SEQ ID NO: 85898 - DNA, 1776 bp, Artificial Sequence
  Description of Artificial Sequence: Synthetic coding sequence
atggaggtgatgaacctgatggagcagcccatcaaggtgaccgagtggcagcagacctacacctacgacagcggcatccacagcggcgccaacacctgcgtgcccagcgtgagcagcaagggcatcatggaggaggacgaggcctgcggcagacagtacaccctgaagaagaccaccacctacacccagggcgtgccccccagccagggcgacctggagtaccagatgagcaccaccgccagagccaagagagtgagagaggccatgtgccccggcgtgagcggcgaggacagcagcctgctgctggccacccaggtggagggccaggccaccaacctgcagagactggccgagcccagccagctgctgaagagcgccatcgtgcacctgatcaactaccaggacgacgccgagctggccaccagagccctgcccgagctgaccaagctgctgaacgacgaggaccccgtggtggtgaccaaggccgccatgatcgtgaaccagctgagcaagaaggaggccagcagaagagccctgatgggcagcccccagctggtggccgccgtggtgagaaccatgcagaacaccagcgacctggacaccgccagatgcaccaccagcatcctgcacaacctgagccaccacagagagggcctgctggccatcttcaagagcggcggcatccccgccctggtgagaatgctgagcagccccgtggagagcgtgctgttctacgccatcaccaccctgcacaacctgctgctgtaccaggagggcgccaagatggccgtgagactggccgacggcctgcagaagatggtgcccctgctgaacaagaacaaccccaagttcctggccatcaccaccgactgcctgcagctgctggcctacggcaaccaggagagcaagatcctgaccgccaccgtggacaacgccaacatcctgctgcagatcgacaacgccagactggccgccgacgacttcagaaccaagttcgagaccgagcaggccctgagactgagcgtggaggccgacatcaacggcctgagaagagtgctggacgagctgaccctggccagagccgacctggagatgcagatcgagaacctgaaggaggagctggcctacctgaagaagaaccacgaggaggagatgaacgccctgagaggccaggtgggcggcgagatcaacgtggagatggacgccgcccccggcgtggacctgagcagaatcctgaacgagatgagagaccagtacgagaagatggccgagaagaacagaaaggacgccgaggactggttcttcagcaagaccgaggagctgaacagagaggtggccaccaacagcgagctggtgcagagcggcaagagcgagatcagcgagctgagaagaaccatgcaggccctggagatcgagctgcagagccagctgagcatgaaggccagcctggagggcaacctggccgagaccgagaacagatactgcgtgcagctgagccagatccagggcctgatcggcagcgtggaggagcagctggcccagctgagatgcgagatggagcagcagaaccaggagtacaagatcctgctggacgtgaagaccagactggagcaggagatcgccacctacagaagactgctggagggcgaggacgcccacctgacccagtacaagaaggagcccgtgaccaccagacaggtgagaaccatcgtggaggaggtgcaggacggcaaggtgatcagcagcagagagcaggtgcaccagaccaccagatag

SEQ ID NO: 85899 - DNA, 897 bp, Artificial Sequence
  Description of Artificial Sequence: Synthetic coding sequence
atggccagaagaagcagacacagactgctgctgctgctgctgagatacctggtggtggccctgggctaccacaaggcctacggcttcagcgcccccaaggaccagcaggtggtgaccgccgtggagtaccaggaggccatcctggcctgcaagacccccaagaagaccgtgagcagcagactggagtggaagaagctgggcagaagcgtgagcttcgtgtactaccagcagaccctgcagggcgacttcaagaacagagccgagatgatcgacttcaacatcagaatcaagaacgtgaccagaagcgacgccggcaagtacagatgcgaggtgagcgcccccagcgagcagggccagaacctggaggaggacaccgtgaccctggaggtgctggtggcccccgccgtgcccagctgcgaggtgcccagcagcgccctgagcggcaccgtggtggagctgagatgccaggacaaggagggcaaccccgcccccgagtacacctggttcaaggacggcatcagactgctggagaaccccagactgggcagccagagcaccaacagcagctacaccatgaacaccaagaccggcaccctgcagttcaacaccgtgagcaagctggacaccggcgagtacagctgcgaggccagaaacagcgtgggctacagaagatgccccggcaagagaatgcaggtggacgacctgaacatcagcggcatcatcgccgccgtggtggtggtggccctggtgatcagcgtgtgcggcctgggcgtgtgctacgcccagagaaagggctacttcagcagcaagtacatgttcatgaagagcaacagcagcagcaaggccaccaccatgagcgagaacgacttcaagcacaccaagagcttcatcatctag

SEQ ID NO: 85900 - DNA, 789 bp, Artificial Sequence
  Description of Artificial Sequence: Synthetic coding sequence
atggccagaagaagcagacacagactgctgctgctgctgctgagatacctggtggtggccctgggctaccacaaggcctacggcttcagcgcccccaaggaccagcaggtggtgaccgccgtggagtaccagggcgacttcaagaacagagccgagatgatcgacttcaacatcagaatcaagaacgtgaccagaagcgacgccggcaagtacagatgcgaggtgagcgcccccagcgagcagggccagaacctggaggaggacaccgtgaccctggaggtgctggtggcccccgccgtgcccagctgcgaggtgcccagcagcgccctgagcggcaccgtggtggagctgagatgccaggacaaggagggcaaccccgcccccgagtacacctggttcaaggacggcatcagactgctggagaaccccagactgggcagccagagcaccaacagcagctacaccatgaacaccaagaccggcaccctgcagttcaacaccgtgagcaagctggacaccggcgagtacagctgcgaggccagaaacagcgtgggctacagaagatgccccggcaagagaatgcaggtggacgacctgaacatcagcggcatcatcgccgccgtggtggtggtggccctggtgatcagcgtgtgcggcctgggcgtgtgctacgcccagagaaagggctacttcagcaaggagaccagcttccagaagagcaacagcagcagcaaggccaccaccatgagcgagaacgacttcaagcacaccaagagcttcatcatctag

SEQ ID NO: 85901 - DNA, 897 bp, Artificial Sequence
  Description of Artificial Sequence: Synthetic coding sequence
atggccagaagaagcagacacagactgctgctgctgctgctgagatacctggtggtggccctgggctaccacaaggcctacggcttcagcgcccccaaggaccagcaggtggtgaccgccgtggagtaccaggaggccatcctggcctgcaagacccccaagaagaccgtgagcagcagactggagtggaagaagctgggcagaagcgtgagcttcgtgtactaccagcagaccctgcagggcgacttcaagaacagagccgagatgatcgacttcaacatcagaatcaagaacgtgaccagaagcgacgccggcaagtacagatgcgaggtgagcgcccccagcgagcagggccagaacctggaggaggacaccgtgaccctggaggtgctggtggcccccgccgtgcccagctgcgaggtgcccagcagcgccctgagcggcaccgtggtggagctgagatgccaggacaaggagggcaaccccgcccccgagtacacctggttcaaggacggcatcagactgctggagaaccccagactgggcagccagagcaccaacagcagctacaccatgaacaccaagaccggcaccctgcagttcaacaccgtgagcaagctggacaccggcgagtacagctgcgaggccagaaacagcgtgggctacagaagatgccccggcaagagaatgcaggtggacgacctgaacatcagcggcatcatcgccgccgtggtggtggtggccctggtgatcagcgtgtgcggcctgggcgtgtgctacgcccagagaaagggctacttcagcaaggagaccagcttccagaagagcaacagcagcagcaaggccaccaccatgagcgagaacgacttcaagcacaccaagagcttcatcatctag

SEQ ID NO: 85902 - DNA, 939 bp, Artificial Sequence
  Description of Artificial Sequence: Synthetic coding sequence
atggccagaagaagcagacacagactgctgctgctgctgctgagatacctggtggtggccctgggctaccacaaggcctacggcttcagcgcccccaaggaccagcaggtggtgaccgccgtggagtaccaggaggccatcctggcctgcaagacccccaagaagaccgtgagcagcagactggagtggaagaagctgggcagaagcgtgagcttcgtgtactaccagcagaccctgcagggcgacttcaagaacagagccgagatgatcgacttcaacatcagaatcaagaacgtgaccagaagcgacgccggcaagtacagatgcgaggtgagcgcccccagcgagcagggccagaacctggaggaggacaccgtgaccctggaggtgctggtggcccccgccgtgcccagctgcgaggtgcccagcagcgccctgagcggcaccgtggtggagctgagatgccaggacaaggagggcaaccccgcccccgagtacacctggttcaaggacggcatcagactgctggagaaccccagactgggcagccagagcaccaacagcagctacaccatgaacaccaagaccggcaccctgcagttcaacaccgtgagcaagctggacaccggcgagtacagctgcgaggccagaaacagcgtgggctacagaagatgccccggcaagagaatgcaggtggacgacctgaacatcagcggcatcatcgccgccgtggtggtggtggccctggtgatcagcgtgtgcggcctgggcgtgtgctacgcccagagaaagggctacttcagcaaggagaccagcttccagaagagcaacagcagcagcaaggccaccaccatgagcgagaacgtgcagtggctgacccccgtgatccccgccctgtggaaggccgccgccggcggcagcagaggccaggagttctag

SEQ ID NO: 85903 - DNA, 933 bp, Artificial Sequence
  Description of Artificial Sequence: Synthetic coding sequence
atggccctgagaagaccccccagactgagactgtgcgccagactgcccgacttcttcctgctgctgctgttcagaggctgcctgatcggcgccgtgaacctgaagagcagcaacagaacccccgtggtgcaggagttcgagagcgtggagctgagctgcatcatcaccgacagccagaccagcgaccccagaatcgagtggaagaagatccaggacgagcagaccacctacgtgttcttcgacaacaagatccagggcgacctggccggcagagccgagatcctgggcaagaccagcctgaagatctggaacgtgaccagaagagacagcgccctgtacagatgcgaggtggtggccagaaacgacagaaaggagatcgacgagatcgtgatcgagctgaccgtgcaggtgaagcccgtgacccccgtgtgcagagtgcccaaggccgtgcccgtgggcaagatggccaccctgcactgccaggagagcgagggccaccccagaccccactacagctggtacagaaacgacgtgcccctgcccaccgacagcagagccaaccccagattcagaaacagcagcttccacctgaacagcgagaccggcaccctggtgttcaccgccgtgcacaaggacgacagcggccagtactactgcatcgccagcaacgacgccggcagcgccagatgcgaggagcaggagatggaggtgtacgacctgaacatcggcggcatcatcggcggcgtgctggtggtgctggccgtgctggccctgatcaccctgggcatctgctgcgcctacagaagaggctacttcatcaacaacaagcaggacggcgagagctacaagaaccccggcaagcccgacggcgtgaactacatcagaaccgacgaggagggcgacttcagacacaagagcagcttcgtgatctag

SEQ ID NO: 85904 - DNA, 780 bp, Artificial Sequence
  Description of Artificial Sequence: Synthetic coding sequence
atggccctgagaagaccccccagactgagactgtgcgccagactgcccgacttcttcctgctgctgctgttcagaggctgcctgatcggcgccgtgaacctgaagagcagcaacagaacccccgtggtgcaggagttcgagagcgtggagctgagctgcatcatcaccgacagccagaccagcgaccccagaatcgagtggaagaagatccaggacgagcagaccacctacgtgttcttcgacaacaagatccaggtgaagcccgtgacccccgtgtgcagagtgcccaaggccgtgcccgtgggcaagatggccaccctgcactgccaggagagcgagggccaccccagaccccactacagctggtacagaaacgacgtgcccctgcccaccgacagcagagccaaccccagattcagaaacagcagcttccacctgaacagcgagaccggcaccctggtgttcaccgccgtgcacaaggacgacagcggccagtactactgcatcgccagcaacgacgccggcagcgccagatgcgaggagcaggagatggaggtgtacgacctgaacatcggcggcatcatcggcggcgtgctggtggtgctggccgtgctggccctgatcaccctgggcatctgctgcgcctacagaagaggctacttcatcaacaacaagcaggacggcgagagctacaagaaccccggcaagcccgacggcgtgaactacatcagaaccgacgaggagggcgacttcagacacaagagcagcttcgtgatctag

SEQ ID NO: 85905 - DNA, 1068 bp, Artificial Sequence
  Description of Artificial Sequence: Synthetic coding sequence
atggtgcccgccagactgggccccgccgtggccatggtgaccggcgccggcagaagagtgctggccggctgggcccacgccagaggcgactacaagcccagaagagccgccgccggccccagcgccaccctggacatggccctgagaagaccccccagactgagactgtgcgccagactgcccgacttcttcctgctgctgctgttcagaggctgcctgatcggcgccgtgaacctgaagagcagcaacagaacccccgtggtgcaggagttcgagagcgtggagctgagctgcatcatcaccgacagccagaccagcgaccccagaatcgagtggaagaagatccaggacgagcagaccacctacgtgttcttcgacaacaagatccagggcgacctggccggcagagccgagatcctgggcaagaccagcctgaagatctggaacgtgaccagaagagacagcgccctgtacagatgcgaggtggtggccagaaacgacagaaaggagatcgacgagatcgtgatcgagctgaccgtgcaggtgaagcccgtgacccccgtgtgcagagtgcccaaggccgtgcccgtgggcaagatggccaccctgcactgccaggagagcgagggccaccccagaccccactacagctggtacagaaacgacgtgcccctgcccaccgacagcagagccaaccccagattcagaaacagcagcttccacctgaacagcgagaccggcaccctggtgttcaccgccgtgcacaaggacgacagcggccagtactactgcatcgccagcaacgacgccggcagcgccagatgcgaggagcaggagatggaggtgtacgacctgaacatcggcggcatcatcggcggcgtgctggtggtgctggccgtgctggccctgatcaccctgggcatctgctgcgcctacagaagaggctacttcatcaacaacaagcaggacggcgagagctacaagaaccccggcaagcccgacggcgtgaactacatcagaaccgacgaggagggcgacttcagacacaagagcagcttcgtgatctag

SEQ ID NO: 85906 - DNA, 1986 bp, Artificial Sequence
  Description of Artificial Sequence: Synthetic coding sequence
atgaccggcggcagattcgacttcgacgacggcggcacctactgcggcggctgggaggagggcaaggcccacggccacggcatctgcaccggccccaagggccagggcgagtacagcggcagctggagccacggcttcgaggtggtgggcggctacacctggcccagcggcaacacctaccagggctactgggcccagggcaagagacacggcctgggcgtggagaccaagggcaagtggatgtacagaggcgagtggagccacggcttcaagggcagatacggcgtgagacagagcctgtgcacccccgccagatacgagggcacctggagcaacggcctgcaggacggctacggcgtggagacctacggcgacggcggcacctaccagggccagtgggccggcggcatgagacacggctacggcgtgagacagagcgtgccctacggcatggccaccgtgatcagaagccccctgagaaccagcctggccagcctgagaagcgagcagagcaacggcagcgtgctgcacgacgccgccgccgccgccgacagccccgccggcaccagaggcggcttcgtgctgaacttccacgccgacgccgagctggccggcaagaagaagggcggcctgttcagaagaggcagcctgctgggcagcatgaagctgagaaagagcgagagcaagagcagcatcagcagcaagagaagcagcgtgagaagcgacgccgccatgagcagaatcagcagcagcgacgccaacagcaccatcagcttcggcgacgtggactgcgacttctgccccgtggaggaccacgtggacgccaccaccaccgagacctacatgggcgagtggaagaacgacaagagaaacggcttcggcgtgagcgagagaagcaacggcatgaagtacgagggcgagtgggccaacaacaagagacacggctacggctgcaccgtgttccccgacggcagcaaggaggagggcaagtacaagaacaacatcctggtgagaggcatcagaaagcagctgatccccatcagacacaccaagaccagagagaaggtggacagagccatcgagggcgcccagagagccgccgccatggccagaaccaaggtggagatcgccaacagcagaaccgcccacgccagagccaaggccgacgccgccgaccaggccgccctggccgccagacaggagtgcgacatcgccagagccgtggccagagagctgagccccgacttctaccagcccggccccgactacgtgaagcagagattccaggagggcgtggacgccaaggagaaccccgaggagaaggtgcccgagaagccccccacccccaaggagagcccccacttctacagaaagggcaccaccccccccagaagccccgaggccagccccaagcacagccacagccccgccagcagccccaagcccctgaagaagcagaaccccagcagcggcgccagactgaaccaggacaagagaagcgtggccgacgagcaggtgaccgccatcgtgaacaagcccctgatgagcaaggcccccaccaaggaggccggcgccgtggtgccccagagcaagtacagcggcagacaccacatccccaaccccagcaacggcgagctgcacagccagtaccacggctactacgtgaagctgaacgccccccagcacccccccgtggacgtggaggacggcgacggcagcagccagagcagcagcgccctggtgcacaagcccagcgccaacaagtggagccccagcaagagcgtgaccaagcccgtggccaaggagagcaaggccgagcccaaggccaagaagagcgagctggccatccccaagaaccccgccagcaacgacagctgccccgccctggagaaggaggccaacagcggccccaacagcatcatgatcgtgctggtgatgctgctgaacatcggcctggccatcctgttcgtgcacttcctgacctag

SEQ ID NO: 85907 - DNA, 390 bp, Artificial Sequence
  Description of Artificial Sequence: Synthetic coding sequence
atgagcggcggcagattcgacttcgacgacggcggcgcctactgcggcggctgggagggcggcaaggcccacggccacggcctgtgcaccggccccaagggccagggcgagtacagcggcagctggaacttcggcttcgaggtggccggcgtgtacacctggcccagcggcaacaccttcgagggctactggagccagggcaagagacacggcctgggcatcgagaccaagggcagatggctgtacaagggcgagtggacccacggcttcaagggcagatacggcatcagacagagcagcagcagcggcgccaagtacgagggcacctggaacaacggcctgcaggacggctacggcaccgagacctacgccgacggcggcatgtgctag

SEQ ID NO: 85908 - DNA, 2091 bp, Artificial Sequence
  Description of Artificial Sequence: Synthetic coding sequence
atgagcggcggcagattcgacttcgacgacggcggcgcctactgcggcggctgggagggcggcaaggcccacggccacggcctgtgcaccggccccaagggccagggcgagtacagcggcagctggaacttcggcttcgaggtggccggcgtgtacacctggcccagcggcaacaccttcgagggctactggagccagggcaagagacacggcctgggcatcgagaccaagggcagatggctgtacaagggcgagtggacccacggcttcaagggcagatacggcatcagacagagcagcagcagcggcgccaagtacgagggcacctggaacaacggcctgcaggacggctacggcaccgagacctacgccgacggcggcacctaccagggccagttcaccaacggcatgagacacggctacggcgtgagacagagcgtgccctacggcatggccgtggtggtgagaagccccctgagaaccagcctgagcagcctgagaagcgagcacagcaacggcaccgtggcccccgacagccccgccagccccgccagcgacggccccgccctgcccagccccgccatccccagaggcggcttcgccctgagcctgctggccaacgccgaggccgccgccagagcccccaagggcggcggcctgttccagagaggcgccctgctgggcaagctgagaagagccgagagcagaaccagcgtgggcagccagagaagcagagtgagcttcctgaagagcgacctgagcagcggcgccagcgacgccgccagcaccgccagcctgggcgaggccgccgagggcgccgacgaggccgcccccttcgaggccgacatcgacgccaccaccaccgagacctacatgggcgagtggaagaacgacaagagaagcggcttcggcgtgagcgagagaagcagcggcctgagatacgagggcgagtggctggacaacctgagacacggctacggctgcaccaccctgcccgacggccacagagaggagggcaagtacagacacaacgtgctggtgaaggacaccaagagaagaatgctgcagctgaagagcaacaaggtgagacagaaggtggagcacagcgtggagggcgcccagagagccgccgccatcgccagacagaaggccgagatcgccgccagcagaaccagccacgccaaggccaaggccgaggccgccgagcaggccgccctggccgccaaccaggagagcaacatcgccagaaccctggccagagagctggcccccgacttctaccagcccggccccgagtaccagaagagaagactgctgcaggagatcctggagaacagcgagagcctgctggagccccccgacagaggcgccggcgccgccggcctgccccagccccccagagagagcccccagctgcacgagagagagacccccagacccgagggcggcagccccagccccgccggcacccccccccagcccaagagacccagacccggcgtgagcaaggacggcctgctgagccccggcgcctggaacggcgagcccagcggcgagggcagcagaagcgtgacccccagcgagggcgccggcagaagaagccccgccagacccgccaccgagagaatggccatcgaggccctgcaggccccccccgcccccagcagagagcccgaggtggccctgtaccagggctaccacagctacgccgtgagaaccaccccccccgagcccccccccttcgaggaccagcccgagcccgaggtgagcggcagcgagagcgcccccagcagccccgccaccgcccccctgcaggcccccaccctgagaggccccgagcccgccagagagacccccgccaagctggagcccaagcccatcatccccaaggccgagcccagagccaaggccagaaagaccgaggccagaggcctgaccaaggccggcgccaagaagaaggccagaaaggaggccgccctggccgccgaggccgaggtggaggtggaggaggtgcccaacaccatcctgatctgcatggtgatcctgctgaacatcggcctggccatcctgttcgtgcacctgctgacctag

SEQ ID NO: 85909 - DNA, 2247 bp, Artificial Sequence
  Description of Artificial Sequence: Synthetic coding sequence
atgagcagcggcggcagattcaacttcgacgacggcggcagctactgcggcggctgggaggacggcaaggcccacggccacggcgtgtgcaccggccccaagggccagggcgagtacaccggcagctggagccacggcttcgaggtgctgggcgtgtacacctggcccagcggcaacacctaccagggcacctgggcccagggcaagagacacggcatcggcctggagagcaagggcaagtgggtgtacaagggcgagtggacccacggcttcaagggcagatacggcgtgagagagtgcgccggcaacggcgccaagtacgagggcacctggagcaacggcctgcaggacggctacggcaccgagacctacagcgacggcggcacctaccagggccagtgggtgggcggcatgagacagggctacggcgtgagacagagcgtgccctacggcatggccgccgtgatcagaagccccctgagaaccagcatcaacagcctgagaagcgagcacaccaacggcaccgccctgcaccccgacgccagccccgccgtggccggcagccccgccgtgagcagaggcggcttcgtgctggtggcccacagcgacagcgagatcctgaagagcaagaagaagggcctgttcagaagaagcctgctgagcggcctgaagctgagaaagagcgagagcaagagcagcctggccagccagagaagcaagcagagcagcttcagaagcgaggccggcatgagcaccgtgagcagcaccgccagcgacatccacagcaccatcagcctgggcgaggccgaggccgagctggccgtgatcgaggacgacatcgacgccaccaccaccgagacctacgtgggcgagtggaagaacgacaagagaagcggcttcggcgtgagccagagaagcgacggcctgaagtacgagggcgagtgggccagcaacagaagacacggctacggctgcatgaccttccccgacggcaccaaggaggagggcaagtacaagcagaacatcctggtgggcggcaagagaaagaacctgatccccctgagagccagcaagatcagagagaaggtggacagagccgtggaggccgccgagagagccgccaccatcgccaagcagaaggccgagatcgccgccagcagaaccagccacagcagagccaaggccgaggccgccctgaccgccgcccagaaggcccaggaggaggccagaatcgccagaatcaccgccaaggagttcagccccagcttccagcacagagagaacggcctggagtaccagagacccaagagacagaccagctgcgacgacatcgaggtgctgagcaccggcacccccctgcagcaggagagccccgagctgtacagaaagggcaccacccccagcgacctgacccccgacgacagccccctgcagagcttccccaccagccccgccgccacccccccccccgcccccgccgccagaaacaaggtggcccacttcagcagacaggtgagcgtggacgaggagagaggcggcgacatccagatgctgctggagggcagagccggcgactgcgccagaagcagctggggcgaggagcaggccggcggcagcagaggcgtgagaagcggcgccctgagaggcggcctgctggtggacgacttcagaaccagaggcagcggcagaaagcagcccggcaaccccaagcccagagagagaagaaccgagagcccccccgtgttcacctggaccagccaccacagagccagcaaccacagccccggcggcagcagactgctggagctgcaggaggagaagctgagcaactacagaatggagatgaagcccctgctgagaatggagacccacccccagaagagaagatacagcaagggcggcgcctgcagaggcctgggcgacgaccacagacccgaggacagaggcttcggcgtgcagagactgagaagcaaggcccagaacaaggagaacttcagacccgccagcagcgccgagcccgccgtgcagaagctggccagcctgagactgggcggcgccgagcccagactgctgagatgggacctgaccttcagccccccccagaagagcctgcccgtggccctggagagcgacgaggagaacggcgacgagctgaagagcagcaccggcagcgcccccatcctggtggtgatggtgatcctgctgaacatcggcgtggccatcctgttcatcaacttcttcatctag

SEQ ID NO: 85910 - DNA, 561 bp, Artificial Sequence
  Description of Artificial Sequence: Synthetic coding sequence
atgagcagcggcggcagattcaacttcgacgacggcggcagctactgcggcggctgggaggacggcaaggcccacggccacggcgtgtgcaccggccccaagggccagggcgagtacaccggcagctggagccacggcttcgaggtgctgggcgtgtacacctggcccagcggcaacacctaccagggcacctgggcccagggcaagagacacggcatcggcctggagagcaagggcaagtgggtgtacaagggcgagtggacccacggcttcaagggcagatacggcgtgagagagtgcgccggcaacggcgccaagtacgagggcacctggagcaacggcctgcaggacggctacggcaccgagacctacagcgacggcgacgccaccgccttcggcgccgagcccggccccgaggccagagagctgcccgccgccgccgccgccgccgccgccgccgccgccgccgccgtgagatggttcctgtgcagagagccctggcccgccctgcagctgcccgcctgcctggacagccccatcagcaccccccagtgcacctag

SEQ ID NO: 85911 - DNA, 96 bp, Artificial Sequence
  Description of Artificial Sequence: Synthetic coding sequence
atgcccccccacagcggccagagcagaggcagaaagcccggcagctgcctgctgctgctgctgctgctgctgctgctgctgctgctgctgctgtag

SEQ ID NO: 85912 - DNA, 1836 bp, Artificial Sequence
  Description of Artificial Sequence: Synthetic coding sequence
atgagacagggctacggcgtgagacagagcgtgccctacggcatggccgccgtgatcagaagccccctgagaaccagcatcaacagcctgagaagcgagcacaccaacggcaccgccctgcaccccgacgccagccccgccgtggccggcagccccgccgtgagcagaggcggcttcgtgctggtggcccacagcgacagcgagatcctgaagagcaagaagaagggcctgttcagaagaagcctgctgagcggcctgaagctgagaaagagcgagagcaagagcagcctggccagccagagaagcaagcagagcagcttcagaagcgaggccggcatgagcaccgtgagcagcaccgccagcgacatccacagcaccatcagcctgggcgaggccgaggccgagctggccgtgatcgaggacgacatcgacgccaccaccaccgagacctacgtgggcgagtggaagaacgacaagagaagcggcttcggcgtgagccagagaagcgacggcctgaagtacgagggcgagtgggccagcaacagaagacacggctacggctgcatgaccttccccgacggcaccaaggaggagggcaagtacaagcagaacatcctggtgggcggcaagagaaagaacctgatccccctgagagccagcaagatcagagagaaggtggacagagccgtggaggccgccgagagagccgccaccatcgccaagcagaaggccgagatcgccgccagcagaaccagccacagcagagccaaggccgaggccgccctgaccgccgcccagaaggcccaggaggaggccagaatcgccagaatcaccgccaaggagttcagccccagcttccagcacagagagaacggcctggagtaccagagacccaagagacagaccagctgcgacgacatcgaggtgctgagcaccggcacccccctgcagcaggagagccccgagctgtacagaaagggcaccacccccagcgacctgacccccgacgacagccccctgcagagcttccccaccagccccgccgccacccccccccccgcccccgccgccagaaacaaggtggcccacttcagcagacaggtgagcgtggacgaggagagaggcggcgacatccagatgctgctggagggcagagccggcgactgcgccagaagcagctggggcgaggagcaggccggcggcagcagaggcgtgagaagcggcgccctgagaggcggcctgctggtggacgacttcagaaccagaggcagcggcagaaagcagcccggcaaccccaagcccagagagagaagaaccgagagcccccccgtgttcacctggaccagccaccacagagccagcaaccacagccccggcggcagcagactgctggagctgcaggaggagaagctgagcaactacagaatggagatgaagcccctgctgagaatggagacccacccccagaagagaagatacagcaagggcggcgcctgcagaggcctgggcgacgaccacagacccgaggacagaggcttcggcgtgcagagactgagaagcaaggcccagaacaaggagaacttcagacccgccagcagcgccgagcccgccgtgcagaagctggccagcctgagactgggcggcgccgagcccagactgctgagatgggacctgaccttcagccccccccagaagagcctgcccgtggccctggagagcgacgaggagaacggcgacgagctgaagagcagcaccggcagcgcccccatcctggtggtgatggtgatcctgctgaacatcggcgtggccatcctgttcatcaacttcttcatctag

SEQ ID NO: 85913 - DNA, 1347 bp, Artificial Sequence
  Description of Artificial Sequence: Synthetic coding sequence
atgaccagcagctgctgcgtgaccaacaacctgcaggccagcctgaagagctgccccagacccgccagcgtgtgcagcagcggcgtgaactgcagacccgagctgtgcctgggctacgtgtgccagcccatggcctgcctgcccagcgtgtgcctgcccaccaccttcagacccgccagctgcctgagcaagacctacctgagcagcagctgccaggccgccagcggcatcagcggcagcatgggccccggcagctggtacagcgagggcgccttcaacggcaacgagaaggagaccatgcagttcctgaacgacagactggccagctacctgaccagagtgagacagctggagcaggagaacgccgagctggagagcagaatccaggaggccagccacagccaggtgctgaccatgacccccgactaccagagccacttcagaaccatcgaggagctgcagcagaagatcctgtgcaccaaggccgagaacgccagaatggtggtgaacatcgacaacgccaagctggccgccgacgacttcagagccaagtacgaggccgagctggccatgagacagctggtggaggccgacatcaacggcctgagaagaatcctggacgacctgaccctgtgcaaggccgacctggaggcccaggtggagagcctgaaggaggagctgatgtgcctgaagaagaaccacgaggaggaggtgggcagcctgagatgccagctgggcgacagactgaacatcgaggtggacgccgccccccccgtggacctgaccagagtgctggaggagatgagatgccagtacgaggccatggtggaggccaacagaagagacgtggaggagtggttcaacatgcagatggaggagctgaaccagcaggtggccaccagcagcgagcagctgcagaactaccagagcgacatcatcgacctgagaagaaccgtgaacaccctggagatcgagctgcaggcccagcacagcctgagagacagcctggagaacaccctgaccgagagcgaggccagatacagcagccagctggcccagatgcagtgcatgatcaccaacgtggaggcccagctggccgagatcagagccgacctggagagacagaaccaggagtaccaggtgctgctggacgtgagagccagactggagggcgagatcaacacctacagaagcctgctggagaacgaggactgcaagctgccctgcaacccctgcagcacccccagctgcaccacctgcgtgcccagcccctgcgtgcccagaaccgtgtgcgtgcccagaaccgtgggcatgccctgcagcccctgcccccagggcagatactag

SEQ ID NO: 85914 - DNA, 1641 bp, Artificial Sequence
  Description of Artificial Sequence: Synthetic coding sequence
atggccgaggtggtgagccccgtgcccggcgccggcagaagagagcccggcgaggtgggcagagccagaggcccccccgtggccgaccccggcgtggccctgagcccccagggcgagatcatcgagggctgcagactgcccgtgctgagaagaaaccaggacaacgaggacgagtggcccctggccgagatcctgagcgtgaaggacatcagcggcagaaagctgttctacgtgcactacatcgacttcaacaagagactggacgagtgggtgacccacgagagactggacctgaagaagatccagttccccaagaaggaggccaagacccccaccaagaacggcctgcccggcagcagacccggcagccccgagagagaggtgcccgccagcgcccaggccagcggcaagaccctgcccatccccgtgcagatcaccctgagattcaacctgcccaaggagagagaggccatccccggcggcgagcccgaccagcccctgagcagcagcagctgcctgcagcccaaccacagaagcaccaagagaaaggtggaggtggtgagccccgccacccccgtgcccagcgagaccgcccccgccagcgtgttcccccagaacggcgccgccagaagagccgtggccgcccagcccggcagaaagagaaagagcaactgcctgggcaccgacgaggacagccaggacagcagcgacggcatccccagcgcccccagaatgaccggcagcctggtgagcgacagaagccacgacgacatcgtgaccagaatgaagaacatcgagtgcatcgagctgggcagacacagactgaagccctggtacttcagcccctacccccaggagctgaccaccctgcccgtgctgtacctgtgcgagttctgcctgaagtacggcagaagcctgaagtgcctgcagagacacctgaccaagtgcgacctgagacacccccccggcaacgagatctacagaaagggcaccatcagcttcttcgagatcgacggcagaaagaacaagagctacagccagaacctgtgcctgctggccaagtgcttcctggaccacaagaccctgtactacgacaccgaccccttcctgttctacgtgatgaccgagtacgactgcaagggcttccacatcgtgggctacttcagcaaggagaaggagagcaccgaggactacaacgtggcctgcatcctgaccctgcccccctaccagagaagaggctacggcaagctgctgatcgagttcagctacgagctgagcaaggtggagggcaagaccggcacccccgagaagcccctgagcgacctgggcctgctgagctacagaagctactggagccagaccatcctggagatcctgatgggcctgaagagcgagagcggcgagagaccccagatcaccatcaacgagatcagcgagatcaccagcatcaagaaggaggacgtgatcagcaccctgcagtacctgaacctgatcaactactacaagggccagtacatcctgaccctgagcgaggacatcgtggacggccacgagagagccatgctgaagagactgctgagaatcgacagcaagtgcctgcacttcacccccaaggactggagcaagagaggcaagtggtag

SEQ ID NO: 85915 - DNA, 1386 bp, Artificial Sequence
  Description of Artificial Sequence: Synthetic coding sequence
atggccgaggtgggcgagatcatcgagggctgcagactgcccgtgctgagaagaaaccaggacaacgaggacgagtggcccctggccgagatcctgagcgtgaaggacatcagcggcagaaagctgttctacgtgcactacatcgacttcaacaagagactggacgagtgggtgacccacgagagactggacctgaagaagatccagttccccaagaaggaggccaagacccccaccaagaacggcctgcccggcagcagacccggcagccccgagagagaggtgaagagaaaggtggaggtggtgagccccgccacccccgtgcccagcgagaccgcccccgccagcgtgttcccccagaacggcgccgccagaagagccgtggccgcccagcccggcagaaagagaaagagcaactgcctgggcaccgacgaggacagccaggacagcagcgacggcatccccagcgcccccagaatgaccggcagcctggtgagcgacagaagccacgacgacatcgtgaccagaatgaagaacatcgagtgcatcgagctgggcagacacagactgaagccctggtacttcagcccctacccccaggagctgaccaccctgcccgtgctgtacctgtgcgagttctgcctgaagtacggcagaagcctgaagtgcctgcagagacacctgaccaagtgcgacctgagacacccccccggcaacgagatctacagaaagggcaccatcagcttcttcgagatcgacggcagaaagaacaagagctacagccagaacctgtgcctgctggccaagtgcttcctggaccacaagaccctgtactacgacaccgaccccttcctgttctacgtgatgaccgagtacgactgcaagggcttccacatcgtgggctacttcagcaaggagaaggagagcaccgaggactacaacgtggcctgcatcctgaccctgcccccctaccagagaagaggctacggcaagctgctgatcgagttcagctacgagctgagcaaggtggagggcaagaccggcacccccgagaagcccctgagcgacctgggcctgctgagctacagaagctactggagccagaccatcctggagatcctgatgggcctgaagagcgagagcggcgagagaccccagatcaccatcaacgagatcagcgagatcaccagcatcaagaaggaggacgtgatcagcaccctgcagtacctgaacctgatcaactactacaagggccagtacatcctgaccctgagcgaggacatcgtggacggccacgagagagccatgctgaagagactgctgagaatcgacagcaagtgcctgcacttcacccccaaggactggagcaagagaggcaagtggtag

SEQ ID NO: 85916 - DNA, 1542 bp, Artificial Sequence
  Description of Artificial Sequence: Synthetic coding sequence
atggccgaggtgggcgagatcatcgagggctgcagactgcccgtgctgagaagaaaccaggacaacgaggacgagtggcccctggccgagatcctgagcgtgaaggacatcagcggcagaaagctgttctacgtgcactacatcgacttcaacaagagactggacgagtgggtgacccacgagagactggacctgaagaagatccagttccccaagaaggaggccaagacccccaccaagaacggcctgcccggcagcagacccggcagccccgagagagaggtgcccgccagcgcccaggccagcggcaagaccctgcccatccccgtgcagatcaccctgagattcaacctgcccaaggagagagaggccatccccggcggcgagcccgaccagcccctgagcagcagcagctgcctgcagcccaaccacagaagcaccaagagaaaggtggaggtggtgagccccgccacccccgtgcccagcgagaccgcccccgccagcgtgttcccccagaacggcgccgccagaagagccgtggccgcccagcccggcagaaagagaaagagcaactgcctgggcaccgacgaggacagccaggacagcagcgacggcatccccagcgcccccagaatgaccggcagcctggtgagcgacagaagccacgacgacatcgtgaccagaatgaagaacatcgagtgcatcgagctgggcagacacagactgaagccctggtacttcagcccctacccccaggagctgaccaccctgcccgtgctgtacctgtgcgagttctgcctgaagtacggcagaagcctgaagtgcctgcagagacacctgaccaagtgcgacctgagacacccccccggcaacgagatctacagaaagggcaccatcagcttcttcgagatcgacggcagaaagaacaagagctacagccagaacctgtgcctgctggccaagtgcttcctggaccacaagaccctgtactacgacaccgaccccttcctgttctacgtgatgaccgagtacgactgcaagggcttccacatcgtgggctacttcagcaaggagaaggagagcaccgaggactacaacgtggcctgcatcctgaccctgcccccctaccagagaagaggctacggcaagctgctgatcgagttcagctacgagctgagcaaggtggagggcaagaccggcacccccgagaagcccctgagcgacctgggcctgctgagctacagaagctactggagccagaccatcctggagatcctgatgggcctgaagagcgagagcggcgagagaccccagatcaccatcaacgagatcagcgagatcaccagcatcaagaaggaggacgtgatcagcaccctgcagtacctgaacctgatcaactactacaagggccagtacatcctgaccctgagcgaggacatcgtggacggccacgagagagccatgctgaagagactgctgagaatcgacagcaagtgcctgcacttcacccccaaggactggagcaagagaggcaagtggtag

SEQ ID NO: 85917 - DNA, 1485 bp, Artificial Sequence
  Description of Artificial Sequence: Synthetic coding sequence
atggccgaggtggtgagccccgtgcccggcgccggcagaagagagcccggcgaggtgggcagagccagaggcccccccgtggccgaccccggcgtggccctgagcccccagggcgagatcatcgagggctgcagactgcccgtgctgagaagaaaccaggacaacgaggacgagtggcccctggccgagatcctgagcgtgaaggacatcagcggcagaaagctgttctacgtgcactacatcgacttcaacaagagactggacgagtgggtgacccacgagagactggacctgaagaagatccagttccccaagaaggaggccaagacccccaccaagaacggcctgcccggcagcagacccggcagccccgagagagaggtgaagagaaaggtggaggtggtgagccccgccacccccgtgcccagcgagaccgcccccgccagcgtgttcccccagaacggcgccgccagaagagccgtggccgcccagcccggcagaaagagaaagagcaactgcctgggcaccgacgaggacagccaggacagcagcgacggcatccccagcgcccccagaatgaccggcagcctggtgagcgacagaagccacgacgacatcgtgaccagaatgaagaacatcgagtgcatcgagctgggcagacacagactgaagccctggtacttcagcccctacccccaggagctgaccaccctgcccgtgctgtacctgtgcgagttctgcctgaagtacggcagaagcctgaagtgcctgcagagacacctgaccaagtgcgacctgagacacccccccggcaacgagatctacagaaagggcaccatcagcttcttcgagatcgacggcagaaagaacaagagctacagccagaacctgtgcctgctggccaagtgcttcctggaccacaagaccctgtactacgacaccgaccccttcctgttctacgtgatgaccgagtacgactgcaagggcttccacatcgtgggctacttcagcaaggagaaggagagcaccgaggactacaacgtggcctgcatcctgaccctgcccccctaccagagaagaggctacggcaagctgctgatcgagttcagctacgagctgagcaaggtggagggcaagaccggcacccccgagaagcccctgagcgacctgggcctgctgagctacagaagctactggagccagaccatcctggagatcctgatgggcctgaagagcgagagcggcgagagaccccagatcaccatcaacgagatcagcgagatcaccagcatcaagaaggaggacgtgatcagcaccctgcagtacctgaacctgatcaactactacaagggccagtacatcctgaccctgagcgaggacatcgtggacggccacgagagagccatgctgaagagactgctgagaatcgacagcaagtgcctgcacttcacccccaaggactggagcaagagaggcaagtggtag

SEQ ID NO: 85918 - DNA, 6222 bp, Artificial Sequence
  Description of Artificial Sequence: Synthetic coding sequence
atggtgaagctggccaaccccctgtacaccgagtggatcctggaggccatccagaagatcaagaagcagaagcagagacccagcgaggagagaatctgccacgccgtgagcaccagccacggcctggacaagaagaccgtgagcgagcagctggagctgagcgtgcaggacggcagcgtgctgaaggtgaccaacaagggcctggccagctacaaggaccccgacaaccccggcagattcagcagcgtgaagcccggcaccttccccaagagcgccaagggcagcagaggcagctgcaacgacctgagaaacgtggactggaacaagctgctgagaagagccatcgagggcctggaggagcccaacggcagcagcctgaagaacatcgagaagtacctgagaagccagagcgacctgaccagcaccaccaacaaccccgccttccagcagagactgagactgggcgccaagagagccgtgaacaacggcagactgctgaaggacggcccccagtacagagtgaactacggcagcctggacggcaagggcgccccccagtaccccagcgccttccccagcagcctgccccccgtgagcctgctgccccacgagaaggaccagcccagagccgaccccatccccatctgcagcttctgcctgggcaccaaggagagcaacagagagaagaagcccgaggagctgctgagctgcgccgactgcggcagcagcggccaccccagctgcctgaagttctgccccgagctgaccaccaacgtgaaggccctgagatggcagtgcatcgagtgcaagacctgcagcgcctgcagagtgcagggcagaaacgccgacaacatgctgttctgcgacagctgcgacagaggcttccacatggagtgctgcgacccccccctgagcagaatgcccaagggcatgtggatctgccaggtgtgcagacccaagaagaagggcagaaagctgctgcacgagaaggccgcccagatcaagagaagatacgccaagcccatcggcagacccaagaacaagctgaagcagagactgctgagcgtgaccagcgacgagggcagcatgaacgccttcaccggcagaggcagccccggcagaggccagaagaccaaggtgtgcaccacccccagcagcggccacgccgccagcggcaaggacagcagcagcagactggccgtgaccgaccccaccagacccggcgccaccaccaagatcaccaccaccagcacctacatcagcgccagcaccctgaaggtgaacaagaagaccaagggcctgatcgacggcctgaccaagttcttcacccccagccccgacggcagaagaagcagaggcgagatcatcgacttcagcaagcactacagacccagaaagaaggtgagccagaagcagagctgcaccagccacgtgctggccaccggcaccacccagaagctgaagcccccccccagcagcctgcccccccccacccccatcagcggccagagccccagcagccagaagagcagcaccgccaccagcagccccagcccccagagcagcagcagccagtgcagcgtgcccagcctgagcagcctgaccaccaacagccagctgaaggccctgttcgacggcctgagccacatctacaccacccagggccagagcagaaagaagggccaccccagctacgccccccccaagagaatgagaagaaagaccgagctgagcagcaccgccaagagcaaggcccacttcttcggcaagagagacatcagaagcagattcatcagccacagcagcagcagcagctggggcatggccagaggcagcatcttcaaggccatcgcccacttcaagagaaccaccttcctgaagaagcacagaatgctgggcagactgaagtacaaggtgaccccccagatgggcacccccagccccggcaagggcagcctgaccgacggcagaatcaagcccgaccaggacgacgacaccgagatcaagatcaacatcaagcaggagagcgccgacgtgaacgtgatcggcaacaaggacgtggtgaccgaggaggacctggacgtgttcaagcaggcccaggagctgagctgggagaagatcgagtgcgagagcggcgtggaggactgcggcagataccccagcgtgatcgagttcggcaagtacgagatccagacctggtacagcagcccctacccccaggagtacgccagactgcccaagctgtacctgtgcgagttctgcctgaagtacatgaagagcaagaacatcctgctgagacacagcaagaagtgcggctggttccacccccccgccaacgagatctacagaagaaaggacctgagcgtgttcgaggtggacggcaacatgagcaagatctactgccagaacctgtgcctgctggccaagctgttcctggaccacaagaccctgtactacgacgtggagcccttcctgttctacgtgctgaccaagaacgacgagaagggctgccacctggtgggctacttcagcaaggagaagctgtgccagcagaagtacaacgtgagctgcatcatgatcatgccccagcaccagagacagggcttcggcagattcctgatcgacttcagctacctgctgagcagaagagagggccaggccggcagccccgagaagcccctgagcgacctgggcagactgagctacctggcctactggaagagcgtgatcctggagtacctgtaccaccaccacgagagacacatcagcatcaaggccatcagcagagccaccggcatgtgcccccacgacatcgccaccaccctgcagcacctgcacatgatcgacaagagagacggcagattcgtgatcatcagaagagagaagctgatcctgagccacatggagaagctgaagacctgcagcagagccaacgagctggaccccgacagcctgagatggacccccatcctgatcagcaacgccgccgtgagcgaggaggagagagaggccgagaaggaggccgagagactgatggagcaggccagctgctgggagaaggaggagcaggagatcctgagcaccagagccaacagcagacagagccccgccaaggtgcagagcaagaacaagtacctgcacagccccgagagcagacccgtgaccggcgagagaggccagctgctggagctgagcaaggagagcagcgaggaggaggaggaggaggaggacgaggaggaggaggaggaggaggaggaggaggaggaggacgaggaggaggaggaggaggaggaggaggaggaggaggaggagaacatccagagcagcccccccagactgaccaagccccagagcgtggccatcaagagaaagagacccttcgtgctgaagaagaagagaggcagaaagagaagaagaatcaacagcagcgtgaccaccgagaccatcagcgagaccaccgaggtgctgaacgagcccttcgacaacagcgacgaggagagacccatgccccagctggagcccacctgcgagatcgaggtggaggaggacggcagaaagcccgtgctgagaaaggccttccagcaccagcccggcaagaagagacagaccgaggaggaggagggcaaggacaaccactgcttcaagaacgccgacccctgcagaaacaacatgaacgacgacagcagcaacctgaaggagggcagcaaggacaaccccgagcccctgaagtgcaagcaggtgtggcccaagggcaccaagagaggcctgagcaagtggagacagaacaaggagagaaagaccggcttcaagctgaacctgtacaccccccccgagacccccatggagcccgacgagcaggtgaccgtggaggagcagaaggagaccagcgagggcaagaccagccccagccccatcagaatcgaggaggaggtgaaggagaccggcgaggccctgctgccccaggaggagaacagaagagaggagacctgcgcccccgtgagccccaacaccagccccggcgagaagcccgaggacgacctgatcaagcccgaggaggaggaggaggaggaggaggaggaggaggaggaggaggaggaggaggagggcgaggaggaggagggcggcggcaacgtggagaaggaccccgacggcgccaagagccaggagaaggaggagcccgagatcagcaccgagaaggaggacagcgccagactggacgaccacgaggaggaggaggaggaggacgaggagcccagccacaacgaggaccacgacgccgacgacgaggacgacagccacatggagagcgccgaggtggagaaggaggagctgcccagagagagcttcaaggaggtgctggagaaccaggagaccttcctggacctgaacgtgcagcccggccacagcaaccccgaggtgctgatggactgcggcgtggacctgaccgccagctgcaacagcgagcccaaggagctggccggcgaccccgaggccgtgcccgagagcgacgaggagcccccccccggcgagcaggcccagaagcaggaccagaagaacagcaaggaggtggacaccgagttcaaggagggcaaccccgccaccatggagatcgacagcgagaccgtgcaggccgtgcagagcctgacccaggagagcagcgagcaggacgacaccttccaggactgcgccgagacccaggaggcctgcagaagcctgcagaactacaccagagccgaccagagcccccagatcgccaccaccctggacgactgccagcagagcgaccacagcagccccgtgagcagcgtgcacagccaccccggccagagcgtgagaagcgtgaacagccccagcgtgcccgccctggagaacagctacgcccagatcagccccgaccagagcgccatcagcgtgcccagcctgcagaacatggagaccagccccatgatggacgtgcccagcgtgagcgaccacagccagcaggtggtggacagcggcttcagcgacctgggcagcatcgagagcaccaccgagaactacgagaaccccagcagctacgacagcaccatgggcggcagcatctgcggcaacggcagcagccagaacagctgcagctacagcaacctgaccagcagcagcctgacccagagcagctgcgccgtgacccagcagatgagcaacatcagcggcagctgcagcatgctgcagcagaccagcatcagcagcccccccacctgcagcgtgaagagcccccagggctgcgtggtggagagaccccccagcagcagccagcagctggcccagtgcagcatggccgccaacttcaccccccccatgcagctggccgagatccccgagaccagcaacgccaacatcggcctgtacgagagaatgggccagagcgacttcggcgccggccactacccccagcccagcgccaccttcagcctggccaagctgcagcagctgaccaacaccctgatcgaccacagcctgccctacagccacagcgccgccgtgaccagctacgccaacagcgccagcctgagcacccccctgagcaacaccggcctggtgcagctgagccagagcccccacagcgtgcccggcggcccccaggcccaggccaccatgacccccccccccaacctgacccccccccccatgaacctgcccccccccctgctgcagagaaacatggccgccagcaacatcggcatcagccacagccagagactgcagacccagatcgccagcaagggccacatcagcatgagaaccaagagcgccagcctgagccccgccgccgccacccaccagagccagatctacggcagaagccagaccgtggccatgcagggccccgccagaaccctgaccatgcagagaggcatgaacatgagcgtgaacctgatgcccgcccccgcctacaacgtgaacagcgtgaacatgaacatgaacaccctgaacgccatgaacggctacagcatgagccagcccatgatgaacagcggctaccacagcaaccacggctacatgaaccagaccccccagtaccccatgcagatgcagatgggcatgatgggcacccagccctacgcccagcagcccatgcagacccccccccacggcaacatgatgtacaccgcccccggccaccacggctacatgaacaccggcatgagcaagcagagcctgaacggcagctacatgagaagatag

SEQ ID NO: 85919 - DNA, 5673 bp, Artificial Sequence
  Description of Artificial Sequence: Synthetic coding sequence
atggtgaagctggccaaccccctgtacaccgagtggatcctggaggccatccagaagatcaagaagcagaagcagagacccagcgaggagagaatctgccacgccgtgagcaccagccacggcctggacaagaagaccgtgagcgagcagctggagctgagcgtgcaggacggcagcgtgctgaaggtgaccaacaagggcctggccagctacaaggaccccgacaaccccggcagattcagcagcgtgaagcccggcaccttccccaagagcgccaagggcagcagaggcagctgcaacgacctgagaaacgtggactggaacaagctgctgagaagagccatcgagggcctggaggagcccaacggcagcagcctgaagaacatcgagaagtacctgagaagccagagcgacctgaccagcaccaccaacaaccccgccttccagcagagactgagactgggcgccaagagagccgtgaacaacggcagactgctgaaggacggcccccagtacagagtgaactacggcagcctggacggcaagggcgccccccagtaccccagcgccttccccagcagcctgccccccgtgagcctgctgccccacgagaaggaccagcccagagccgaccccatccccatctgcagcttctgcctgggcaccaaggagagcaacagagagaagaagcccgaggagctgctgagctgcgccgactgcggcagcagcggccaccccagctgcctgaagttctgccccgagctgaccaccaacgtgaaggccctgagatggcagtgcatcgagtgcaagacctgcagcgcctgcagagtgcagggcagaaacgccgacaacatgctgttctgcgacagctgcgacagaggcttccacatggagtgctgcgacccccccctgagcagaatgcccaagggcatgtggatctgccaggtgtgcagacccaagaagaagggcagaaagctgctgcacgagaaggccgcccagatcaagagaagatacgccaagcccatcggcagacccaagaacaagctgaagcagagactgctgagcgtgaccagcgacgagggcagcatgaacgccttcaccggcagaggcagccccggcagaggccagaagaccaaggtgtgcaccacccccagcagcggccacgccgccagcggcaaggacagcagcagcagactggccgtgaccgaccccaccagacccggcgccaccaccaagatcaccaccaccagcacctacatcagcgccagcaccctgaaggtgaacaagaagaccaagggcctgatcgacggcctgaccaagttcttcacccccagccccgacggcagaagaagcagaggcgagatcatcgacttcagcaagcactacagacccagaaagaaggtgagccagaagcagagctgcaccagccacgtgctggccaccgacaccgagatcaagatcaacatcaagcaggagagcgccgacgtgaacgtgatcggcaacaaggacgtggtgaccgaggaggacctggacgtgttcaagcaggcccaggagctgagctgggagaagatcgagtgcgagagcggcgtggaggactgcggcagataccccagcgtgatcgagttcggcaagtacgagatccagacctggtacagcagcccctacccccaggagtacgccagactgcccaagctgtacctgtgcgagttctgcctgaagtacatgaagagcaagaacatcctgctgagacacagcaagaagtgcggctggttccacccccccgccaacgagatctacagaagaaaggacctgagcgtgttcgaggtggacggcaacatgagcaagatctactgccagaacctgtgcctgctggccaagctgttcctggaccacaagaccctgtactacgacgtggagcccttcctgttctacgtgctgaccaagaacgacgagaagggctgccacctggtgggctacttcagcaaggagaagctgtgccagcagaagtacaacgtgagctgcatcatgatcatgccccagcaccagagacagggcttcggcagattcctgatcgacttcagctacctgctgagcagaagagagggccaggccggcagccccgagaagcccctgagcgacctgggcagactgagctacctggcctactggaagagcgtgatcctggagtacctgtaccaccaccacgagagacacatcagcatcaaggccatcagcagagccaccggcatgtgcccccacgacatcgccaccaccctgcagcacctgcacatgatcgacaagagagacggcagattcgtgatcatcagaagagagaagctgatcctgagccacatggagaagctgaagacctgcagcagagccaacgagctggaccccgacagcctgagatggacccccatcctgatcagcaacgccgccgtgagcgaggaggagagagaggccgagaaggaggccgagagactgatggagcaggccagctgctgggagaaggaggagcaggagatcctgagcaccagagccaacagcagacagagccccgccaaggtgcagagcaagaacaagtacctgcacagccccgagagcagacccgtgaccggcgagagaggccagctgctggagctgagcaaggagagcagcgaggaggaggaggaggaggaggacgaggaggaggaggaggaggaggaggaggaggaggaggacgaggaggaggaggaggaggaggaggaggaggaggaggaggagaacatccagagcagcccccccagactgaccaagccccagagcgtggccatcaagagaaagagacccttcgtgctgaagaagaagagaggcagaaagagaagaagaatcaacagcagcgtgaccaccgagaccatcagcgagaccaccgaggtgctgaacgagcccttcgacaacagcgacgaggagagacccatgccccagctggagcccacctgcgagatcgaggtggaggaggacggcagaaagcccgtgctgagaaaggccttccagcaccagcccggcaagaagagacagaccgaggaggaggagggcaaggacaaccactgcttcaagaacgccgacccctgcagaaacaacatgaacgacgacagcagcaacctgaaggagggcagcaaggacaaccccgagcccctgaagtgcaagcaggtgtggcccaagggcaccaagagaggcctgagcaagtggagacagaacaaggagagaaagaccggcttcaagctgaacctgtacaccccccccgagacccccatggagcccgacgagcaggtgaccgtggaggagcagaaggagaccagcgagggcaagaccagccccagccccatcagaatcgaggaggaggtgaaggagaccggcgaggccctgctgccccaggaggagaacagaagagaggagacctgcgcccccgtgagccccaacaccagccccggcgagaagcccgaggacgacctgatcaagcccgaggaggaggaggaggaggaggaggaggaggaggaggaggaggaggaggaggagggcgaggaggaggagggcggcggcaacgtggagaaggaccccgacggcgccaagagccaggagaaggaggagcccgagatcagcaccgagaaggaggacagcgccagactggacgaccacgaggaggaggaggaggaggacgaggagcccagccacaacgaggaccacgacgccgacgacgaggacgacagccacatggagagcgccgaggtggagaaggaggagctgcccagagagagcttcaaggaggtgctggagaaccaggagaccttcctggacctgaacgtgcagcccggccacagcaaccccgaggtgctgatggactgcggcgtggacctgaccgccagctgcaacagcgagcccaaggagctggccggcgaccccgaggccgtgcccgagagcgacgaggagcccccccccggcgagcaggcccagaagcaggaccagaagaacagcaaggaggtggacaccgagttcaaggagggcaaccccgccaccatggagatcgacagcgagaccgtgcaggccgtgcagagcctgacccaggagagcagcgagcaggacgacaccttccaggactgcgccgagacccaggaggcctgcagaagcctgcagaactacaccagagccgaccagagcccccagatcgccaccaccctggacgactgccagcagagcgaccacagcagccccgtgagcagcgtgcacagccaccccggccagagcgtgagaagcgtgaacagccccagcgtgcccgccctggagaacagctacgcccagatcagccccgaccagagcgccatcagcgtgcccagcctgcagaacatggagaccagccccatgatggacgtgcccagcgtgagcgaccacagccagcaggtggtggacagcggcttcagcgacctgggcagcatcgagagcaccaccgagaactacgagaaccccagcagctacgacagcaccatgggcggcagcatctgcggcaacggcagcagccagaacagctgcagctacagcaacctgaccagcagcagcctgacccagagcagctgcgccgtgacccagcagatgagcaacatcagcggcagctgcagcatgctgcagcagaccagcatcagcagcccccccacctgcagcgtgaagagcccccagggctgcgtggtggagagaccccccagcagcagccagcagctggcccagtgcagcatggccgccaacttcaccccccccatgcagctggccgagatccccgagaccagcaacgccaacatcggcctgtacgagagaatgggccagagcgacttcggcgccggccactacccccagcccagcgccaccttcagcctggccaagctgcagcagctgaccaacaccctgatcgaccacagcctgccctacagccacagcgccgccgtgaccagctacgccaacagcgccagcctgagcacccccctgagcaacaccggcctggtgcagctgagccagagcccccacagcgtgcccggcggcccccaggcccaggccaccatgacccccccccccaacctgacccccccccccatgaacctgcccccccccctgctgcagagaaacatggccgccagcaacatcggcatcagccacagccagagactgcagacccagatcgccagcaagggccacatcagcatgagaaccaagagcgccagcctgagccccgccgccgccacccaccagagccagatctacggcagaagccagaccgtggccatgcagggccccgccagaaccctgaccatgcagagaggcatgaacatgagcgtgaacctgatgcccgcccccgcctacaacgtgaacagcgtgaacatgaacatgaacaccctgaacgccatgaacggctacagcatgagccagcccatgatgaacagcggctaccacagcaaccacggctacatgaaccagaccccccagtaccccatgcagatgcagatgggcatgatgggcacccagccctacgcccagcagcccatgcagacccccccccacggcaacatgatgtacaccgcccccggccaccacggctacatgaacaccggcatgagcaagcagagcctgaacggcagctacatgagaagatag
